United States Patent 12,569,549 (FLAVIVIRUS VACCINE) - sequence listing, part 36

SEQ ID NO: 13849 - RNA, 9879 nt, synthetic construct
  misc_feature 1..9879: note = derived and/or modified CDS sequence (opt3) from DENV-1__GQ199847__SS-prME
  source 1..9879: mol_type = other RNA
tccgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctgctctgctcaagaacgatgtgcccctggcagggcctcttattgccggaggcatgctcatcgcgtgttacgtcataagtggttccagcgctgacctgtctttggagaaggccgcagaggtgagctgggaagaggaagccgagcattccggggcttcacacaatattttagtagaagtgcaggatgacggaactatgaaaatcaaggatgaggagagggacgatacactgaccatcctcctgaaggcaactcttctggccgtcagtggcgtttatcccttgagcattccagcgacactattcgtgtggtacttttggcagaaaaagaaacaacgatctggcgtgctgtgggacaccccttcacccccagaagtcgagcgcgctgtgctcgatgacgggatatatcggatcatgcagagaggactgcttggtaggagccaggttggcgtaggggtgttccaggaaaacgtctttcatacgatgtggcacgtgactcgtggagccgttttaatgtaccaaggcaagcgcctggagccgagttgggcaagcgtgaaaaaggacctcatttcctacggtgggggatggcggttgcagggctcttggaataccggcgaggaagtccaggtgatcgccgtagagcctgggaagaaccccaaaaatgtccagacagctccaggaaccttcaagacatcggaaggtgaggtgggcgccattgcactggattttaaacccgggactagcggatcacctatcgttaacagagaaggcaagatagtgggtctctatgggaatggagtcgtgaccacgtccggcacatacgttagtgctatcgcccaagcgaaagcctctcaggagggcccactgcccgagattgaagacgaggtgttcaggaagcgaaaccttactatcatggatctgcaccctgggagcggaaagacccggcgctatttgccggcaattgtcagagaagctatcaaaaggaagctacggacactgatactcgccccaacccgagtggtagcttccgagatggcagaagccttaaaaggtatgcccattagataccagactaccgccgtgaagtcagagcatacaggcaaagagatcgttgacctgatgtgccacgctacgtttactatgcgccttctgtctcctgtcagggtgccaaattataacatgatcattatggatgaagcgcatttcaccgaccccagcagtatcgcagcccgtgggtacatatccacacgggtgggaatgggcgaggctgccgcaatttttatgaccgccactcctccgggtagcgtcgaggctttcccccaatctaatgcggtaatccaggatgaggaaagagacattccagagaggtcatggaactccgggtatgagtggatcacagattttcctggaaagaccgtgtggttcgttcccagtataaagagcggcaatgacattgccaactgtctccgcaaaaatggcaagcgagtgatccagttgtcgagaaaaacgttcgatactgaataccagaagaccaaaaacaacgactgggactacgtcgtgaccaccgatatctctgagatgggggcaaattttcgggctgacagggttattgatccacgccgttgcctgaagcctgtgatcctcaaggacggacccgaaagagtcattctggccggtccaatgccggtgactgtagcatccgccgctcaacggaggggccgcatagggcgaaaccacaataaagagggagatcagtatatctacatgggccagcctcttaacaatgacgaggatcatgcccactggacagaagcgaagatgctactggacaacattaatacccccgagggtatcatcccagcattgttcgaacccgagagagagaaaagcgccgctattgatggggagtatcggttaaggggcgaggcccgcaagacatttgtggaactgatgagaaggggagacctccctgtttggctgtcatacaaagtcgctagtgagggcttccagtattctgatcggcgttggtgctttgacggggaacgcaacaatcaagtgcttgaggaaaacatggatgtggagatatggactaaggagggagaaaggaaaaagctgagaccaagatggctcgacgcacggacgtactccgaccccttggccctgcgcgagttcaaggaatttgctgccggtagaaggagcgtctcaggcgatctaatcctggagattgggaaactccctcagcaccttacccagcgggcacagaatgcgctggacaacttagttatgttgcataatagtgaacaaggaggccgagcctatagacacgctatggaggagctgccggatacaatcgaaactctcatgctgcttgccctgattgcagtgctcaccggtggggtaacattgttctttctgagcggccgcggattaggcaagacctccatcgggctactgtgtgtgatggcttctagcgtcctcctttggatggcctccgtggagccacattggatagcagcctcaatcattctggagttctttttgatggttctgctcatccccgagcctgacaggcagcggactccccaggataaccagctggcttacgtggtcattggacttctcttcatgatcctgacggtagcggccaatgagatgggtttgctggaaaccaccaaaaaggacttaggcatagggcacgtggcagttgagaaccaccatcacgctgccatgctagatgtggacctgcatccagcctctgcatggactctctacgctgtcgccaccacaattatcacccctatgatgcgtcacactattgaaaacacaacggcgaatatcagtcttaccgctatagccaaccaagcagccatcctgatgggattggataaaggctggcccatttcgaagatggacatcggtgtgccactgctcgctctggggtgctatagccaggtcaatcctcttactttaacagcagccgtgctgatgctcgttgcgcattacgctattatcggcccgggattgcaggccaaggcaaccagagaggcccagaaaaggaccgctgccggcataatgaagaaccccacagtggatgggattgtagcaatcgacctggatccagtggtctatgacgctaaatttgaaaagcagctaggacagatcatgctgctcattctttgtacttcccagatcctgttgatgcgcacgacctgggccctgtgcgagtctataacactcgcgactggccctctgaccacattatgggagggttcacccgggaaattctggaataccactattgccgttagcatggcaaacatcttccggggatcctaccttgctggcgccggtctggcatttagtctcatgaagtctctaggcgggggacgaagaggcacgggggctcaaggagaaacactgggcgagaagtggaaaaggcagttgaatcagctgagcaagtcagagttcaacacctataaacgctccggtattatggaggtggaccggagtgaagccaaggaggggctcaaaagaggagagactaccaagcacgccgtcagccgtggcacagcgaaacttaggtggtttgtggaacggaatctggtaaaaccagagggtaaggtgatcgatttgggctgtgggcgcggaggctggtcttactattgcgctgggctgaaaaaggttactgaagtgaaaggatacaccaagggcggtcctgggcacgaggaacccataccgatggcaacatacggatggaacctcgtcaaattacattccggcaaggacgtgttctttatcccacctgagaagtgtgatacgctgctttgcgacattggcgagtcaagccccaatccaaccatcgaagaggggcgaactctgagagtcctaaaaatggtggaaccctggctcaggggaaaccagttctgtattaagatcctgaatccttatatgccgtcggttgtagagacattggagcaaatgcagcggaaacacggtggcatgctggtgcgcaaccccctctctagaaatagtacccatgaaatgtactgggtctcctgcgggactggaaacattgtgagcgccgttaatatgacatcaaggatgcttctgaaccgatttaccatggctcaccggaagccaacgtatgagcgtgatgtggacttaggcgccggtaccagacacgtcgcagtggaacctgaggtagccaacctggatatcatagggcagcgcattgaaaatatcaaacatgagcacaagtccacatggcattacgacgaggataacccctataagacttgggcttaccacggatcttatgaagtgaaacctagcggcagtgcgtccagcatggttaatggcgtcgtgaagttgctcaccaaaccatgggacgtgatccccatggtcacacagattgccatgactgataccacacctttcgggcaacagagggtttttaaggagaaagtggacacccggactccaaaggcaaagagaggaacggctcagataatggaagtaacagccaaatggctgtggggtttcctatctcgcaacaagaaacccaggatctgtacccgagaggaatttactcggaaggtgagatcaaatgcagccattggcgctgtcttcgtggacgagaaccaatggaatagtgccaaagaggcggttgaagatgagaggttttgggaccttgtgcatcgcgaacgtgagctgcacaagcaggggaagtgcgcaacctgcgtctacaacatgatgggaaaacgggaaaagaaactcggcgagttcggtaaggccaaagggtccagagctatctggtacatgtggctgggagccaggttcttggagtttgaagcactgggcttcatgaatgaggatcactggtttagccgcgaaaactctctctcgggcgtggagggggagggacttcataagctgggttatattttacgagacatctcaaaaataccgggcgggaatatgtacgctgatgacacagccggatgggatacgcggatcaccgaagacgatctgcagaacgaggctaagattactgacatcatggaacctgagcacgccttgctcgcaaagagcattttcaaactgacatatcagaataaggtagttagagtgcaaaggccagcgaaaaacggcaccgtcatggatgtgatctcccgcagagaccagcggggtagtggacaggtgggaacttacggcctaaatacatttaccaacatggaagcccagcttataaggcaaatggagtctgagggcattttcagcccctccgaactggagacacctaacctcgctgggcgtgtcctggattggttggaaaagcatggagttgagcgattaaaacgcatggccatctcaggtgacgactgtgtggtaaagccaatcgatgacagatttgcaactgctctgaccgccctcaatgatatgggcaaggtgcggaaagacattccccagtgggaaccgagtaaggggtggaacgattggcagcaggtccctttctgctctcaccactttcatcaacttataatgaaagacggaagggagatcgtggttccctgtcgcaatcaggatgagctggtgggcagagcacgggtcagccagggtgccgggtggtccctaagggaaacggcgtgcctgggaaagtcatatgctcagatgtggcaactcatgtacttccaccgacgtgacttgagactggccgcaaacgccatttgtagcgctgatccagacgattgggtgcctacctctcgcacaacttggtccatccatgcccaccatcagtggatgaccacagaggacatgcttagtgtatggaatcgggtttggattgaagagaacccctggatggaagacaaaactcacatcagctcgtggggcgatgtgccatatctgggcaagagggaggaccagtggtgcgggtccctcataggattaaccgcaagagctacgtgggccacaaatatccaagtcgcgattaaccaggtgcgccggctgatcggtaatgagaactacttggattacatgacctctatgaagaggtttaaaaatgaatcagaccccgagggcgctctgtggtga

SEQ ID NO: 13850 - RNA, 9879 nt, synthetic construct
  misc_feature 1..9879: note = derived and/or modified CDS sequence (opt3) from DENV-1__GQ199849__SS-prME
  source 1..9879: mol_type = other RNA
agcgtgaccatgctgctcatgcttatgcccaccgccctggctttccacttgactacgcggggaggggaacctcatatgatcgtcaccaagcaggaaaggggaaaatccttactgtttaagacatctgcgggtgttaacatgtgcactctgattgccatggacctcggagagctgtgtgaagataccatgacatacaaatgcccacggataaccgaggcggaaccggacgatgtggactgttggtgcaatgctactgatacatgggtaacctatgggacgtgttcacgcactggagagcaccgacgtgacaagagaagtgtggcccttgcaccccatgtcggcctgggtttggagaccaggacagaaacttggatgagctccgagggggcctggaaacaaatccagcgggtggaaacctgggctctccgccaccctggattcacagttattgcactgtttctggcccatgctatcggcacctctattacgcagaagggcatcatattcatcctcttaatgctggtgactccatcgatggccatgagatgcgtcgggattggatcaagggattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgcggaaactttgcattgaagctaagatctccaataccacaactgattctcgctgtccaacccagggagaggccacactgatggaagaacaagacgcaaacttcgtctgccgaagaacttttgttgataggggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaggttggtaatgagtcaacggaacacggcacaaccgccactattacaccccaagcgcctacaagtgagatccagctgaccgactacggggccctcactcttgattgtagcccacggacaggactggacttcaacgaaatggtgttgctaacgatgaaggagaaatcttggctggtccataagcagtggtttctcgatctgccgcttccctggacctccggcgcatcaactagccaggagacatggaatcgtcaagacctgttggtgaccttcaaaacagctcacgccaagaagcaggaagtagttgtgctcggtagtcaggagggggctatgcacactgccctgaccggcgcaacggaaatccaaacctctggaacaactaccatttttgccggccatttaaaatgccgcctgaagatggataaactagctctcaaggggatgtcctatgtcatgtgtacaggtagcttcaaactggagaaggaagtggcggagactcagcacggaaccgtccttgtgcagataaagtacgagggcacggacgcaccttgcaaaatcccattctcgacacaggatgaaaagggggttacccaaaacggaagattgattactgccaatcccatcgtgacagacaaagagaagcctgtaaacatagaagctgagccaccctttggcgagtcttatattgtcatcggtgccggggaaaaagcactgaagctctcctggttcaagaaaggctcaagtatcggaaagatgtttgaggccaccgctaggggcgcccggcgaatggcaattctgggggatactgcgtgggacttcggaagcatcggtggcgtgtttacctccgttgggaaacttgtgcatcagattttcggaacagcttacggcgtcctgttttctggtgtgagctggacgatgaagatagggatcggcgtattgctcacctggctgggattaaattcacgcagtacttccctgagcatgacatgtattgccgtgggcctagttaccctctacctgggggtcatggtgcaggcagattctggatgcgtgatcaactggaaaggcagagaacttaagtgtggttcagggatcttcgtcacaaatgaggttcacacttggaccgaacagtataagtttcaagccgacagtccgaaaaggttgagcgctgccattggaaaggcatgggaggagggcgtgtgcggtatacggtccgctacgcgcctggaaaacatcatgtggaaacagatttctaacgagctcaatcatatcctgttagaaaacggcctgaagttcacagtggtagtcggggacgtggttggcattcttgcccagggcaaaaagatgatcagacctcagcccatggagcacaaatactcgtggaaaagctgggggaaggcgaagataatcggagccgatgtgcaaaataccacttttattatcgacggcccaaacacccctgaatgtcccgatgaccagagggcttggaatatttgggaggtcgaggattatggtttcgggatctttacaactaacatatggttgaagctccgtgactcctacacccaggtgtgcgatcaccggctgatgtcagcagccattaaagacagtaaggctgttcatgccgatatgggatattggatcgaatctgagcgaaatgaaacatggaaactagcaagagcgagcttcattgaggtgaagacgtgtatctggccaaagtcccacaccctgtggtcaaacggcgtactcgaaagcgagatgataatccccaaaatttacggtggccctatctctcagcataattataggccagggtacttcactcaaacagccggaccgtggcacctgggcaaacttgagttggactttgatctgtgcgaagggaccactgtcgtggtggacgagcactgcggaaaccgcggcccctccttacggacaaccacggtcactggtaaaattatccatgaatggtgttgcagaagttgtaccctccctccactgaggttcaagggggaggatggatgctggtacggcatggagatacgccccgttaaagaaaaggaggaaaatcttgtgaagtccatggtatctgctggttccggcgaggtggactcatttagtctggggttgctctgtacaagcattatgatcgaagaggtcatgcgatcgcggtggtcccgtaaaatgctgatgaccggaactctagccgtgttcctgctcctgatcatgggccagcttacatggaacgacttgattagactgtgcatcatggttggggcaaatgcttctgataggatgggaatgggcaccacatatttagccctcatggcaacttttaagatgcgccctatgttcgccgtgggtctgctttttcggagactgaccagcagggaggtcctactcctgacgattgggttgtcactggtggctagtgttgaattaccaaactccctcgaggaactgggagacggccttgcgatgggcataatgatcctgaaattgctcacagatttccagtctcaccaactgtgggccaccctactgagccttacttttattaagaccacactctccctgcattacgcatggaaaactatggctatggtgttgtcaatcgtcagcctgttccccttatgtctcagtaccacgtctcagaagacaacctggctgccggtacttctggggtccttgggatgcaagcctctcactatgtttctgattgccgagaataaaatctggggtcgaaagagctggccactaaacgaaggcataatggccgtgggggttgtgtcgatcctgctttcatctctcctgaaaaacgacgtccccttggctggacctttaattgcaggcggtatgctgatcgcctgttatgtgattagtgggtccagcgcggatctctctctggagaaggctgccgaggtaagctgggaagaggaagcagagcactccggagcctcacataatatcttcgtggaagtccaggacgatggcacaatgaaaataaaggacgaggagcgcgatgacacccttactattctgttgaaagctacactactggcagttagtggcgtgtaccccctcagcatcccagccaccctgtttgtgtggtatttctggcagaagaagaaacaacggtctggggtcctttgggatacgccttcacccccagaagtggagagagcggctttagacgatggaatctacaggattatgcagcgtggtctgctcggccgcagccaggttggggtaggagtgttccaggaaaacgtctttcacactatgtggcacgtgacccggggcgccgttttgatgtatcaaggtaagagactggagccgagttgggcaagcgtgaaaaaggacctcatatcctacgggggaggctggaggctgcagggctcttggaatacaggggaggaagtccaggtgatcgccgtagagcctggcaagaatcccaagaatgtccagaccgctccaggtacattcaagactcccgaaggcgaggtgggggccattgcacttgactttaaacctggaacctcgggcagcccaatcgttaaccgagaaggtaagattgtggggctgtacggaaatggcgtcgtgacgacatcaggcacttatgtttccgctatcgcccaaaccaaagcgagtcaggaggggcccttgcctgagatagaagatgaggtgttccggaagcgcaacctaacaatcatggacctgcatccgggatctggtaaaaccagaaggtacctcccagccattgtccgggaagcaatcaagcgaaagttaagaactctgattcttgctcccacccgcgtggtagccagcgagatggctgaagcactgaaaggcatgcctatcaggtatcagacaacggccgtgaagtccgagcacactgggaaagagatagttgatctcatgtgccatgccacctttacaatgcgtttgctgtcaccagtccgggtgcccaattacaacatgattatcatggacgaagctcacttcaccgatccttctagcatcgcggcaagaggatatattagtactagggtgggcatgggtgaggccgctgccatctttatgacagcaaccccgcccgggtccgtcgaagccttcccacaaagcaatgctgtaatacaggacgaggaacgcgatattcctgagcgatcttggaactcaggatacgagtggatcacggactttcccggcaagactgtgtggttcgttccatccattaaaagtggcaatgatatcgcgaactgtctcagaaagaatgggaagcgggtgatacagctgagcaggaaaacatttgacaccgaatatcagaagaccaaaaacaacgattgggactacgtcgtgactacagacatttcggagatgggagccaatttccgcgcagatcgtgttatcgaccctagacggtgccttaagcccgtgatcctaaaagatggtccagaaagggtcattctggctggcccgatgcctgtgaccgtagcctctgcagcccaacgccgagggagaatcggacggaaccataataaggagggcgaccagtacatttatatgggtcagcccttgaacaatgatgaggaccacgctcactggacagaagccaagatgttactggataacataaatactccagaggggatcattcccgcactcttcgaacctgagagggaaaaatccgcagccatcgacggcgagtaccgcctgagaggagaggctaggaagacgtttgtggaacttatgcggcgtggcgatctgccagtttggctcagctataaagtcgcctcagaggggttccagtacagtgaccgccgatggtgctttgatggagaaagaaacaatcaagtgttggaggaaaacatggacgtggagatctggaccaaggagggtgaaaggaaaaagctgcggccccgctggctagatgctagaacatattctgaccctctggcactcagggagttcaaagaatttgccgctggccggcgatccgtcagcggggaccttattctggagataggaaagttaccgcagcatttgactcagagagcccagaatgcactggataacctcgttatgctgcacaattcagaacaaggcggtcgcgcgtacaggcatgccatggaggagcttccagacaccatcgaaacactgatgctcttggctctgattgccgtgttaaccgggggcgtaactctattctttctgagtggacggggcctcgggaagacgagcatcggacttctgtgtgtgatggcatcctctgtcttgctgtggatggctagcgtggagccccactggattgccgcatccatcatactcgagttctttctgatggttcttctcatccctgagcccgatcgtcagagaaccccacaggacaaccagctggcctatgtggtcattggtttgctgttcatcattttaacagtagctgcgaatgagatgggcctactggaaactaccaaaaaggatctcgggatcggacacgtggccgttgagaaccatcaccatgcaacaatgcttgacgtggatctgcaccctgcttcagcctggaccttgtacgccgtcgcaactacaataattacgcccatgatgaggcataccatcgaaaacactacagctaatatttctctgaccgccatcgcgaaccaagctgccatactcatgggcctggacaaaggttggccaatcagtaagatggatattggggtgcctcttttagcactgggctgctactcgcaggtcaatccgctcaccttgacagccgctgtgctgatgctagttgcacactatgccatcattggacccggcctgcaggcgaaagctactcgcgaggcccaaaagcggacggcagccgggatcatgaagaacccaaccgtggacggaatagtagctattgatctcgaccctgtggtctacgatgccaaatttgaaaagcagcttggccagatcatgctgttgatcctgtgtacaagccagattctcctgatgcgaactacctgggcattatgcgagtccatcacacttgctaccggtcccctgactacgctctgggaggggtctccaggaaaattctggaatacaaccatagccgtttcaatggcgaacatttttagaggcagctatctagccggtgcaggcctggctttctccttgatgaagagtctagggggaggcaggcgcgggactggagcccaaggcgaaaccctcggtgagaaatggaagcggcagcttaatcagctgtctaagagcgagttcaacatctacaaaagatcagggattatggaggtggaccgttccgaagcaaaggagggattgaaaaggggcgagacaactcggcacgctgtcagtcgcggtaccgccaagctgcgatggtttgtggaaagaaatctcgtaaaacctgagggcaaggtgatcgacttagggtgtggaaggggcgggtggagctattactgcgccggactgaagaaagttacagaagtgaagggctatacgaaaggtgggcccggacatgaggaaccgataccaatggcgacctacggctggaaccttgtcaagctgcactctggcaaagatgtgttctttactcctcccgagaagtgtgacacactactctgcgatatcggggagtcctcaccaaatcccaccattgaagagggacggactctgcgcgtcttgaaaatggtggaaccttggctgagaggtaaccagttctgtatcaagattctcaatccgtacatgcccagcgttgtagagacacttgagcaaatgcagaggaagcatggcgggatgctggtgcgaaacccattatcgagaaattctacccacgaaatgtattgggtcagttgcggaacgggcaacatcgtgtccgctgttaatatgaccagccgtatgctgttgaacagatttacaatggcacaccgcaaacctacttacgagagggacgtggatctcggtgccgggacccggcatgtcgctgtggaacccgaggtagccaacctggacattatcggacagagaatagaaaatattaagcacgagcataaatcaacatggcactatgatgaggacaacccttacaagacttgggcatatcatggctcctacgaagtgaaaccatctggcagcgccagttccatggttaatggggtcgtgaagctacttaccaagccctgggatgtgatccctatggtcacacagatcgctatgaccgacactacgccattcggacaacagcgcgtttttaaagagaaggtggatacaaggacccccaaagcgaagcgaggtactgcccagattatggaagtaaccgcacggtggctgtggggcttcctcagcagaaacaaaaagccgaggatatgtacacgcgaggaatttacgcgtaaggtgcggtctaatgctgccatcggggcagtcttcgtggacgagaaccaatggaactcagccaaagaggctgttgaagacgagagattttgggatctggtgcagaaggaaagggagttgcacaaacagggaaagtgcgcgacctgcgtctataacatgatgggcaaacgcgaaaagaagctgggtgagttcgggaaagccaagggaagtcgagcaatttggtacatgtggctcggcgcccggtttcttgagttcgaagctctgggcttcatgaatgaggaccactggttttccagagaaaacagcttatctggggtggagggagagggtctgcataaattgggctacatcctcagggatatttcgaagatccctgggggaaatatgtatgccgacgatactgcaggctgggacacacgcataaccgaagatgacctgcagaacgaggctaaaatcactgatattatggaaccagagcacgccctacttgctacatcaatcttcaagctgacctaccaaaataaagtagttagagtgcagcggcccgccaagaacggtacagtcatggacgtgattagcaggcgtgatcagcgagggtccggacaggtgggcacttatggcctcaatacctttacgaacatggaagcacaactgatccgccagatggagagtgaggggatattcttgccttctgaattagagaccccaaacctggcggaaagagtcctcgactggcttgagaagtacggagttgaacggctgaaaaggatggccattagcggtgatgactgtgtggtaaagcccatcgacgatcgctttgctacagccctaactgcactgaatgacatgggcaaagtgagaaaggatatcccgcagtgggagccttccaaagggtggaacgactggcagcaagtccccttctgctcacatcactttcaccagctcattatgaaggatggacgggagatagtggttccatgtaggaatcaggacgaattggtgggccgagctcgtgtcagtcagggtgccgggtggtctctgagagagaccgcatgccttggaaagagctatgcccaaatgtggcagctgatgtacttccatcgccgggatctcaggttagcggctaacgccatctgttccgcagtgcctgtagactgggttcccacatcaagaactacctggagcattcacgcccatcaccagtggatgacgacagaagatatgctgtctgtgtggaatcgcgtctggatcgaggaaaacccatggatggaggacaaaacccatgtgtccagttggggcgatgttccctatttgggcaagcgggaggaccaatggtgcgggagcctgattggactcactgctagggccacatgggcatcgaatatccaggtggctataaaccaggtccgaagacttatcggtaatgaaaactacctggactacatgacctccatgaaacggtttaagaatgagggcgatcctgaaggggccctatggtga

SEQ ID NO: 13851 - RNA, 9879 nt, synthetic construct
  misc_feature 1..9879: note = derived and/or modified CDS sequence (opt3) from DENV-1__FJ898410__SS-prME
  source 1..9879: mol_type = other RNA
agcgtgaccatgctgctcatgcttacccccactgcactggctttccacttgacgaccagaggaggggaacctcatatgatcgtctccaagcaggaaagggggaaatctttactgtttaagacatcagccggtgttaatatgtgcactctaattgccatggacctcggcgagttctgtgaagataccatgacatacaaatgcccacggataaccgaggcggaaccggacgatgtggactgttggtgcaatgctactgatacatgggtaacctatgggacgtgtagtcaaactggagagcaccgccgagacaagcgtagcgtggccctggcaccccatgtcggccttggtctggagaccagaacagaaacttggatgtcctctgagggggcctggaaacagatccagagggtggaaacctgggctttgcggcaccctggatttacagttattgcactcttcctggcccatgctatcggcacctcgattacgcagaagggcatcatatttatcctgctcatgttagtgactccatcaatggccatgcgctgcgtcgggattggaagcagagatttcgtggagggtctgagtggcgcgacatgggtagacgttgtgcttgagcacgggtcctgtgtcaccactatggcaaaggataaacccacattggacatcgaactgctaaagaccgaggtgacgaaccctgccgtgctcaggaaactgtgcattgaagctaagatctctaataccacaactgatagccggtgtccaacccaaggagaggccacacttgtcgaagaacaagacgcaaactttgtttgccgccgaactttcgtggatagaggctggggtaatgggtgtggactgtttggcaaaggctccttgataacctgcgctaagttcaagtgcgtaacaaaactcgaggggaagattgtgcagtacgaaaacctgaaatattcagtcatcgtgaccgttcacactggagaccagcatcaagtgggtaatgagagtacggaacacggcacaaccgccactattacaccccaggcgcctagcacagagatccagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggcaggaccttctggtaacctttaaaacagctcacgccaagaagcaggaagttgtggtcttgggttctcaagagggggctatgcacactgccctcaccggcgcaacggaaatccagacctccggaacaactaccattttcgccggccatctgaaatgccgtttaaagatggataaactgacactaaaggggatgagctatgtgatgtgtactggatcgttcaaactcgagaaggaagtcgctgagacccagcacggtacggtgctggttcagataaagtacgagggcacagacgcgccttgcaaaatcccattttctacccaagatgaaaagggggtgactcagaacggacgccttattacagcaaatcccatcgtaaccgacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaactgccagaggcgctaggcggatggccattctcggggataccgcatgggactttggatccatcggtggcgttttcacatctgtggggaaactggtccatcagatttttggaacggcgtacggcgtgcttttcagcggtgtatcatggaccatgaagatagggatcggcgtgctgttgacttggctcggactgaatagtcgatccactagcttatctatgacctgtattgctgttggcctggtcacactatacctcggggtgatggtgcaggccgattcaggatgcgtcatcaactggaaaggccgcgaactgaagtgtggtagtgggatctttgttactaatgaggtgcacacctggacggaacaatataagttccaggcagacagcccgaaaagactttccgccgctattggaaaggcctgggaggagggcgtgtgcggtataaggtctgcaacacggttggaaaacatcatgtggaaacagatttcgaacgagctgaatcatatcctcctggaaaacgacatgaagttaaccgtagtcgtgggcgatgttgctgggattctggcccagggcaagaagatgatccgccctcaacccatggagtacaaatatagctggaagatatggggcaaggcgaaaatcattggggccgacgtgcagaatactacctttatcattgatggaccaaacacacctgaatgtcccgacgatcagagagcttggaatatctgggaggtcgaggactacggcttcggtatatttactaccaacatttggcttaagttgagggattcctatacacaggtgtgcgaccaccgtctcatgtcagcagccatcaaagatagtaaggctgttcacgccgacatggggtactggattgaatctgagaaaaatgaaacgtggaagctggcacgggcgagcttcatcgaggtgaagacctgtatatggccaaaatcccatactctatggtcaaacggagtactggaaagcgagatgatcattcccaagatctatggcggtcctatttctcaacacaattaccgaccaggctacttcacacagaccgccgggccgtggcatctcggaaaactggagcttgattttgacttgtgcgaaggcactacagtcgtggtggatgagcactgcgggaacagaggaccctccctgaggaccacgactgtcaccggcaagatcatacacgaatggtgttgccgcagttgtacattacctccactccggttcaaaggtgaggacgggtgctggtatggaatggagattagacccgttaaggaaaaggaggaaaatctggtgaaaagcatggtatctgctggctccggtgaggtggactcatttagtcttggcctgttgtgtatcagcatcatgattgaagaggtcatgaggtcgcgctggtcccgaaagatgctcatgaccgggactctggccgtgttctttctactgatcatgggacagctcacatggaacgatctgattcggctttgcataatggttggcgcaaatgcttctgaccgtatggggatgggaaccacatacttggccctgatggcaactttcaaaatgagacctatgtttgccgtgggcttactcttcaggcgcctgaccagccgggaggtccttctgctaacgatcggtctctcactggtggctagtgttgaattgccaaactccctggaggaattaggggatggactcgcgatgggcattatgatcctgaaacttctgacagactttcaatctcatcagttgtgggccaccctcctgagcctaactttcattagaaccacattttccctgcactatgcatggaaaactatggctatggtgctttcaatcgtcagcctcttccccctgtgtttgagtaccacgtctcagaagacaacctggctgccggtattactcggctccctggggtgcaagcctcttactatgtttctgatagccgagaataaaatctggggaagaaagtcctggccattgaacgaaggtattatggccgtgggcatcgtttcgattctcctgtcatctctactgaaaaacgatgtgccccttgctgggcctctcatcgcaggaggcatgctgatagcctgttacgtcattagtggttccagcgcggacttgtctttagagaaggctgccgaggtgagctgggaagaggaagcagagcattccggggcctcacacaatatcctggtagaagtgcaggatgacggaacaatgaaaatcaaggatgaggagcgagacgataccctcactattctgcttaaagctacactgttggcagtcagtggcgtttatcccctaagcataccagccaccctgttcgtgtggtacttctggcaaaagaagaaacagcgctctggcgtgctctgggacacgccttcacccccagaagtcgagcgggcggtgctggatgacgggatctatagaattatgcagaggggacttttaggtcgtagccaggttggcgtaggggtgtttcaagaaaacgtcttccatactatgtggcacgtgacccgcggagctgttctgatgtaccagggcaagcggctcgagccgagttgggccagcgtgaaaaaggacttgatctcctacggtgggggatggagactgcagggctcttggaatacaggcgaggaagtccaggtgattgcagtagagcctgggaaaaaccccaagaatgtccaaaccgccccaggaacatttaagacttcggaaggtgaggtgggcgctatcgccctcgatttcaaacccgggaccagcggatcacctatagttaacagggaaggcaagatcgtgggtctgtatgggaatggagtcgtgacgacatccggcacttacgttagtgcaattgctcaggccaaagcgtctcaggagggcccacttcccgagatcgaagacgaggtgtttcgaaagcggaacctgaccattatggatttgcaccctgggagcggaaaaacacgcagatatctaccggccatcgtcagggaagcaataaagcggcgactgagaaccctcattttagctccaactcgcgtggtagcctccgagatggctgaagcactgaagggtatgcccatcaggtaccaaaccacagccgtgaaatcagagcatacgggcaaggagatcgttgaccttatgtgccacgccactttcaccatgcgtctgctctctcctgtccgggtgccaaattataacatgattatcatggatgaagctcattttacagaccccagcagtatagcggcaagagggtacatttccaccagggtgggaatgggcgaggccgctgccatcttcatgactgcaacacctccgggtagcgtcgaagcctttccccagtctaatgctgtaattcaggatgaggaacgcgacatcccagagcgatcatggaactccgggtatgagtggataaccgatttccctggaaaaacggtgtggtttgttcccagtattaagagcggcaatgacatcgcgaactgtttgaggaaaaatggcaagcgggtgatccagctgtcgaggaagactttcgatacagaataccagaaaaccaagaacaacgactgggactacgtcgtgaccactgatatttctgagatgggggccaatttccgcgcagaccgtgttatcgatccaagacggtgcctcaaacctgtgattctgaaggacggacccgaaagggtcatacttgctggtccaatgccggtgacagtagcctccgcagcccagcgccgaggcagaatcgggcggaaccacaataaagagggagatcagtatatttacatgggccagcctctaaacaatgacgaggatcatgctcactggaccgaagccaagatgctgttggacaacatcaatacacccgagggtatcattccagcgttatttgaacccgagagggaaaagagcgcagccatagatggggagtatcgcctgagaggcgaggctaggaaaactttcgtggaactcatgcggcgtggagacctgcctgtttggctttcatacaaggtcgccagtgagggctttcaatattctgatcgccgatggtgcttcgacggggaaagaaacaatcaggtgctggaggaaaacatggatgtggagatctggacgaaagagggagaaaggaagaaactccggccacgctggttggacgctagaacctactccgaccccctggcactaagggagtttaaggagttcgccgctggtcggcgaagcgtctcaggcgatctgattctcgagatcgggaaacttcctcagcacctgacacagagagcccaaaatgcattagacaacttggttatgctgcataatagtgaacagggaggccgcgcgtataggcacgccatggaggagctcccggatactattgaaaccctgatgcttctggctctcatcgccgtgttgacaggtggggtaaccctgtttttcttaagcggccggggactaggcaagacttccatagggctgctctgtgtgatggcatctagcgtccttctgtggatggcttccgtggagccacattggatcgccgcatcaattatcttggaatttttcctgatggttctcctgattcccgagcctgaccgtcagagaacgccccaggataaccaacttgcctacgtggtcatcggactcctgtttatgatattgaccgtagctgcgaatgagatgggtctgttagaaacaactaagaaagacctaggcattgggcacgtggccgttgagaaccaccatcacgcagctatgctggatgtggacctccatccagcctctgcctggaccctttacgcagtcgctacaaccatcattactcctatgatgaggcacacaatcgaaaacacgaccgccaatataagtctgactgcgatcgctaaccaggccgcaattttgatgggactggataagggctggcccatctcgaaaatggacattggtgtgccactcctggcccttgggtgctatagccaggtcaatcctttaacactgaccgctgcagtgctcatgttggttgcccattacgcgatcataggcccgggactgcaagctaaggccacccgcgaggcacagaaacggacagccgctggcattatgaagaaccccactgtggatgggatcgtagccatcgacctagatccagtggtctatgacgcaaagttcgaaaaacagctgggacagattatgctccttatcctgtgtacgtcccaaatattgctgatgcgaaccacatgggctctctgcgagtctattactctggccaccggccctttaacaaccctttgggagggttcacccgggaagttttggaatactacgatcgcggttagcatggccaacattttcagaggatcctacctggcaggcgctggtctcgccttcagtctaatgaaatctctgggcgggggaaggcgcggcacaggggcacagggagaaaccttgggcgagaagtggaaacggcagctgaatcagctcagcaagccagaatttaacacttataagagatcaggtatcatggaggtggaccgttccgaagctaaagaggggcttaagaggggagagaccacaaaacacgccgtcagtcggggcactgccaagctgcgctggttcgtggaacgaaatttggtaaaacctgagggtaaggtgatagatctgggctgtgggagaggaggctggagctactattgcgcggggctcaagaaagttaccgaagtgaagggatacacaaaaggcggtcccgggcacgaggaaccgatcccaatggctacgtacggatggaacttagtcaagctgcattctggcaaagacgtgtttttcattcctcccgagaagtgtgatacccttctgtgcgacatcggcgagtcctcaccaaatcccactattgaagaggggaggacactacgggtcctcaaaatggtggaaccttggctgcgcggaaaccaattttgtatcaagattttgaatccgtatatgcccagcgttgtagagaccctggagcagatgcagagaaagcacggtggcatgctcgtgaggaacccactttcgcgaaattctactcatgaaatgtactgggtcagttgcgggacaggaaacatcgtgtccgcagttaatatgaccagccggatgctgttaaaccgtttcacgatggcccacagaaaacctacctatgagcgcgatgtggacctgggcgctggtacaaggcacgtcgccgtggaacccgaggtagcaaacttggatataattgggcagcggatcgaaaatatcaagcatgagcacaaatcaacttggcattacgacgaggataacccttataagacctgggcctaccacggatcctatgaagtgaaaccatctggcagcgctagttccatggttaatggcgtcgtgaagctcctgacaaagccctgggacgtgattcctatggtcactcaaatagcgatgaccgatacaaccccatttgggcagcagagagttttcaaagagaaggtggacactcgcacgcccaaagccaagaggggaacagcacaaatcatggaagtaaccgctaaatggctatggggttttcttagccgaaacaagaagccgcggatttgtactagagaggagttcaccaggaaagtgcgctctaatgccgcaatcggcgccgtctttgtggacgagaaccagtggaactcagctaaggaggccgttgaagatgagcgtttctgggacctggtgcatcgggaaagagagctccacaaacaggggaagtgcgcgacatgcgtctacaacatgatgggaaaaagggaaaagaagctgggcgagtttggtaaagcaaaggggagtcgcgccatttggtacatgtggttgggagctcgattcctggagttcgaagccctcggctttatgaatgaggatcactggttctcccgggaaaacagcctttctggcgtggagggggagggactgcataaattaggttatatcctgagagacatatcgaagatccctggcgggaatatgtacgcagatgacacggctggatgggataccaggattactgaagacgatttgcagaacgaggccaaaatcacagacattatggaaccagagcacgctctcctggccaagtcaatctttaaactaacctatcaaaataaggtagttcgcgtgcagagacccgcaaagaacggcactgtcatggatgtgataagccggagggaccagcgtggttccggacaggtgggaacatacggccttaataccttcacaaacatggaagcgcaactgattcgacagatggagagtgagggcatcttttctcctagcgaactcgagactccaaacctggccgggcgcgtcttggattggttagaaaaacatggagttgagagactgaagcggatggctatctccggtgacgactgtgtggtaaaacccattgatgacaggttcgccaccgcactcacggctcttaatgatatgggcaaggtgcgcaaagacataccgcagtgggaaccttcaaaggggtggaacgattggcagcaagtccccttttgcagtcaccacttccatcagctgatcatgaaggacggaagagagattgtggttccatgtcggaatcaggatgagctagtgggcagggcccgagtctctcagggtgcagggtggagcctgcgtgaaaccgcctgcctcggaaaatcctatgcgcaaatgtggcagttgatgtactttcacagacgcgacctgcggcttgctgccaacgcaatctgttcagccgtgcctgtagattgggttcccacaagcaggactacctggtctattcatgctcaccatcagtggatgacaactgaggacatgctgtccgtgtggaatagagtctggatcgaagagaacccatggatggaagataagacccacgtgagtagctggggcgacgttccctatctcggcaaacgcgaggaccaatggtgcgggtcgttaataggactgacggcccgggcaacatgggctaccaatatccaggtggccattaaccaggtcaggcgattgctgggtaatgagaactacctcgattacatgacttccatgaagagattcaaaaatgaatctgaccctgagggcgcgctttggtga

SEQ ID NO: 13852 - RNA, 9879 nt, synthetic construct
  misc_feature 1..9879: note = derived and/or modified CDS sequence (opt3) from DENV-1__FJ898411__SS-prME
  source 1..9879: mol_type = other RNA
tccgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctgctctgctcaagaacgatgtgcccctggcagggcctcttattgccggaggcatgctcatcgcgtgttacgtcataagtggttccagcgctgacctgtctttggagaaggccgcagaggtgagctgggaagaggaagccgagcattccggggcttcacacaatattttagtagaagtgcaggatgacggaactatgaaaatcaaggatgaggagagggacgatacactgaccatcctcctgaaggcaactcttctggccgtcagtggcgtttatcccttgagcattccagcgacactattcgtgtggtacttttggcagaaaaagaaacaacgatctggcgtgctgtgggacaccccttcacccccagaagtcgagcgcgctgtgctcgatgacgggatatatcggatcatgcagagaggactgcttggtaggagccaggttggcgtaggggtgttccaggaaaacgtctttcatacgatgtggcacgtgactcgtggagccgttttaatgtaccaaggcaagcgcctggagccgagttgggcaagcgtgaaaaaggacctcatttcctacggtgggggatggcggttgcagggctcttggaataccggcgaggaagtccaggtgatcgccgtagagcctgggaagaaccccaaaaatgtccagacagctccaggaaccttcaagacatcggaaggtgaggtgggcgccattgcactggattttaaacccgggactagcggatcacctatcgttaacagagaaggcaagatagtgggtctctatgggaatggagtcgtgaccacgtccggcacatacgttagtgctatcgcccaagcgaaagcctctcaggagggcccactgcccgagattgaagacgaggtgttcaggaagcgaaaccttactatcatggatctgcaccctgggagcggaaagacccggcgctatttgccggcaattgtcagagaagctatcaaaaggaagctacggacactgatactcgccccaacccgagtggtagcttccgagatggcagaagccttaaaaggtatgcccattagataccagactaccgccgtgaagtcagagcatacaggcaaagagatcgttgacctgatgtgccacgctacgtttactatgcgccttctgtctcctgtcagggtgccaaattataacatgatcattatggatgaagcgcatttcaccgaccccagcagtatcgcagcccgtgggtacatatccacacgggtgggaatgggcgaggctgccgcaatttttatgaccgccactcctccgggtagcgtcgaggctttcccccaatctaatgcggtaatccaggatgaggaaagagacattccagagaggtcatggaactccgggtatgagtggatcacagattttcctggaaagaccgtgtggttcgttcccagtataaagagcggcaatgacattgccaactgtctccgcaaaaatggcaagcgagtgatccagttgtcgagaaaaacgttcgatactgaataccagaagaccaaaaacaacgactgggactacgtcgtgaccaccgatatctctgagatgggggcaaattttcgggctgacagggttattgatccacgccgttgcctgaagcctgtgatcctcaaggacggacccgaaagagtcattctggccggtccaatgccggtgactgtagcatccgccgctcaacggaggggccgcatagggcgaaaccacaataaagagggagatcagtatatctacatgggccagcctcttaacaatgacgaggatcatgcccactggacagaagcgaagatgctactggacaacattaatacccccgagggtatcatcccagcattgttcgaacccgagagagagaaaagcgccgctattgatggggagtatcggttaaggggcgaggcccgcaagacatttgtggaactgatgagaaggggagacctccctgtttggctgtcatacaaagtcgctagtgagggcttccagtattctgatcggcgttggtgctttgacggggaacgcaacaatcaagtgcttgaggaaaacatggatgtggagatatggactaaggagggagaaaggaaaaagctgagaccaagatggctcgacgcacggacgtactccgaccccttggccctgcgcgagttcaaggaatttgctgccggtagaaggagcgtctcaggcgatctaatcctggagattgggaaactccctcagcaccttacccagcgggcacagaatgcgctggacaacttagttatgttgcataatagtgaacaaggaggccgagcctatagacacgctatggaggagctgccggatacaatcgaaactctcatgctgcttgccctgattgcagtgctcaccggtggggtaacattgttctttctgagcggccgcggattaggcaagacctccatcgggctactgtgtgtgatggcttctagcgtcctcctttggatggcctccgtggagccacattggatagcagcctcaatcattctggagttctttttgatggttctgctcatccccgagcctgacaggcagcggactccccaggataaccagctggcttacgtggtcattggacttctcttcatgatcctgacggtagcggccaatgagatgggtttgctggaaaccaccaaaaaggacttaggcatagggcacgtggcagttgagaaccaccatcacgctgccatgctagatgtggacctgcatccagcctctgcatggactctctacgctgtcgccaccacaattatcacccctatgatgcgtcacactattgaaaacacaacggcgaatatcagtcttaccgctatagccaaccaagcagccatcctgatgggattggataaaggctggcccatttcgaagatggacatcggtgtgccactgctcgctctggggtgctatagccaggtcaatcctcttactttaacagcagccgtgctgatgctcgttgcgcattacgctattatcggcccgggattgcaggccaaggcaaccagagaggcccagaaaaggaccgctgccggcataatgaagaaccccacagtggatgggattgtagcaatcgacctggatccagtggtctatgacgctaaatttgaaaagcagctaggacagatcatgctgctcattctttgtacttcccagatcctgttgatgcgcacgacctgggccctgtgcgagtctataacactcgcgactggccctctgaccacattatgggagggttcacccgggaaattctggaataccactattgccgttagcatggcaaacatcttccggggatcctaccttgctggcgccggtctggcatttagtctcatgaagtctctaggcgggggacgaagaggcacgggggctcaaggagaaacactgggcgagaagtggaaaaggcagttgaatcagctgagcaagtcagagttcaacacctataaacgctccggtattatggaggtggaccggagtgaagccaaggaggggctcaaaagaggagagactaccaagcacgccgtcagccgtggcacagcgaaacttaggtggtttgtggaacggaatctggtaaaaccagagggtaaggtgatcgatttgggctgtgggcgcggaggctggtcttactattgcgctgggctgaaaaaggttactgaagtgaaaggatacaccaagggcggtcctgggcacgaggaacccataccgatggcaacatacggatggaacctcgtcaaattacattccggcaaggacgtgttctttatcccacctgagaagtgtgatacgctgctttgcgacattggcgagtcaagccccaatccaaccatcgaagaggggcgaactctgagagtcctaaaaatggtggaaccctggctcaggggaaaccagttctgtattaagatcctgaatccttatatgccgtcggttgtagagacattggagcaaatgcagcggaaacacggtggcatgctggtgcgcaaccccctctctagaaatagtacccatgaaatgtactgggtctcctgcgggactggaaacattgtgagcgccgttaatatgacatcaaggatgcttctgaaccgatttaccatggctcaccggaagccaacgtatgagcgtgatgtggacttaggcgccggtaccagacacgtcgcagtggaacctgaggtagccaacctggatatcatagggcagcgcattgaaaatatcaaacatgagcacaagtccacatggcattacgacgaggataacccctataagacttgggcttaccacggatcttatgaagtgaaacctagcggcagtgcgtccagcatggttaatggcgtcgtgaagttgctcaccaaaccatgggacgtgatccccatggtcacacagattgccatgactgataccacacctttcgggcaacagagggtttttaaggagaaagtggacacccggactccaaaggcaaagagaggaacggctcagataatggaagtaacagccaaatggctgtggggtttcctatctcgcaacaagaaacccaggatctgtacccgagaggaatttactcggaaggtgagatcaaatgcagccattggcgctgtcttcgtggacgagaaccaatggaatagtgccaaagaggcggttgaagatgagaggttttgggaccttgtgcatcgcgaacgtgagctgcacaagcaggggaagtgcgcaacctgcgtctacaacatgatgggaaaacgggaaaagaaactcggcgagttcggtaaggccaaagggtccagagctatctggtacatgtggctgggagccaggttcttggagtttgaagcactgggcttcatgaatgaggatcactggtttagccgcgaaaactctctctcgggcgtggagggggagggacttcataagctgggttatattttacgagacatctcaaaaataccgggcgggaatatgtacgctgatgacacagccggatgggatacgcggatcaccgaagacgatctgcagaacgaggctaagattactgacatcatggaacctgagcacgccttgctcgcaaagagcattttcaaactgacatatcagaataaggtagttagagtgcaaaggccagcgaaaaacggcaccgtcatggatgtgatctcccgcagagaccagcggggtagtggacaggtgggaacttacggcctaaatacatttaccaacatggaagcccagcttataaggcaaatggagtctgagggcattttcagcccctccgaactggagacacctaacctcgctgggcgtgtcctggattggttggaaaagcatggagttgagcgattaaaacgcatggccatctcaggtgacgactgtgtggtaaagccaatcgatgacagatttgcaactgctctgaccgccctcaatgatatgggcaaggtgcggaaagacattccccagtgggaaccgagtaaggggtggaacgattggcagcaggtccctttctgctctcaccactttcatcaacttataatgaaagacggaagggagatcgtggttccctgtcgcaatcaggatgagctggtgggcagagcacgggtcagccagggtgccgggtggtccctaagggaaacggcgtgcctgggaaagtcatatgctcagatgtggcaactcatgtacttccaccgacgtgacttgagactggccgcaaacgccatttgtagcgctgtgccagtagattgggttcctacctctcgcacaacttggtccatccatgcccaccatcagtggatgaccacagaggacatgcttagtgtgtggaatcgggtctggattgaagagaacccctggatggaagataaaactcacatcagctcgtggggcgacgtgccatatctgggcaagagggaggaccagtggtgcgggtccctcataggattaaccgcaagagctacgtgggccacaaatatccaagttgcgattaaccaggtgcgccggctgatcggtaatgagaactacttggattacatgacctctatgaagaggtttaaaaatgaatcagaccccgagggcgctctgtggtga

SEQ ID NO: 13853 - RNA, 9879 nt, synthetic construct
  misc_feature 1..9879: note = derived and/or modified CDS sequence (opt3) from DENV-1__FJ898412__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaaaaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctactgctcattatgggacagctgacatggaacgatcttatccggttgtgcattatggttggcgccaatgcatctgaccgtatggggatgggaaccacatatctggctttaatggccacttttaaaatgagacctatgttcgcagtgggcctcctgtttaggcgccttaccagccgggaggtcctgctactcacgataggtctgtcattggtggccagtgttgaactgccaaactccttagaggaactcggggatggactggctatgggcatcatgattcttaagctgttgacagacttccaatctcaccagctctgggcgaccctgctaagcctgacttttatcaaaaccacactttccctccattacgcctggaagactatggcaatggtgctgtcaattgtcagcttgttccccctgtgtttaagtaccacgtctcagaagacaacctggctcccggtactgcttggctccctggggtgcaaacctttgactatgtttctcatcgctgagaataagatatggggaagaaaaagctggccactgaacgaaggtatcatggccgtgggcgttgtgtcgattctactgtcatctcttctcaagaacgatgtccccctggccgggcctttgatcgctggaggcatgttaattgcatgttatgtgatcagtggttccagcgccgacctgtctctcgagaaagcggctgaggtaagctgggaagaggaagccgagcactccggggcatcacataatatactggtggaagtccaggatgacggaacaatgaagattaaagatgaggagagggacgatacccttactatcctgttgaaggccacactactggctgttagtggcgtgtaccccctcagcatcccagcaaccctgttcgtgtggtatttttggcaaaagaaaaagcagcgatctggcgtcctttgggacacgccttcacccccagaagtggagcgcgccgttttagatgacgggatttaccggataatgcagagaggactgctcggtaggagccaggtaggcgtgggggtcttccaagaaaacgtgttccacactatgtggcacgttacccgtggagcggtgttgatgtatcagggcaaacgcctggagccgagttgggctagcgtcaagaaagacctcatctcctacggtgggggatggcggctgcagggctcttggaatacaggcgaggaagtgcaggtaattgccgtcgagcctgggaagaaccccaagaatgtgcaaaccgcaccaggaacatttaaaactcccgaaggtgaggttggcgccatcgctcttgatttcaagcctgggacctcgggaagcccaattgtgaacagagaaggcaaaatcgtcggtctgtacgggaatggagtggttacgacatcaggcacttatgtgtccgccatagcacaggctaaggccagtcaggagggccccttgcctgagatcgaagacgaggtctttaggaaacgaaacctaaccattatggatctgcatccggggtctggaaagacacggcgctacctcccagcgatcgtgagagaagccattaagaggaaattacggaccctgatccttgcacccactcgagtagtggctagcgagatggccgaagctctgaagggtatgcctataagatatcaaaccacagcagttaaatccgagcacacgggcaaggagattgtcgacctcatgtgccatgccactttcaccatgcgcttgctgtcaccagtgagggtgcccaattacaacatgatcatcatggatgaagcccactttacagacccttctagcattgctgcgcgtgggtatatcagtacccgggtcggaatgggcgaggcagccgctatattcatgactgccacaccgcccggttccgtagaagcatttccacagagcaatgccgtgattcaggatgaggaaagagacatccctgagaggtcttggaactcagggtacgagtggattaccgatttccccggaaaaacggtttggtttgtgccatccatcaagagtggcaatgacatagctaactgtctccgcaagaatggcaaacgagtcattcagctgagcagaaagactttcgatacagaatatcagaaaaccaagaacaacgactgggactacgtggttaccactgatatctcggagatgggggcgaattttcgggccgacagggtgatcgatcctcgccgttgccttaaacccgtcattctaaaggacggaccagaaagagtgatcctggcaggtccgatgcctgtaacagtggcttctgccgcacagcggaggggccgcattgggcgaaaccataataaggagggagatcagtacatatatatgggccagcccttgaacaatgacgaggatcacgcccactggaccgaagctaaaatgttactggacaacatcaatacaccagagggtattatccccgccctcttcgaacctgagagagaaaagtccgcggcaatcgatggggagtaccggctgaggggcgaggcccgcaaaactttcgttgaacttatgagaaggggagacctgccagtctggctcagctataaggtggcttcagagggctttcaatacagtgatcggcgttggtgcttcgacggggaacgcaacaatcaggtgttggaggaaaacatggatgtcgagatttggacgaaagagggagaacgaaagaaactgagacccaggtggctagacgcccggacctattctgaccctctggctctccgcgagtttaaggagttcgcagccggtagaaggtccgttagcggcgatcttatactggagatcgggaagttaccgcagcatttgacacagcgggctcaaaatgccctggacaacctcgtgatgctgcacaattcagaacagggaggccgagcatacagacatgcgatggaggagcttccagatactattgaaaccctgatgctcttggccctgatcgctgtattaacaggtggggtgaccctatttttcctgagtggccgcggactcggcaaaactagcattgggcttctgtgtgtcatggcctcctctgtgttgctgtggatggcaagcgttgagccccactggatcgctgcctccataatcctcgaatttttcctgatggtgcttctcattcctgagcccgacaggcagcggacgccacaggataaccaactggcatatgtcgtaatcggattgctgtttatgattttaaccgtggccgctaatgagatgggtctactggaaacaactaagaaagacctcggcatcgggcacgttgcggtggagaaccatcaccatgtcaccatgcttgatgtggacctgcaccctgcctcagcatggacattgtacgctgtcgccaccactataattacacccatgatgcgtcatacgatcgaaaacaccactgccaatatttctctgacagcaatcgctaaccaggccgcgatactcatgggactggataagggctggccaatcagtaaaatggacattggtgtgcctcttttagctctggggtgctactcgcaggttaatccgctcaccttgaccgccgcagtgctgatgctagtagcccactatgctatcattggccccggactgcaagcaaaggccacaagagaggcgcagaagaggactgctgccggcatcatgaaaaacccaacggtggatgggatagtcgcaattgacctcgatcctgttgtgtacgacgccaagttcgaaaaacagcttggacagatcatgctgttgatcctgtgtaccagccaaattctcctgatgcgcacaacttgggctttatgcgagtccatcacccttgccacaggccccctgaccactctctgggagggttctccagggaagttttggaatacgacaatagcagtctcaatggctaacattttccggggaagctatctagccggcgcgggtctggccttttccttgatgaaaagtctgggcgggggacgaagaggcaccggggcacagggagaaactctcggcgagaagtggaagaggcagcttaatcagctgtctaaaagcgagttcaacatctacaagcgctcaggtattatggaggtggaccggtccgaagctaaagaggggttgaagagaggagagaccacacgtcacgccgtaagtaggggcactgcaaaactgcggtggttcgtggaacgcaatctcgttaagcctgagggtaaggtgatcgatttaggctgtgggcgaggaggctggagctattactgcgctgggctgaaaaaggtcaccgaagtgaaaggatatacaaagggcggtcccgggcatgaggaaccgataccaatggccacgtacggatggaaccttgtcaaactgcactctggcaaggacgtgtttttcacccctcccgagaaatgtgatactctactctgcgacatcggcgagtcctcaccaaatcccacaattgaagaggggagaaccctgagggttttgaagatggtagaaccttggctgcggggaaaccaattttgtatcaagattctcaatccgtacatgcccagcgtggtcgagactcttgagcagatgcagcgcaaacatggtggcatgctggtgagaaacccattatcgagaaattctacacacgaaatgtattgggttagttgcgggaccggaaacatcgtgtccgccgtcaatatgacgagccgaatgctgttgaaccggttcaccatggcgcaccgtaagcctacatacgagagagatgtggacctcggcgctggtactcgccatgtagcagtggaacccgaggttgccaacctggatattatcgggcagaggatagaaaatattaaacacgagcataagtcaacctggcactatgacgaggataacccttacaaaacatgggcttatcatggatcctacgaagtcaagccatctggcagcgccagttccatggtgaatggcgtggtcaagctacttactaaaccctgggacgttatccctatggtgacccaaatcgcaatgacagataccactccatttgggcagcagcgggtattcaaggagaaagtggacacgagaacacccaaggccaaacgcggaaccgctcaaattatggaagtcactgcgaggtggctgtggggttttctcagccgaaacaagaagccgcggatatgtaccagagaggagttcacaaggaaagtgcgctctaatgccgcaatcggcgctgtttttgtggacgagaaccagtggaactcagccaaggaggcagtcgaagatgagcgtttctgggacctggtgcagaaagaacgggagttgcacaagcaggggaaatgcgccacgtgcgtatataacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgttgagggggagggactgcataagttgggttacatcctccgggacatttcgaaaatccctggcgggaatatgtatgccgatgacaccgctggatgggatactagaataacagaagacgatctgcaaaacgaggccaagatcaccgacattatggaaccagagcacgcactacttgctacttcaatctttaaactgacataccagaataaggtggtcagggtgcagcgccccgccaagaacggcaccgtgatggatgtcattagcagacgggaccagaggggttccgggcaagttggaacatatggcctcaatactttcaccaacatggaagctcagctgatccgtcagatggagagtgagggcatatttttgccttctgaattagagacgccaaacctggccgaacgagtgctcgattggcttgagaaatacggggtagaacgcctgaagagaatggcaattagcggagacgactgtgtggtcaaacccatcgatgaccggttcgcgaccgccctaacagctctgaatgatatgggtaaggtgaggaaagacatcccgcagtgggagccttccaagggctggaacgattggcaacaggttcccttttgctcacatcacttccaccagctcattatgaaggacgggcgcgagatagtggtcccatgtagaaatcaggatgaattggtgggacgggccagggtaagtcaaggcgcaggttggtctctgcgagagactgcttgccttgggaaaagctatgcccagatgtggcagctgatgtactttcatcgtagagacctccgcttagcagccaacgcgatctgttccgctgttcctgtggattgggtccccacctcacggacaacttggagcattcacgcccatcaccaatggatgaccacggaagacatgctgtctgtgtggaatagggtttggatcgaggaaaacccatggatggaggataagacacatgtgtccagttggggagacgtcccctatttgggcaaaagagaggaccagtggtgcggcagcctgattgggctcaccgcacgcgccacttgggcttcgaatatccaggtggccataaaccaggtacggaggcttatcggaaatgaaaactacctggattacatgacatccatgaagcgattcaaaaatgagggtgaccctgaaggcgcactatggtga

SEQ ID NO: 13854 - RNA, 9879 nt, synthetic construct
  misc_feature 1..9879: note = derived and/or modified CDS sequence (opt3) from DENV-1__GQ199852__SS-prME
  source 1..9879: mol_type = other RNA
agcgtgaccatgctgctcatgcttatgcccacagcactggctttccacttgactacgagaggaggggagcctcatatgatcgtcaccaagcaggaaaggggaaaatccttactgtttaagacctctgccggtgttaatatgtgcactctaattgcaatggacctcggagagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaggaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggcagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggccagcttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcaccactgggacactggctgttttcctactgctcatcatgggacagctgacctggaacgatcttattcggttgtgcatcatggtgggcgccaatgcatctgaccgtatggggatgggaacaacttatctggctttaatggccacctttaaaatgagacctatgttcgcagtcggcctcctgtttaggcgccttacgagccgggaggtgctgctactcacaattggtctgtcattggttgccagtgtggaactgccaaactccttagaggaactcggggatggactggctatgggcataatgatccttaagctgttgaccgacttccaatctcaccagctctgggcgactctgctaagcctgacctttattaaaacaactcttcccctccattgtgcctggaagaccatggcaatggtcctgtccatcgcttcattgttcccgctgtgcttaagcacgacaagtcagaagaccacttggctccctgtactgcttggctctctggggtgtaaaccattgacaatgtttctcattaccgagactaagatctggggaagaaaatcctggcccctgaatgaaggtataatggccgtgggcgttgtgagcatcctactgtcgtcacttctcaagaacgatgtccctctggccgggcccttgattgctggaggcatgttaatcgcatgctacgtgatttctggtagttccgccgacctgagcctcgagaaagcggctgaggtatcttgggaagaggaagccgagcacagcggggcatcccataacatcctggtggtcgttcaggatgacggaacaatgaagataaaagatgaagagagggacgatacccttacgattctgttgaaggccactctactggctgtgtcaggcgtgtatccactcagtatccctgcaaccctgttcgtctggtacttttggcaaaagaaaaagcagcgaagcggcgtgctttgggacacaccctctccaccggaggttgaacgcgccgtattagatgacgggatctatcggattatgcagagaggactgctcggtaggtcccaggtgggcgtcggggtgttccaagagaatgttttccacaccatgtggcacgtgacacgtggagcggtcttgatgtaccagggcaaacgcctggaaccttcatgggctagtgtgaagaaagacctcataagctatggtgggggatggcggctgcagggctcctggaacactggcgaggaggtacaggtcatcgccgtggaacccgggaagaatccaaagaacgttcaaaccgcacccggaacgtttaaaacacctgagggtgaagtgggcgccattgctcttgatttcaagccagggacttctggatcgcccatcgtcaatagagagggcaaaattgtgggtctgtacgggaacggagttgtgaccacaagcggcacctacgtctcagccatcgcacaggctaaggcctcccaggaaggccctttgccggagatagaggacgaagtgtttaggaaacgaaatctaactatcatggatctgcatccagggagtggaaagacccggcgctatctccccgcgattgtaagagaggccatcaagaggaaattacggacactgattcttgcacctacgcgagtggttgcttctgaaatggccgaggctctgaagggtatgccaatcagataccaaactaccgcagtcaaaagcgaacacacaggcaaggagatagtggacctcatgtgtcatgccaccttcactatgcgcttgctgtcccccgtgagggtccctaactataatatgattatcatggatgaggcccactttacagacccgtcatctatcgctgcgcgtgggtacattagcacccgggtaggaatgggcgaagcagccgctatcttcatgacggccactcccccaggtagtgtggaggcatttcctcagtccaacgccgttatacaggatgaagagagagacattcccgaaaggagctggaactctgggtatgagtggatcacagatttcccaggaaaaaccgtgtggtttgtcccttcaattaagtccggcaacgacatcgctaattgcctccgcaagaacggcaaacgagtgatacagctgagtagaaagaccttcgatactgagtaccagaaaaccaagaataacgactgggactatgttgtgaccacagatattagcgaaatgggggcgaactttcgggccgacagggtcatcgatccccgccgttgccttaaaccagtgatcctaaaggacggaccggagagagtaattctggcaggtcctatgcccgtgactgttgcttcggccgcacagcggaggggccgcatcgggcgaaatcataacaaggaaggagatcagtacatttacatgggccagccattgaataacgacgaggatcacgcccactggacggaggctaaaatgttactggacaatataaacacccccgaaggtatcattcctgccctcttcgagccagaaagagagaagtctgcggcaatcgatggggaatatcggctgaggggcgaggcccgcaaaacattcgtcgagcttatgagaaggggagacctgcccgtgtggctctcctacaaggtggctagcgaaggctttcaatattcagatcggcgttggtgtttcgacggggagcgcaataaccaggtcttggaagagaatatggatgttgaaatctggactaaagagggagagcgaaagaaactgagacctaggtggctagacgcccggacctacagtgacccgctggctctccgcgaatttaaggagttcgcagccggtagaaggtctgtgtccggcgatcttattctggaaatagggaagttaccacagcatttgacacagcgggctcaaaacgccctggacaatctcgtaatgctgcacaacagcgagcagggaggccgagcatatagacatgcgatggaggaacttcccgataccatcgagactctgatgctcttggccctgattgctgtgttaacgggtggggtcaccctatttttcctgtcaggccgcggactcggcaaaacaagtatcgggcttctgtgcgtgatggccagctccgttttgctgtggatggcatctgtggaacctcactggattgctgccagcatcatactcgagtttttcctgatggtccttctcatccccgaaccagacaggcagcggactcctcaggataatcaactggcatacgtagtgattggattgctgtttatgatcttaaccgttgccgctaacgagatgggtctactggagacaaccaagaaagacctcggcattgggcacgtggcggtcgaaaatcatcaccatgccactatgcttgatgtggacctgcaccccgcatccgcttggacattgtatgccgtcgccacgaccatcataactccaatgatgcgtcatacaattgagaacaccaccgcaaacatctcactgacagctattgccaatcaggcggctatcctcatgggactggataagggctggcctatatctaaaatggacatcggtgtgccgcttttagccctggggtgttacagtcaggttaaccccctcactttgacggcagccgtgctgatgctagtagctcactacgcaattatcggcccaggactgcaagccaaggcgaccagagaagctcagaagaggacagccgcaggcattatgaaaaatcctactgtggatgggatcgtcgccatagacctcgatcccgttgtgtatgacgctaagttcgagaaacagcttggacagattatgctgttgatcctgtgcacctcgcaaatcctcctgatgcgcacaacctgggccttatgtgaaagcattactcttgcaacgggcccactgacaaccctctgggagggttcccctgggaagttttggaacactaccatcgctgtctctatggccaatatattccggggatcatacctagcgggcgccggtctggcatttagcttgatgaaatccctgggcgggggacgaagaggcacaggggctcagggagagactctcggcgaaaagtggaagaggcagcttaaccagctgagtaaatctgagttcaatatttataagcgcagcggtatcatggaagtggaccggtcagaggccaaagaagggttgaagagaggagagaccacacgtcacgcagtatccaggggcacggctaaactgcggtggttcgtggagcgcaacctcgttaagcccgaaggtaaggtgattgatttaggctgcgggcgaggaggctggagttactattgtgccgggctgaaaaaggtcaccgaggtgaaaggatacactaagggcggtccggggcatgaggagccaatccctatggccacatatggatggaatcttgtcaaactgcacagcggcaaggacgtgtttttcacacccccagaaaaatgcgatactctactctgtgacataggcgagtcttcccccaaccctacaatcgaggaagggagaaccctgagggttttgaagatggtagagccgtggctgcggggaaatcaattttgcattaagatcctcaacccctacatgccatcagtggtcgaaacgcttgagcagatgcagcgcaaacatggtggcatgctggtgagaaatcctttaagcaggaactcgacccacgagatgtactgggtttcttgtgggacaggaaatattgtgagtgcggtcaacatgacttcccgaatgctgttgaatcggttcaccatggctcaccgtaagcccacatatgaaagagatgtggacctcggcgcaggtactcgccatgtagccgtggagcctgaagttgctaacctggatatcattgggcagaggatcgagaacataaaacacgaacataagagcacctggcactacgacgaggataatccatataaaacatgggcctaccatggatcatatgaggtcaagccctccggctctgcaagcagtatggtgaacggcgtggtcaagctacttaccaaaccttgggacgttattccaatggtgactcaaatcgccatgacggatacaaccccctttgggcagcagcgggtattcaaggaaaaagtggacactagaaccccgaaggctaaacgcggaacagcgcaaatcatggaggtcacggccaggtggctgtggggttttctctcccgaaataagaagcctcggatttgcaccagagaagagttcactaggaaagtgcgcagcaacgcagctataggcgccgtttttgtggacgaaaatcagtggaactctgcaaaggaggccgtcgaggatgaacgtttctgggacctggtgcagaaagagcgggaattgcacaagcaggggaaatgcgctacatgtgtatacaatatgatgggaaagagagagaagaaactgggcgaatttggtaaggccaaagggtcaagggcgatctggtatatgtggctcggagcacgcttccttgagtttgaggccctgggcttcatgaacgaagatcactggttcagtcgagaaaattccttaagcggcgttgaaggggagggactgcataagttgggttacattctccgggacatctctaaaattccaggcgggaacatgtacgctgatgacaccgccggatgggatactagaatcacagaggacgatctgcaaaatgaagcaaagataaccgacatcatggagcccgaacacgctctacttgccacatcgatttttaaactgacttatcagaacaaggtggtcagggtgcagcgccctgctaagaatggcaccgtgatggatgtcatctcaagacgggaccagaggggtagcgggcaagttggaacgtacggcctcaacaccttcacaaatatggaggcccagctgattcgtcagatggaatccgagggcatctttttgccaagtgagttagaaactcccaacctggcagagcgagtgctcgattggcttgaaaaatatggggtagagcgcctgaagagaatggcgatatctggagacgactgcgtggtcaaaccgattgatgaccggttcgccaccgctctaacagccctgaacgatatgggtaaggtgaggaaagacatccctcagtgggaacccagcaagggctggaatgattggcaacaggttccattttgttcccatcacttccaccagctcatcatgaaggacgggcgcgagattgtggtcccttgcagaaaccaggatgagttggtgggacgggcaagggtatcacaaggcgctggttggagtctgcgagaaactgcctgtcttgggaaatcttacgcacagatgtggcagctgatgtattttcatcgtagagacctccgcttagccgcgaatgctatatgcagcgccgttcccgtggattgggtcccaacctcccggacgacatggtcaatccacgcacatcaccaatggatgaccactgaggacatgctgagcgtgtggaacagggtttggattgaagagaatccctggatggaagataagacacatgtgtcttcctggggagacgtcccttacttgggcaaaagagaggaccagtggtgtggcagtctgatcgggctcaccgcccgcgctacttgggccagcaacattcaggtggcaatcaatcaggtacggaggcttataggaaacgagaattatctggattacatgacctcgatgaagcgattcaaaaacgaaggtgacccagagggcgctctatggtga

SEQ ID NO: 13855 - RNA, 9879 nt, synthetic construct
  misc_feature 1..9879: note = derived and/or modified CDS sequence (opt3) from DENV-1__FJ898415__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggaagcttcaaactggagaaggaagtggctgagacccagcacggtacggtccttgtgcagataaagtacgagggcacagacgcgccttgcaaaatcccattcttgacccaagatgaaaagggggttactcagaacggacgcctgattacagcaaatcccatcgtgaccgacaaagagaagcctgtaaacatagaagccgagccaccctttggcgagtcgtatattgtcatcggtgctggggaaaaagccctcaagctgtcttggttcaagaaaggctccaatatcggaaagatgtttgaggcaactgccagaggcgctaggcggatggccattcttggggataccgcatgggacttcggatcaatcggtggcgtgtttacaagtgttgggaaactggtgcatcagattttcggaacggcgtacggcgtcttgtttagcggtgtgtcctggaccatgaagatagggatcggcgtactcctgacttggttaggactgaactctcgaagcacatcactaagtatgacctgtattgctgtgggcctcgttacactgtaccttggggtcatggtgcaggccgattccggatgcgtgatcaattggaaaggccgcgaattgaagtgtggtagcgggatcttcgtcactaacgaggttcacacctggacggaacaatataagtttcaggcagactctccgaaaagactgtcagccgctattggaaaggcctgggaggagggcgtgtgcggtataaggagtgcaacacggctcgaaaacatcatgtggaaacagattagcaatgagctgaaccatatcttactggaaaatgacatgaagttcaccgtggtagtcggcgatgtggttgggattcttgctcagggaaaaaagatgatccgccctcaacccatggagcacaaatactcctggaagtcttggggcaaggccaaaataatcggggcggacgtgcagaacactacctttattatcgatggaccaaatacacctgaatgtcccgacgatcagagagcctggaacatttgggaggtcgaggactatggcttcggtatctttactaccaatatatggttgaagctcagggattcgtacacacaggtgtgcgaccaccgtctgatgagcgctgcaattaaagattccaaggccgttcatgctgacatggggtattggatcgaatcagagaaaaacgaaacgtggaagctagcccgggcaagtttcattgaggtgaagacctgtatctggccaaaatctcacactctgtggagcaatggagtactcgaatccgagatgataatccccaagatttacggcggtcctatctcacaacataactatcgaccaggctacttcacacagaccgcggggccgtggcacctgggaaaacttgagttggattttgacctgtgcgaaggcactacagtcgtggtggatgagcactgcgggaatagaggacccagcttaaggaccacgactgtcaccggcaagacaattcatgaatggtgttgccgctcttgtaccctccctccactgcggttcaaaggtgaggacgggtgctggtacggaatggagatcagacccgttaaggaaaaggaggaaaaccttgtgaaatccatggtaagtgccggcagcggtgaggtggactctttttccctgggcttgctctgtatatcaattatgatcgaagaggtcatgaggagtcgctggagccgaaagatgctgatgactgggacactagctgtgttcctgctcctgatcatgggacagcttacctggaatgatttgattcggctgtgcatcatggttggcgccaacgcatcggaccgtatggggatgggaacaacttatttagctctcatggccacctttaaaatgagacctatgttcgcagtgggcctgctttttaggcgcctgacgtcccgggaggtcctactcctgacaattggtttgtctctggtggccagcgttgaattaccaaattcactcgaggaactgggggatggacttgctatgggcataatgatcctgaagttgctcaccgacttccaaagtcaccagctgtgggcgactctactgtcccttacctttattaaaacaactctctctctgcattacgcctggaagaccatggcaatggtgttgagcatcgtctccctgttccccttatgtctctcaacgacaagccagaagaccacttggctgccggtacttctgggcagtttggggtgcaaacctctcacaatgtttctgattgctgagaacaagatctggggaagaaaatcttggccactaaacgaaggtataatggccgtgggcgttgtgtccatcctgcttagctcgctcctgaagaatgatgtccccttggccgggcctttaattgctggaggcatgctgatcgcatgttatgtgatttcaggttctagtgccgacctctccctggagaaagcggctgaggtaagctgggaagaggaagccgagcactctggggcaagccataacatccttgtggaagtccaggatgacggaaccatgaagataaaagatgaggagagggacgatactctgacaattttgctaaaggccaccctgctcgctgtttccggcgtgtaccccctgtcaatcccagcaacgcttttcgtgtggtatttttggcaaaagaaaaagcagcgaagtggcgtcttatgggacactcctagccccccagaagtggagcgcgccgttctggatgacgggatctaccggattatgcagagaggactcttgggtaggtctcaggtaggcgtgggggtcttccaagaaaatgtgttccacaccatgtggcacgttacacgtggagcggtgctgatgtatcagggcaaacgcctcgagccgtcctgggcttcagtcaagaaagacctgataagttacggtgggggatggcggcttcagggcagctggaacaccggcgaggaagtgcaggtaatcgccgtcgagcctgggaagaatcccaagaacgtgcaaacagcaccaggaacttttaaaacccccgaaggtgaggttggcgccattgctctggatttcaagcctgggacgtccggatctccaatcgtgaatagagaaggcaaaattgtcggtttgtacgggaacggagtggttacaacttcgggcacctatgtgagcgccatcgcacaggctaaggcctcacaggagggccccctacctgagatagaagacgaggtctttaggaaacgaaatctgacaatcatggatctccatccggggtccggaaagacccggcgctacttaccagcgattgtgagagaagccatcaagaggaaactgcggactcttattctggcacccacccgagtagtggctagtgagatggccgaagctctcaagggtatgcctatcagatatcaaacaacggcagttaaatctgagcacactggcaaggagatagtcgacttgatgtgccatgccaccttcacaatgcgcctgctcagcccagtgagggtgcccaactacaatatgattatcatggatgaagcccactttaccgacccttcctcaatcgctgcgcgtgggtatatttctactcgggtcggaatgggcgaggcagccgctatcttcatgacagccaccccgcccggtagcgtagaagcatttccacagagtaacgccgtgatacaggatgaggaaagagacattcctgagaggtcctggaatagcgggtacgagtggatcacggatttccccggaaaaactgtttggtttgtgccatctattaagtcaggcaacgacatcgctaattgtctgcgcaagaacggcaaacgagtcatacagctttccagaaagacattcgataccgaatatcaaaaaaccaagaacaatgactgggactacgtggttactacagatattagtgagatgggggcgaactttcgggccgacagggtgatcgatcctcgccgttgcctaaaacccgtcatcctgaaggacggaccagaaagagtgattttggcaggtccgatgcctgtaaccgtggctagcgccgcacagcggaggggccgcatcgggcgaaatcataacaaggagggagatcagtacatttatatgggccagcccttaaataacgacgaggatcacgcccactggacagaagctaaaatgctgctcgacaatataaacactccagagggtatcattcccgccctgttcgaacctgagagagaaaagtcggcggcaatcgatggggagtaccggcttaggggcgaggcccgcaaaacgttcgttgaactgatgagaaggggagacctcccagtctggttgtcttataaggtggcttccgagggctttcaatacagcgatcggcgttggtgcttcgacggggaacgcaataaccaggtgctggaggaaaatatggatgtcgagatctggaccaaagagggagaacgaaagaaactaagacccaggtggctggacgcccggacatattcagaccctctcgctcttcgcgagtttaaggaattcgcagccggtagaaggagtgtttctggcgatctgattttagagatagggaagttgccgcagcatctgactcagcgggctcaaaacgccctcgacaatctggtgatgcttcacaactccgaacagggaggccgagcatacagacatgcgatggaggagctgccagataccatcgaaacactcatgttgctggccttaattgctgtactaaccggtggggtgactctgtttttcctcagcggccgcggacttggcaaaacgtcaatcgggctgttgtgtgtcatggccagtagcgtgctgctctggatggcatccgttgagccccactggattgctgcctctatcatactggaatttttccttatggtgctcctgatccctgagcccgacaggcagcggaccccacaggataatcaattggcatatgtcgtaattggactgttatttatgatcctaacagtggccgctaacgagatgggtctgctcgaaactaccaagaaagaccttggcattgggcacgttgcggtggagaaccatcaccatgccacaatgctggatgtcgacttgcaccctgcaagcgcttggaccctgtacgccgtggccactacaatcataacgcccatgatgcgtcataccattgaaaatactacagcaaacatctccctcaccgctattgccaatcaggcggctatcctgatgggacttgataagggctggccaatatcaaaaatggacatcggtgtccctttactggccctcgggtgctactctcaggtgaacccgttgaccctgacagcagccgttctaatgctggtggctcactatgcaattatcggccccggactccaagccaaggcgactagagaggctcagaagaggacggccgcaggcattatgaaaaatccaaccgtagatgggatcgtggccatagaccttgatcctgtcgtttacgacgctaagttcgaaaaacagctgggacagattatgttgctgatcctctgtacaagtcaaatcctgttaatgcgcactacctgggccctttgcgagtcgattacactggcaaccggccccctcactacgctatgggagggtagcccagggaagttttggaacacaaccatcgctgtgtccatggccaatatattccggggatcttatctggcgggcgccggtttggcattttcactgatgaaaagcctcggcgggggacgaagaggcactggggctcagggagaaacccttggcgagaagtggaagaggcagctgaaccagttgtccaaaagtgaattcaatatttacaagcgctctggtatcatggaggtcgaccggagcgaagccaaagaggggctgaagagaggagagacaactcgtcacgcagtgtcaaggggcaccgctaaactccggtggttcgtagaacgcaacttagtgaagcctgagggtaaggttattgatctgggctgtgggcgaggaggctggtcctattactgcgccgggcttaaaaaggtgacagaagtcaaaggatatacgaagggcggtcccgggcatgaggaaccgatcccaatggccacctacggatggaatctggtgaaactacacagtggcaaggacgtctttttcactcctcccgagaaatgtgatacactcctgtgcgacataggcgagagctctccaaaccccaccatcgaagaggggagaactttgagggtgctgaagatggttgaaccttggctccggggaaatcaattttgtattaagatccttaacccgtacatgccctccgtagtggagacactggagcagatgcagcgcaaacatggtggcatgttagtcagaaatccactgtcaaggaacagcacccacgaaatgtattgggtgtcgtgcgggacgggaaatattgtttctgcggtgaacatgaccagtcgaatgttgctcaaccggttcacaatggctcaccgtaagcctacttacgagagagatgtcgacctgggcgcaggtacccgccatgtggccgtagaacccgaggtggctaatctagatatcattgggcagaggatcgaaaacataaaacacgagcataagtccacatggcactatgacgaggataatccttacaaaacttgggcctatcatggaagctacgaagttaagccatcaggctccgcatctagcatggtcaacggcgtggtgaagcttctgaccaaaccctgggacgtcattcctatggttacacaaatcgccatgaccgatactacgccatttgggcagcagcgggtgttcaaggagaaagtagacacaagaacccccaaggctaaacgcggaactgcgcaaatcatggaagtgaccgccaggtggctctggggttttctgagtcgaaataagaagccgcggatttgtacaagagaggaattcacgaggaaagtccgctccaacgcagctataggcgccgtgtttgttgacgagaatcagtggaacagcgcaaaggaggccgtggaagatgagcgtttctgggacttggtccagaaagaacgggagctgcacaagcaggggaaatgcgctacctgcgtgtataatatgatgggaaagagagaaaagaaactcggcgagtttggtaaggccaaagggtctagggcgatctggtacatgtggcttggagcacgcttcctggagtttgaagccttaggcttcatgaacgaggatcactggttctcacgagaaaatagtctgtccggcgtagagggggagggattgcataagctcggttacattctgcgggacatcagcaaaattcctggcgggaacatgtatgctgatgacactgccggatgggatacaagaatcaccgaagacgatctacaaaatgaggcaaagataactgacatcatggaaccagagcacgctcttctggccacatctatttttaaactcacctaccagaacaaggttgtgagggtccagcgccccgctaagaatggcacagtgatggatgtgatctcgagacgggaccagaggggttcagggcaagtcggaacttatggcctgaacaccttcacgaacatggaagcccagttgattcgtcagatggagagcgagggcatcttttcccctagtgaattagagataccaaatctggcagaacgagttctcgattggcttgagaaatacggggtggaacgcctgaagagaatggcgatttctggagacgactgtgtagtgaaacccatcgatgaccggttcgccaccgctctaacagccctgaacgatatgggtaaggtcaggaaagacgtgccgcagtgggagcctagcaagggctggaatgattggcaacaggttcccttttgctcccatcacttccaccagctcatcatgaaggacgggcgcgagattgtggtcccatgtagaaaccaggatgaattggtgggacgggcaagggtatcacaaggcgctggttggagtctgcgagagactgcctgccttgggaaatcttatgcacagatgtggcagctgatgtactttcatcgtagagacctccgcttagccgcgaatgctatatgtagcgccgttcctgtggattgggtccccacctcccggacaacttggtcaatccacgcacatcaccaatggatgaccacggaagacatgctgagcgtgtggaacagggtttggattgaggaaaatccatggatggaggataagacacatgtgtcttcctggggagacgtcccctatttgggcaaaagagaggaccagtggtgcggcagtctgatcgggctcaccgcccgcgctacttgggccagcaacattcaggtggcaatcaatcaggtacggaggcttataggaaacgaaaattacctggattacatgacatcgatgaagcgattcaaaaacgagggtgaccctgaaggcgctctatggtga

SEQ ID NO: 13856 - RNA, 9879 nt, synthetic construct
  misc_feature 1..9879: note = derived and/or modified CDS sequence (opt3) from DENV-1__FJ898416__SS-prME
  source 1..9879: mol_type = other RNA
agcgtgaccatgctgctcatgcttatgcccacagcactggctttccacttgactacgagaggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgctagcttgttccccctgtgtttaagtaccacgtctcagaagacaacctggctcccggtactgcttggctccctggggtgcaaacctttgactatgtttctcattacagagaccaagatctggggaagaaaaagctggccactgaatgaaggtataatggccgtgggcgttgtgtcgatcctactgtcatctcttctcaagaacgatgtccccctggccgggcctttgattgctggaggcatgttaatcgcatgttatgtgattagtggttccagcgccgacctgtctctcgagaaagcggctgaggtaagctgggaagaggaagccgagcactccggggcatcacataacatcctggtggtcgttcaggatgacggaactatgaagataaaagatgaagagagggacgatacacttaccattctgttgaaggccacgctactggctgtgagtggcgtgtaccccctcagcatcccagcaactctgttcgtctggtatttttggcaaaagaaaaagcagcgatctggcgtgctttgggacaccccttcacccccagaggttgaacgcgccgtattagatgacgggatctaccggattatgcagagaggactgctcggtaggagccaggtgggcgtcggggtgttccaagagaatgttttccacacaatgtggcacgtgacccgtggagcggtcttgatgtatcagggcaaacgcctggaaccgagttgggctagcgtgaagaaagacctcatatcctacggtgggggatggcggctgcagggctcttggaacacaggcgaggaggtacaggtcatcgccgtggaacctgggaagaatcccaagaacgttcaaactgcaccaggaacctttaaaacgcccgagggtgaagtgggcgccattgctcttgatttcaagcctgggacatcgggaagcccaatcgtcaatagagagggcaaaattgtgggtctgtacgggaacggagttgtgactacctcaggcacatatgtctccgccatcgcacaggctaagaccagtcaggaaggccccttgcctgagatagaggacgaagtgtttaggaaacgaaatctaactatcatggatctgcatccggggtctggaaagacccggcgctacctcccagccattgtaagagaggcgatcaagaggaaattacggacactgattcttgcccccacgcgagtggttgcaagcgaaatggctgaggccctgaagggtatgcctatcagatatcaaactaccgctgtcaaatccgaacacacaggcaaggagatagtggacctcatgtgccatgcaaccttcactatgcgcttgctgtcaccagtgagggtccccaactacaatatgattatcatggatgaggcccactttacagacccttctagcatcgccgctcgtgggtatattagtacccgggtaggaatgggcgaagcggcagccatcttcatgacggctactccgcccggttccgtggaggcctttccacagagcaacgcagttatacaggatgaagagagagacattcctgaaaggtcttggaactcagggtacgagtggatcacagatttccccggaaaaaccgtgtggtttgtcccatccattaagagtggcaacgacatcgccaattgtctccgcaagaacggcaaacgagtgatacagctgagcagaaagaccttcgatactgagtatcagaaaaccaagaataacgactgggactacgttgtgaccacagatatttcggaaatgggggctaactttcgggcggacagggtcatcgatcctcgccgttgccttaaacccgtgatcctaaaggacggaccagagagagtaattctggccggtccgatgcctgtgactgttgcatctgctgcccagcggaggggccgcatcgggcgaaatcataacaaggaaggagatcagtacatttatatgggccagcccttgaataacgacgaggatcacgcacactggacggaggccaaaatgttactggacaatataaacaccccagaaggtatcattcccgctctcttcgagcctgaaagagagaagtccgccgcgatcgatggggaataccggctgaggggcgaggcacgcaaaacattcgtcgagcttatgagaaggggagacctgccagtgtggctcagctataaggtggcctcagaaggctttcaatacagtgatcggcgttggtgcttcgacggggagcgcaataaccaggtcttggaagagaatatggatgttgaaatctggactaaagagggagagcgaaagaaactgagacccaggtggctagacgctcggacctattctgaccctctggccctccgcgaatttaaggagttcgctgcaggtagaaggtccgtgagcggcgatcttattctggaaatagggaagttaccgcagcatttgacacagcgggcccaaaacgctctggacaatctcgtaatgctgcacaactcagagcagggaggccgagcctacagacatgcaatggaggaacttccagataccatcgagactctgatgctcttggcgctgattgccgtgttaacgggtggggtcaccctatttttcctgagtggccgcggactcggcaaaacaagcatcgggcttctgtgtgtgatggcttcctctgttttgctgtggatggccagcgtggaaccccactggattgcagcttccatcatactcgagtttttcctgatggtccttctcatccctgaacccgacaggcagcggactccacaggataatcaactggcctatgtagtgattggattgctgtttatgatcttaaccgttgcagccaacgagatgggtctactggagacaaccaagaaagacctcggcattgggcacgtggctgtcgaaaatcatcaccatgcgactatgcttgatgtggacctgcaccctgcctcagcatggacattgtacgctgtcgccacgaccatcataactcccatgatgcgtcatacaattgagaacaccaccgccaacatctctctgacagcaattgctaatcaggccgcgatcctcatgggactggataagggctggccaataagtaaaatggacatcggtgtgcctcttttagctctggggtgctactcgcaggttaacccgctcactttgacggccgcagtgctgatgctagtagcccactatgctattatcggccccggactgcaagcaaaggccaccagagaagcgcagaagaggacagctgccggcattatgaaaaatccaactgtggatgggatcgtcgcaatagacctcgatcctgttgtgtacgacgccaagttcgagaaacagcttggacagattatgctgttgatcctgtgtaccagccaaatcctcctgatgcgcacaacctgggctttatgcgaatccattactcttgccacgggccccctgacaaccctctgggagggttctccagggaagttttggaacactaccatcgcagtctcaatggctaatatattccggggaagctatctagccggcgcgggtctggccttttccttgatgaaaagtctgggcgggggacgaagaggcacaggggcacagggagagactctcggcgaaaagtggaagaggcagcttaaccagctgtctaaaagcgagttcaatatttacaagcgctcaggtatcatggaagtggaccggtccgaggctaaagaagggttgaagagaggagagaccacacgtcacgccgtaagtaggggcacggcaaaactgcggtggttcgtggagcgcaacctcgttaagcctgaaggtaaggtgattgatttaggctgtgggcgaggaggctggagctattactgcgctgggctgaaaaaggtcaccgaggtgaaaggatatactaagggcggtcccgggcatgaggagccgatcccaatggccacatacggatggaatcttgtcaaactgcactctggcaaggacgtgtttttcacccctcccgaaaaatgtgatactctactctgcgacataggcgagtcctcaccaaaccccacaatcgaggaagggagaaccctgagggttttgaagatggtagagccttggctgcggggaaatcaattttgtattaagatcctcaacccgtacatgcccagcgtggtcgaaacgcttgagcagatgcagcgcaaacatggtggcatgctggtgagaaatccattatcgaggaactctacccacgagatgtattgggttagttgcgggacaggaaatattgtgtccgccgtcaacatgactagccgaatgctgttgaatcggttcaccatggcgcaccgtaagcctacatacgaaagagatgtggacctcggcgctggtactcgccatgtagcagtggagcccgaagttgccaacctggatatcattgggcagaggatcgagaacataaaacacgaacataagtcaacctggcactatgacgaggataatccttacaaaacatgggcttatcatggatcctacgaggtcaagccatctggcagcgccagttccatggtgaacggcgtggtcaagctacttaccaaaccctgggacgttattcctatggtgactcaaatcgcaatgacggatacaaccccatttgggcagcagcgggtattcaaggaaaaagtggacactagaacccccaaggccaaacgcggaacagctcaaatcatggaggtcacggcgaggtggctgtggggttttctcagccgaaataagaagccgcggatttgtaccagagaagagttcactaggaaagtgcgctctaacgccgcaataggcgctgtttttgtggacgaaaatcagtggaactcagccaaggaggcagtcgaggatgaacgtttctgggacctggtgcagaaagagcgggaattgcacaagcaggggaaatgcgccacatgcgtatataatatgatgggaaagagagagaagaaactgggcgaatttggtaaggctaaagggagtagggccatctggtacatgtggctcggagcgcgcttccttgagtttgaggcactgggcttcatgaacgaagatcactggttctcccgagagaatagcttatctggcgttgaaggggagggactgcataagttgggttacattctccgggacatctcgaaaattcctggcgggaacatgtatgccgatgacaccgctggatgggatactagaatcacagaggacgatctgcaaaatgaagccaagataaccgacatcatggagccagaacacgcactacttgctacatcaatttttaaactgacttaccagaacaaggtggtcagggtgcagcgccccgccaagaatggcaccgtgatggatgtcatcagcagacgggaccagaggggttccgggcaagttggaacgtatggcctcaacaccttcacaaatatggaggctcagctgattcgtcagatggaaagtgagggcatctttttgccttctgagttagaaactccaaacctggccgagcgagtgctcgattggcttgaaaaatacggggtagagcgcctgaagagaatggcaataagcggagacgactgtgtggtcaaacccattgatgaccggttcgcgaccgccctaacagctctgaacgatatgggtaaggtgaggaaagacatcccgcagtgggaaccttccaagggctggaatgattggcaacaggttcccttttgctcacatcacttccaccagctcatcatgaaggacgggcgcgagattgtggtcccatgtagaaaccaggatgagttggtgggacgggccagggtaagtcaaggcgcaggttggtctctgcgagaaactgcttgccttgggaaaagctatgcccagatgtggcagctgatgtactttcatcgtagagacctccgcttagcagccaatgcgatatgttccgctgttcctgtggattgggtccccacctcacggacgacatggagcatccacgcccatcaccaatggatgaccactgaggacatgctgtctgtgtggaacagggtttggattgaagagaatccatggatggaagataagacacatgtgtccagttggggagacgtcccctatttgggcaaaagagaggaccagtggtgcggcagcctgatcgggctcaccgcacgcgccacttgggcttcgaacattcaggtggccatcaatcaggtacggaggcttataggaaacgagaattacctggattacatgacctccatgaagcgattcaaaaacgaaggtgaccctgagggcgtgctatggtga

SEQ ID NO: 13857 - RNA, 9879 nt, synthetic construct
  misc_feature 1..9879: note = derived and/or modified CDS sequence (opt3) from DENV-1__FJ898417__SS-prME
  source 1..9879: mol_type = other RNA
tccgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctgctctgctcaagaacgatgtgcccctggcagggcctcttattgccggaggcatgctcatcgcgtgttacgtcataagtggttccagcgctgacctgtctttggagaaggccgcagaggtgagctgggaagaggaagccgagcattccggggcttcacacaatattttagtagaagtgcaggatgacggaactatgaaaatcaaggatgaggagagggacgatacactgaccatcctcctgaaggcaactcttctggccgtcagtggcgtttatcccttgagcattccagcgacactattcgtgtggtacttttggcagaaaaagaaacaacgatctggcgtgctgtgggacaccccttcacccccagaagtcgagcgcgctgtgctcgatgacgggatatatcggatcatgcagagaggactgcttggtaggagccaggttggcgtaggggtgttccaggaaaacgtctttcatacgatgtggcacgtgactcgtggagccgttttaatgtaccaaggcaagcgcctggagccgagttgggcaagcgtgaaaaaggacctcatttcctacggtgggggatggcggttgcagggctcttggaataccggcgaggaagtccaggtgatcgccgtagagcctgggaagaaccccaaaaatgtccagacagctccaggaaccttcaagacatcggaaggtgaggtgggcgccattgcactggattttaaacccgggactagcggatcacctatcgttaacagagaaggcaagatagtgggtctctatgggaatggagtcgtgaccacgtccggcacatacgttagtgctatcgcccaagcgaaagcctctcaggagggcccactgcccgagattgaagacgaggtgttcaggaagcgaaaccttactatcatggatctgcaccctgggagcggaaagacccggcgctatttgccggcaattgtcagagaagctatcaaaaggaagctacggacactgatactcgccccaacccgagtggtagcttccgagatggcagaagccttaaaaggtatgcccattagataccagactaccgccgtgaagtcagagcatacaggcaaagagatcgttgacctgatgtgccacgctacgtttactatgcgccttctgtctcctgtcagggtgccaaattataacatgatcattatggatgaagcgcatttcaccgaccccagcagtatcgcagcccgtgggtacatatccacacgggtgggaatgggcgaggctgccgcaatttttatgaccgccactcctccgggtagcgtcgaggctttcccccaatctaatgcggtaatccaggatgaggaaagagacattccagagaggtcatggaactccgggtatgagtggatcacagattttcctggaaagaccgtgtggttcgttcccagtataaagagcggcaatgacattgccaactgtctccgcaaaaatggcaagcgagtgatccagttgtcgagaaaaacgttcgatactgaataccagaagaccaaaaacaacgactgggactacgtcgtgaccaccgatatctctgagatgggggcaaattttcgggctgacagggttattgatccacgccgttgcctgaagcctgtgatcctcaaggacggacccgaaagagtcattctggccggtccaatgccggtgactgtagcatccgccgctcaacggaggggccgcatagggcgaaaccacaataaagagggagatcagtatatctacatgggccagcctcttaacaatgacgaggatcatgcccactggacagaagcgaagatgctactggacaacattaatacccccgagggtatcatcccagcattgttcgaacccgagagagagaaaagcgccgctattgatggggagtatcggttaaggggcgaggcccgcaagacatttgtggaactgatgagaaggggagacctccctgtttggctgtcatacaaagtcgctagtgagggcttccagtattctgatcggcgttggtgctttgacggggaacgcaacaatcaagtgcttgaggaaaacatggatgtggagatatggactaaggagggagaaaggaaaaagctgagaccaagatggctcgacgcacggacgtactccgaccccttggccctgcgcgagttcaaggaatttgctgccggtagaaggagcgtctcaggcgatctaatcctggagattgggaaactccctcagcaccttacccagcgggcacagaatgcgctggacaacttagttatgttgcataatagtgaacaaggaggccgagcctatagacacgctatggaggagctgccggatacaatcgaaactctcatgctgcttgccctgattgcagtgctcaccggtggggtaacattgttctttctgagcggccgcggattaggcaagacctccatcgggctactgtgtgtgatggcttctagcgtcctcctttggatggcctccgtggagccacattggatagcagcctcaatcattctggagttctttttgatggttctgctcatccccgagcctgacaggcagcggactccccaggataaccagctggcttacgtggtcattggacttctcttcatgatcctgacggtagcggccaatgagatgggtttgctggaaaccaccaaaaaggacttaggcatagggcacgtggcagttgagaaccaccatcacgctgccatgctagatgtggacctgcatccagcctctgcatggactctctacgctgtcgccaccacaattatcacccctatgatgcgtcacactattgaaaacacaacggcgaatatcagtcttaccgctatagccaaccaagcagccatcctgatgggattggataaaggctggcccatttcgaagatggacatcggtgtgccactgctcgctctggggtgctatagccaggtcaatcctcttactttaacagcagccgtgctgatgctcgttgcgcattacgctattatcggcccgggattgcaggccaaggcaaccagagaggcccagaaaaggaccgctgccggcataatgaagaaccccacagtggatgggattgtagcaatcgacctggatccagtggtctatgacgctaaatttgaaaagcagctaggacagatcatgctgctcattctttgtacttcccagatcctgttgatgcgcacgacctgggccctgtgcgagtctataacactcgcgactggccctctgaccacattatgggagggttcacccgggaaattctggaataccactattgccgttagcatggcaaacatcttccggggatcctaccttgctggcgccggtctggcatttagtctcatgaagtctctaggcgggggacgaagaggcacgggggctcaaggagaaacactgggcgagaagtggaaaaggcagttgaatcagctgagcaagtcagagttcaacacctataaacgctccggtattatggaggtggaccggagtgaagccaaggaggggctcaaaagaggagagactaccaagcacgccgtcagccgtggcacagcgaaacttaggtggtttgtggaacggaatctggtaaaaccagagggtaaggtgatcgatttgggctgtgggcgcggaggctggtcttactattgcgctgggctgaaaaaggttactgaagtgaaaggatacaccaagggcggtcctgggcacgaggaacccataccgatggcaacatacggatggaacctcgtcaaattacattccggcaaggacgtgttctttatcccacctgagaagtgtgatacgctgctttgcgacattggcgagtcaagccccaatccaaccatcgaagaggggcgaactctgagagtcctaaaaatggtggaaccctggctcaggggaaaccagttctgtattaagatcctgaatccttatatgccgtcggttgtagagacattggagcaaatgcagcggaaacacggtggcatgctggtgcgcaaccccctctctagaaatagtacccatgaaatgtactgggtctcctgcgggactggaaacattgtgagcgccgttaatatgacatcaaggatgcttctgaaccgatttaccatggctcaccggaagccaacgtatgagcgtgatgtggacttaggcgccggtaccagacacgtcgcagtggaacctgaggtagccaacctggatatcatagggcagcgcattgaaaatatcaaacatgagcacaagtccacatggcattacgacgaggataacccctataagacttgggcttaccacggatcttatgaagtgaaacctagcggcagtgcgtccagcatggttaatggcgtcgtgaagttgctcaccaaaccatgggacgtgatccccatggtcacacagattgccatgactgataccacacctttcgggcaacagagggtttttaaggagaaagtggacacccggactccaaaggcaaagagaggaacggctcagataatggaagtaacagccaaatggctgtggggtttcctatctcgcaacaagaaacccaggatctgtacccgagaggaatttactcggaaggtgagatcaaatgcagccattggcgctgtcttcgtggacgagaaccaatggaatagtgccaaagaggcggttgaagatgagaggttttgggaccttgtgcatcgcgaacgtgagctgcacaagcaggggaagtgcgcaacctgcgtctacaacatgatgggaaaacgggaaaagaaactcggcgagttcggtaaggccaaagggtccagagctatctggtacatgtggctgggagccaggttcttggagtttgaagcactgggcttcatgaatgaggatcactggtttagccgcgaaaactctctctcgggcgtggagggggagggacttcataagctgggttatattttacgagacatctcaaaaataccgggcgggaatatgtacgctgatgacacagccggatgggatacgcggatcaccgaagacgatctgcagaacgaggctaagattactgacatcatggaacctgagcacgccttgctcgcaaagagcattttcaaactgacatatcagaataaggtagttagagtgcaaaggccagcgaaaaacggcaccgtcatggatgtgatctcccgcagagaccagcggggtagtggacaggtgggaacttacggcctaaatacatttaccaacatggaagcccagcttataaggcaaatggagtctgagggcattttcagcccctccgaactggagacacctaacctcgctgggcgtgtcctggattggttggaaaagcatggagttgagcgattaaaacgcatggccatctcaggtgacgactgtgtggtaaagccaatcgatgacagatttgcaactgctctgaccgccctcaatgatatgggcaaggtgcggaaagacattccccagtgggaaccgagtaaggggtggaacgattggcagcaggtccctttctgctctcaccactttcatcaacttataatgaaagacggaagggagatcgtggttccctgtcgcaatcaggatgagctggtgggcagagcacgggtcagccagggtgccgggtggtccctaagggaaacggcgtgcctgggaaagtcatatgctcagatgtggcaactcatgtacttccaccgacgtgacttgagactggccgcaaacgccatttgtagcgctgatccagtggactgggtacctacctctcgcacaacttggtccatccatgcccaccatcagtggatgaccacagaggatatgcttagtgtttggaatcgggtgtggattgaagagaacccctggatggaagacaaaactcacatcagctcgtggggcgacgtcccatatctgggcaagagggaggatcagtggtgcgggtccctcataggattaaccgcaagagctacgtgggccacaaatatccaagtggcgattaaccaggttcgccggctgatcggtaatgagaactacttggactacatgacctctatgaagaggtttaaaaatgaatcagatcccgagggcgctctgtggtga

SEQ ID NO: 13858 - RNA, 9879 nt, synthetic construct
  misc_feature 1..9879: note = derived and/or modified CDS sequence (opt3) from DENV-1__GQ868612__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacactgattgccatggacctcggcgaactgtgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggatcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggccatggtgcaggcagattctggatgcgtgatcaactggaaaggccgcgaacttaagtgtggttcagggatcttcgtcactaatgaggttcacacctggacggaacaatataagtttcaggccgacagtccgaaaagattgagcgctgccattggaaaggcatgggaggagggcgtgtgcggtataaggtccgctacacggctggaaaacatcatgtggaaacagatttctaacgagctcaatcatatcctgttagaaaacgacatgaagctgaccgtggtagtcggcgatgtggccgggattcttggacagggcaaaaagatgatccgccctcaacccatggagtacaaatattcgtggaaaagctgggggaaggcgaagataatcggagccgacgctcagaatactaccttcattatcgatggcccaaacacacctgaatgtcccgacgatcagagagcatggaatatttgggaggttgaggactacggttttgggatcttcactaccaacatatggttgaagctcagggattcctatacacaggtgtgcgaccaccgtctgatgtcagccgctattaaagatagtaaggccgtccacgcagacatgggatactggatcgaatctgagaaaaatgaaacgtggaagctagcgcgggccagcctgattgaggtgaagacctgtatctggccaaaatcccatactctctggtcaaacggcgttctggaaagcgagatgataatccccaagatttatggtggccctatctctcaacacaattaccgaccagggtactttacacagaccgctggaccgtggcatcttggcaaattggagctggatttcgacttatgcgaagggactacagtggtagtcgatgagcactgcggaaacagaggcccctccctcaggaccacgactgtgaccggtaagattatccacgaatggtgttgccgcagttgtacactgcctccacttcggttcagaggggaggacggatgctggtatggcatggagataaggcccgtgaaagaaaaggaggaaaatctggtcaagagcatggtttctgccggttccggcgaggtggactcatttagtttggggctcctgtgtattagcatcatgatcgaagaggtaatgcgctcgcgatggtcccggaaaatgctaatgaccggaactctggcagtgttctttctcctgattatgggccagcttacatggaacgatttgatccgtctgtgcattatggtcggggctaatgcctctgacagaatgggaatgggcaccacatacttagcactcatggccactttcaagatgaggcctatgtttgctgtgggtctgcttttccgccggctgaccagcagagaggttctactcctgacgatagggttgtcactggtggcgagtgtcgaattaccaaactccctcgaggaactgggagatggccttgccatgggcatcatgattctgaaattgctcacagactttcaatctcatcagctgtgggcaaccctactgagccttactttcatcaagaccacattttccctccactatgcttggaaaactatggccatggtgctgtcaattgttagcttgttccccctgtgtttaagtaccacgtctcagaagacaacctggctcccggtgctgcttgggtccctgggatgcaagcctttgactatgtttctcatcgccgagaataaaatatggggtaggaagtcctggccactgaacgaaggcatcatggctgtcgggattgtatcgatcctactgtcatctcttctcaaaaacgatgtgcccctggcaggacctttgattgccggcggtatgttaatcgcgtgttacgttataagtgggtccagcgctgacctgtctctcgagaaggccgcagaggtgagctgggaagaggaagccgagcattccggagcttcacacaatattctggtcgaagtgcaggatgacggcacaatgaaaatcaaggatgaggagcgagacgatacccttactatcctgttgaaagcaacactactggccgtaagtggcgtgtatcccctcagcattccagcgaccctgttcgtctggtacttttggcaaaagaagaaacagcgctctggggttctttgggacacgccttcacccccagaagtggagcgggctgtgttagatgacggaatatatagaatcatgcagaggggtctgctcggccgtagccaggtcggggtgggagttttccaagaaaacgtattccatactatgtggcacgtgacccgcggcgccgtcttgatgtaccagggtaagcggctggagccgagttgggcaagcgtgaaaaaggacctcatttcctacgggggaggctggagactgaggggctcttggaatacaggggaggaagttcaggtgatcgccgtcgagcctggcaaaaatcccaagaatgtgcagaccgctccaggtacatttaagactcccgaaggcgaggtaggggccattgcacttgatttcaaacctggaacctcgggcagcccaatcgtcaaccgagaaggtaagatagtggggctgtatggaaatggcgttgtgacgacatcaggcacttacgtctccgctatcgcccaagcgaaagccagtcaggaggggcccttgcctgagattgaagacgaggtgtttcggaagcgcaacctaaccatcatggatctgcacccgggatctggtaaaacaagaaggtatctcccagcaattgttcgggaagctatcaagcgaaagttaagaaccctgatacttgcccccactcgcgtggtcgctagcgagatggcagaagccctgaaaggcatgcctattaggtaccagaccacagccgtgaagtccgagcatacggggaaagagatcgtagacctcatgtgccacgctactttcaccatgcgtttgctgtcaccagtgcgggttcccaattataacatgatcattatggatgaagcgcattttacagacccttctagcatcgcagccagaggatacataagtaccagggtcggcatgggtgaggctgccgcaattttcatgactgccacaccgcccgggtccgtggaggcttttccacaaagcaatgcggtgatccaggatgaggaacgcgacattcctgagcgatcttggaactcaggatatgagtggatcaccgatttccccggcaagacggtctggtttgtaccatccataaaaagtggcaatgacattgccaactgtctcagaaagaatgggaagcgggtgatccagctgagcaggaaaactttcgatacagaataccagaagaccaaaaacaacgactgggactacgttgtgaccactgatatctcggagatgggagcaaattttcgcgctgaccgtgtcattgatcctagacggtgccttaagcccgtgatcctaaaagacggtccagaaagggttattctggccggcccgatgcctgtgacagtcgcatctgccgctcaacgccgagggagaataggacggaaccacaataaggagggcgatcagtatatctacatgggtcagcccttgaacaatgacgaggatcatgcccactggaccgaagcgaagatgttactggacaacattaatacaccagaggggatcatccccgcactcttcgaacctgagagggaaaaatccgccgctgtggatggcgagtatcgcctgagaggagaggccaggaagactttcgtagaacttatgcggcgtggcgacctgccagtgtggctcagctacaaagttgcttcagaggggtttcagtatagtgatcgccgatggtgcttcgacggagaaagaaacaatcaagtcttggaggaaaacatggatgtggagatttggacgaaggagggtgaaaggaaaaagctgcggccccgctggctagacgcaagaacctactctgaccctctggccctcagggagtttaaagagttcgctgccggccggcgatccgtgagcggggatcttatactggagatcggaaagttaccgcagcacttgacacagagagcacagaatgcgctggacaacctcgtcatgctgcataattcagaacaaggcggtcgcgcctataggcacgctatggaggagcttccagatactattgaaaccctgatgctcttggccctgatcgcagttttaacagggggcgtgaccctatttttcctgagtggacggggcctcgggaagactagcattggacttctgtgtgtaatggcttcctctgtgttgctgtggatggccagcgtcgagccccattggatcgcagcctccataatcctcgaatttttcctgatggtgcttctcattcctgagcccgaccgtcagagaacgccacaggataaccagctggcttacgttgtgatcggtttgctgtttatgattttaaccgtcgcggccaatgagatgggcctactggaaacaactaaaaaggacctcgggatcggacacgtagcagtggagaaccaccatcacgctgccatgcttgatgttgacctgcatcctgcctcagcatggaccttgtacgctgtggccacaaccataattactcccatgatgaggcacacaatcgaaaacacgaccgcgaatatttctctgactgctatcgccaaccaagcagccatactcatgggcctggataaaggttggccaatcagtaagatggacattggggtccctcttttagctctgggctgctatagccaggtgaatccgctcacattgaccgcagccgtcctgatgctagtggcgcattacgctatcattggacccggcctgcaggccaaagcaacccgcgaggcccaaaagcggacagctgccgggatcatgaagaacccaactgttgatggaatagtggcaattgacctcgatcctgtagtgtatgacgctaaattcgaaaagcagcttggccagatcatgctgttgatcctgtgtacgagccagattctcctgatgcgaaccacatgggccttatgcgagtccatcactcttgcgaccggtcccctgacaaccctctgggaggggtctccaggaaaattttggaatactacgatagccgtctcaatggcaaacattttcagaggcagctacctagctggtgccggcctggcattttccttgatgaagagtctagggggaggcaggcgcgggacaggagctcaaggcgaaaccctcggtgagaaatggaagcggcagcttaatcagctgtctaagagcgagttcaacacttataaaagatcagggatcatggaggttgaccgttccgaagccaaggagggattgaaaaggggcgagaccacaaagcacgccgtgagtcggggtactgcgaaactgcgctggttcgtcgaacgaaatctcgtgaagcctgagggcaaggtaattgatttagggtgtggaagaggcgggtggagctactattgcgctggactgaaaaaggtgaccgaagttaaaggctacacaaagggtgggcccggacacgaggaaccgatcccaatggcaacgtacggctggaaccttgtgaaactgcattctggcaaggacgtctttttcatacctcccgagaaatgtgataccctactctgcgacatcggggagtcctcaccaaatcccactattgaagagggaaggacactgcgggtgttgaagatggtcgaaccttggctgcgcggtaaccagttttgtatcaagattctcaatccgtatatgcccagcgtggttgagacccttgagcaaatgcagagaaaacacggcgggatgctggtaaggaacccattatcgcgaaattctactcatgaaatgtactgggtgagttgcggaacaggcaacatcgtctccgccgtgaatatgaccagccggatgctgttgaaccgtttcacgatggctcacagaaagcctacctatgagcgcgatgttgacctcggtacagggactaggcacgtggccgtcgaacccgaggtggcaaacctggatattatcggacagcggatagaaaatattaaacatgagcacaagtcaacctggcattacgacgaggataacccttataaaacatgggcctaccacggctcctatgaagtaaagccatctggcagcgctagttccatggtgaatggggttgtcaagctacttactaaaccctgggacgtgatccctatggtgacccagatcgcgatgacagataccactccatttggacaacagagagtcttcaaggagaaagttgacacgcgcacacccaaggccaaaaggggtaccgcacagattatggaagtgactgctcgatggctgtggggctttctcagccggaacaagaagccgagaatatgtaccagggaggagttcacacgcaaagtacgttctaatgccgcaatcggggccgtgtttgtcgacgagaaccaatggaactcagctaaggaggccgtggaagatgagcggttctgggacctggttcatagagaaagggagttgcacaaacagggaaagtgcgcgacgtgcgtgtacaacatgatgggcaaacgcgaaaagaagctgggtgagtttgggaaagcaaagggaagtcgagccatttggtacatgtggctcggcgctcggttccttgagtttgaagccctgggcttcatgaatgaggatcactggttctccagagaaaacagcttatctggggtcgagggagagggtctgcataaattgggctatatcctcagggacatttcgaagatccctgggggaaatatgtacgcagatgacaccgctggctgggatactcgcataacagaagacgatctgcagaacgaggccaaaatcaccgacattatggaaccagagcacgctctacttgccaaggcaatctttaaactgacttatcagaataaggtggtaagagttcaacggcccgcgaagaacggtacagtgatggatgtcatttcaaggcgtgaccagcgagggagcggacaggtgggcacctacggcctcaatacattcactaacatggaagcccagctgatccgccaaatggagtccgaggggatatttagtccttctgaattggagaccccaaacttagctgaaagagccctggattggctcgagaaatatggagtggaacggcttaagaggatggcaattagcggtgacgactgtgtcgttaaacccatcgatgaccgcttcgctacggccctgaccgcactaaatgatatgggcaaggtgagaaaagacatcccgcagtgggagccttccaaggggtggaacgattggcagcaggtacccttttgctcacatcacttccaccaactgattatgaaggacggacgggagatagtggtcccatgtaggaatcaggatgaactcgtgggccgagcccgtgttagtcagggtgcggggtggtctttgagagagacagcttgcctgggaaaaagctacgcccagatgtggcaacttatgtattttcatcgccgggacctgaggctcgcagccaacgctatctgttccgccgtgcctgtcgattgggtgcccacttcaagaaccacatggagcattcacgcacatcaccagtggatgactaccgaagacatgttatctgtatggaatcgcgtttggatcgaggaaaacccatggatggaggataagacgcatatttccagttgggaggacgtgccctacctgggcaaacgggaagaccagtggtgcggcagcttgatcgggctgacagctagggccacctgggcgactaatatacaagtcgctatcaaccaggtgcgaagactcattggaaatgagaactaccttgattatatgacatcgatgaagcggttcaaaaatgaatccgaccctgagggtgccctgtggtga

SEQ ID NO: 13859 - RNA, 9879 nt, synthetic construct
  misc_feature 1..9879: note = derived and/or modified CDS sequence (opt3) from DENV-1__FJ898419__SS-prME
  source 1..9879: mol_type = other RNA
tccgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctgctctgctcaagaacgatgtgcccctggcagggcctcttattgccggaggcatgctcatcgcgtgttacgtcataagtggttccagcgctgacctgtctttggagaaggccgcagaggtgagctgggaagaggaagccgagcattccggggcttcacacaatattttagtagaagtgcaggatgacggaactatgaaaatcaaggatgaggagagggacgatacactgaccatcctcctgaaggcaactcttctggccgtcagtggcgtttatcccttgagcattccagcgacactattcgtgtggtacttttggcagaaaaagaaacaacgatctggcgtgctgtgggacaccccttcacccccagaagtcgagcgcgctgtgctcgatgacgggatatatcggatcatgcagagaggactgcttggtaggagccaggttggcgtaggggtgttccaggaaaacgtctttcatacgatgtggcacgtgactcgtggagccgttttaatgtaccaaggcaagcgcctggagccgagttgggcaagcgtgaaaaaggacctcatttcctacggtgggggatggcggttgcagggctcttggaataccggcgaggaagtccaggtgatcgccgtagagcctgggaagaaccccaaaaatgtccagacagctccaggaaccttcaagacatcggaaggtgaggtgggcgccattgcactggattttaaacccgggactagcggatcacctatcgttaacagagaaggcaagatagtgggtctctatgggaatggagtcgtgaccacgtccggcacatacgttagtgctatcgcccaagcgaaagcctctcaggagggcccactgcccgagattgaagacgaggtgttcaggaagcgaaaccttactatcatggatctgcaccctgggagcggaaagacccggcgctatttgccggcaattgtcagagaagctatcaaaaggaagctacggacactgatactcgccccaacccgagtggtagcttccgagatggcagaagccttaaaaggtatgcccattagataccagactaccgccgtgaagtcagagcatacaggcaaagagatcgttgacctgatgtgccacgctacgtttactatgcgccttctgtctcctgtcagggtgccaaattataacatgatcattatggatgaagcgcatttcaccgaccccagcagtatcgcagcccgtgggtacatatccacacgggtgggaatgggcgaggctgccgcaatttttatgaccgccactcctccgggtagcgtcgaggctttcccccaatctaatgcggtaatccaggatgaggaaagagacattccagagaggtcatggaactccgggtatgagtggatcacagattttcctggaaagaccgtgtggttcgttcccagtataaagagcggcaatgacattgccaactgtctccgcaaaaatggcaagcgagtgatccagttgtcgagaaaaacgttcgatactgaataccagaagaccaaaaacaacgactgggactacgtcgtgaccaccgatatctctgagatgggggcaaattttcgggctgacagggttattgatccacgccgttgcctgaagcctgtgatcctcaaggacggacccgaaagagtcattctggccggtccaatgccggtgactgtagcatccgccgctcaacggaggggccgcatagggcgaaaccacaataaagagggagatcagtatatctacatgggccagcctcttaacaatgacgaggatcatgcccactggacagaagcgaagatgctactggacaacattaatacccccgagggtatcatcccagcattgttcgaacccgagagagagaaaagcgccgctattgatggggagtatcggttaaggggcgaggcccgcaagacatttgtggaactgatgagaaggggagacctccctgtttggctgtcatacaaagtcgctagtgagggcttccagtattctgatcggcgttggtgctttgacggggaacgcaacaatcaagtgcttgaggaaaacatggatgtggagatatggactaaggagggagaaaggaaaaagctgagaccaagatggctcgacgcacggacgtactccgaccccttggccctgcgcgagttcaaggaatttgctgccggtagaaggagcgtctcaggcgatctaatcctggagattgggaaactccctcagcaccttacccagcgggcacagaatgcgctggacaacttagttatgttgcataatagtgaacaaggaggccgagcctatagacacgctatggaggagctgccggatacaatcgaaactctcatgctgcttgccctgattgcagtgctcaccggtgggtggacattgttctttctgagcggccgcggattaggcaagacctccatcgggctactgtgtgtaatggcttctagcgtgctcctttggatggcctccgtcgagccacattggatagcagcctcaatcattctggagttctttttgatggtgctgctcatccccgagcctgacaggcagcggactccccaggataaccagctggcttacgttgtgattggacttctcttcatgatcctgacggtcgcggccaatgagatgggtttgctggaaaccaccaaaaaggacttaggcatagggcacgtagcagtggagaaccaccatcacgctgccatgctagatgttgacctgcatccagcctctgcatggactctctacgctgtggccaccacaattatcacccctatgatgcgtcacactattgaaaacacaacggcgaatatcagtcttaccgctatagccaaccaagcagccatcctgatgggattggataaaggctggcccatttcgaagatggacatcggtgtcccactgctcgctctggggtgctatagccaggtgaatcctcttactttaacagcagccgtcctgatgctcgtggcgcattacgctattatcggcccgggattgcaggccaaggcaaccagagaggcccagaaaaggaccgctgccggcataatgaagaaccccacagttgatgggattgtggcaatcgacctggatccagtagtgtatgacgctaaatttgaaaagcagctaggacagatcatgctgctcattctttgtacttcccagatcctgttgatgcgcacgacctgggccctgtgcgagtctataacactcgcgactggccctctgaccacattatgggagggttcacccgggaaattctggaataccactattgccgtcagcatggcaaacatcttccggggatcctaccttgctggcgccggtctggcatttagtctcatgaagtctctaggcgggggacgaagaggcacgggggctcaaggagaaacactgggcgagaagtggaaaaggcagttgaatcagctgagcaagtcagagttcaacacctataaacgctccggtattatggaggttgaccggagtgaagccaaggaggggctcaaaagaggagagactaccaagcacgccgtgagccgtggcacagcgaaacttaggtggtttgtcgaacggaatctggtgaaaccagagggtaaggtaatcgatttgggctgtgggcgcggaggctggtcttactattgcgctgggctgaaaaaggtgactgaagttaaaggatacaccaagggcggtcctgggcacgaggaacccataccgatggcaacatacggatggaacctcgtgaaattacattccggcaaggacgtcttctttatcccacctgagaagtgtgatacgctgctttgcgacattggcgagtcaagccccaatccaaccatcgaagaggggcgaactctgagagtgctaaaaatggtcgaaccctggctcaggggaaaccagttctgtattaagatcctgaatccttatatgccgtcggtggttgagacattggagcaaatgcagcggaaacacggtggcatgctggtacgcaaccccctctctagaaatagtacccatgaaatgtactgggtgtcctgcgggactggaaacattgtcagcgccgtgaatatgacatcaaggatgcttctgaaccgatttaccatggctcaccggaagccaacgtatgagcgtgatgttgacttaggcgccggtaccagacacgtggcagtcgaacctgaggtggccaacctggatatcatagggcagcgcattgaaaatatcaaacatgagcacaagtccacatggcattacgacgaggataacccctataagacttgggcttaccacggatcttatgaagtaaaacctagcggcagtgcgtccagcatggtgaatggcgttgtcaagttgctcaccaaaccatgggacgtgatccccatggtgacacagattgccatgactgataccacacctttcgggcaacagagggtctttaaggagaaagttgacacccggactccaaaggcaaagagaggaacggctcagataatggaagtgacagccaaatggctgtggggtttcctatctcgcaacaagaaacccaggatctgtacccgagaggaatttactcggaaggtaagatcaaatgcagccattggcgctgtgttcgtcgacgagaaccaatggaatagtgccaaagaggcggtggaagatgagaggttttgggaccttgttcatcgcgaacgtgagctgcacaagcaggggaagtgcgcaacctgcgtgtacaacatgatgggaaaacgggaaaagaaactcggcgagttcggtaaggccaaagggtccagagctatctggtacatgtggctgggagccaggttcttggagtttgaagcactgggcttcatgaatgaggatcactggtttagccgcgaaaactctctctcgggcgtcgagggggagggacttcataagctgggttatattttacgagacatctcaaaaataccgggcgggaatatgtacgctgatgacacagccggatgggatacgcggatcaccgaagacgatctgcagaacgaggctaagattactgacatcatggaacctgagcacgccttgctcgcaaagagcattttcaaactgacatatcagaataaggtggtaagagttcaaaggccagcgaaaaacggcaccgtgatggatgtcatctcccgcagagaccagcggggtagtggacaggtgggaacttacggcctaaatacatttaccaacatggaagcccagcttataaggcaaatggagtctgagggcattttcagcccctccgaactggagacacctaacctcgctgggcgtgtgctggattggttggaaaagcatggagtcgagcgattaaaacgcatggccatctcaggtgacgactgtgttgtgaagccaatcgatgacagatttgcaactgctctgaccgccctcaatgatatgggcaaggtacggaaagacattccccagtgggaaccgagtaaggggtggaacgattggcaacaggtgcctttctgctctcaccactttcatcaacttataatgaaagacggaagggagatcgtcgtgccctgtcgcaatcaggatgagctggttggcagagcacgggtgagccagggtgccgggtggtccctaagggaaacggcgtgcctgggaaagtcatatgctcagatgtggcaactcatgtacttccaccgacgtgacttgagactggccgcaaacgccatttgtagcgctgtcccagtggattgggtacctacctctcgcacaacttggtccatccatgcccaccatcagtggatgaccacagaggacatgcttagtgtttggaatcgggtgtggattgaagagaacccctggatggaagataaaactcacatcagctcgtggggcgacgtcccatatctgggcaagagggaggaccagtggtgcgggtccctcataggattaaccgcaagagctacgtgggccacaaatatccaagtggcgattaaccaggttcgccggctgatcggtaatgagaactacttggattacatgacctctatgaagaggtttaaaaatgaatcagaccccgagggcgctctgtggtga

SEQ ID NO: 13860 - RNA, 9879 nt, synthetic construct
  misc_feature 1..9879: note = derived and/or modified CDS sequence (opt3) from DENV-1__FJ898420__SS-prME
  source 1..9879: mol_type = other RNA
tccgtgaccatgctgctcatgcttatgcccacagcactggctttccacttgactacgcggggcggggaacctcatatgatcgtctccaagcaggaaaggggaaaatctttactgtttaagacctcagccggtgttaatatgtgcacattgattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggccatggtgcaggcagattctggatgcgtgatcaactggaaaggccgcgaacttaagtgtggttcagggatcttcgtcactaatgaggttcacacctggacggaacaatataagtttcaggccgacagtccgaaaagattgagcgctgccattggaaaggcatgggaggagggcgtgtgcggtataaggtccgctacacggctggaaaacatcatgtggaaacagatttctaacgagctcaatcatatcctgttagaaaacgacatgaagctgaccgtggtagtcggcgatgtggccgggattcttggacagggcaaaaagatgatccgccctcaacccatggagtacaaatattcgtggaaaagctgggggaaggcgaagataatcggagccgacgctcagaatactaccttcattatcgatggcccaaacacacctgaatgtcccgacgatcagagagcatggaatatttgggaggttgaggactacggttttgggatcttcactaccaacatatggttgaagctcagggattcctatacacaggtgtgcgaccaccgtctgatgtcagccgctattaaagatagtaaggccgtccacgcagacatgggatactggatcgaatctgagaaaaatgaaacgtggaagctagcgcgggccagctttattgaggtgaagacctgtatctggccaaaatcccatactctgtggtcaaacggcgttctcgaaagcgagatgataatccccaagatttatggtggccctatctctcaacacaattaccgaccagggtacttcacacagaccgctggaccgtggcatctgggcagacttgagttggatttcgacctgtgcgaagggactacagtggtagtcgatgagcactgcggaaacaggggcccctccttacgcaccacgactgtgaccggtaaaattatccacgaatggtgttgccggagttgtacactccctccactgagatttaggggagaagacggatgctggtatggcatggagatacgccccgtgaaggaaaaagaggaaaatcttgtcaagagcatggtttctgccggttccggcgaggtggactcattcagtctggggttgctctgtattagcatcatgatcgaagaggtaatgcgatcgcggtggtcccgtaagatgctgatgaccggaactctagcagtgtttttcctgctcattatgggccagctgacatggaacgatcttatcagattgtgcattatggtcggggctaatgcctctgacaggatgggaatgggcaccacatacctggcattaatggccacttttaaaatgcgccctatgttcgctgtgggtctcctgtttcggagacttaccagcagggaggttctgctactcacgatagggctgtcattggtggcgagtgtcgaactgccaaactccttagaggaactcggagatggcctggccatgggcatcatgattcttaagctgttgacagacttccaatctcatcagctctgggcaaccctgctaagcctgacttttatcaaaaccacattctcccttcactatgcttggaagactatggccatggtgctctcaattgttagcctgtttcccttgtgtctgagtaccacgtctcagaaaacaacctggttaccggtgctcctggggtcccttggatgcaagcctctgactatgttcttgatcgccgagaataagatatggggtcgaaaaagctggccactcaacgaaggcatcatggctgtcgggattgtatcgatcctgctatcatctctgcttaagaacgatgtgcccctcgcaggacctctgattgccggcggtatgttgatcgcgtgttacgttataagtgggtccagcgctgacttatctctggagaaagccgcagaggtgagctgggaagaggaagccgagcattccggagcttcacacaatattctcgtcgaagtgcaggatgacggcacaatgaagatcaaagatgaggagcgcgacgataccctgactatccttctgaaggcaacattgctagccgtaagtggcgtgtatcccctgagcattccagcgaccctctttgtctggtacttctggcagaagaagaagcagcggtctggggttctgtgggacacgccttcacccccagaagtggagagagctgtgcttgatgacggaatatataggatcatgcagcgtggtttactgggccgcagccaggtcggggtgggagttttccaagaaaacgtatttcatactatgtggcacgtgacccggggcgccgtcctcatgtaccagggtaaaagattggagccgagttgggcaagcgtgaagaaagacctgatttcctacgggggaggctggaggctccgaggctcttggaatacaggggaggaagttcaggtgatcgccgtcgagcctggaaagaaccccaaaaatgtgcagaccgctccaggtacattcaagactcccgaaggcgaggtaggggccattgcactggattttaagcctggaacctcgggcagcccaatcgtcaaccgggaaggtaaaatagtggggctttatggaaatggcgttgtgacgacatcaggcacttacgtctccgctatcgcccaagcgaaggccagtcaggaggggcccctgcctgagattgaagacgaggtgttccgcaaaagaaacttgaccatcatggatctacacccgggatctggtaagacaaggcggtatctgccagcaattgttcgagaagctatcaaaagaaagctccgcaccttaatactggcccccactagggtggtcgctagcgagatggcagaagcccttaagggcatgcctattcgttaccagaccacagccgtgaaatccgagcatacggggaaggagatcgtagacctgatgtgccacgctacttttaccatgcggctcttgtcaccagtgagagttcccaattataacatgatcattatggatgaagcgcatttcacagacccttctagcatcgcagccaggggatacataagtacccgcgtcggcatgggtgaggctgccgcaatttttatgactgccacaccgcccgggtccgtggaggctttcccacaaagcaatgcggtgatccaggatgaggaacgagacattcctgagagatcttggaactcaggatatgagtggatcaccgattttcccggcaaaacggtctggttcgtaccatccataaagagtggcaatgacattgccaactgtctgcggaaaaatgggaagagggtgatccagctcagccgcaagacttttgatacagaataccagaaaaccaagaacaacgactgggactacgttgtgaccactgatatctcggagatgggagcaaatttccgtgctgacagagtcattgatcctcggaggtgcctgaaacccgtgatccttaaggacggtccagaacgcgttattctagccggcccgatgcctgtgacagtcgcatctgccgctcaacgaagagggcggataggaaggaaccacaataaagagggcgatcagtatatctacatgggtcagcccctgaacaatgacgaggatcatgcccactggaccgaagcgaagatgttgttagacaacattaatacaccagaggggatcatccccgcactgttcgaacctgagcgcgaaaagtccgccgctgtggatggcgagtatagactcaggggagaggcccggaaaacttttgtagaactgatgcgtcgcggcgaccttccagtgtggctgagctacaaggttgcttcagaggggttccagtatagtgatcgaagatggtgctttgacggagaaaggaacaatcaagtcctcgaggaaaacatggatgtggagatttggacgaaagagggtgaacggaagaaattgcgccccagatggctggacgcaaggacctactctgaccctctagccctgcgggagttcaaggaatttgctgccggccgaagatccgtgagcggggatctcatacttgagatcggaaaactgccgcagcacttaacacagcgcgcacagaatgcgttggacaacctggtcatgctccataattcagaacaaggcggtagggcctatcggcacgctatggaggagctgccagatactattgaaacccttatgctgctcgccttgatcgcagttctgacagggggcgtgaccttattctttctaagtggacgtggcctggggaagactagcattggactcctttgtgtaatggcttcctctgtgctgttgtggatggccagcgtcgagccccattggatcgcagcctccataatcctggagttctttctcatggtgctgcttattcctgagcccgacagacagaggacgccacaggataaccagctcgcttacgttgtgatcggtctgttgttcatgattctgaccgtcgcggccaatgagatgggcttactagaaacaactaagaaagacctggggatcggacacgtagcagtggagaaccaccatcacgctgccatgctcgatgttgaccttcatcctgcctcagcatggaccctgtacgctgtggccacaaccataattactcccatgatgcgccacacaatcgaaaacacgaccgcgaatatttctttgactgctatcgccaaccaagcagccatactgatgggcctcgataagggttggccaatcagtaaaatggacattggggtccctctgcttgctttaggctgctattcgcaagtgaatccgctgacactcaccgcagccgtcttgatgctggtggcgcattacgctatcattggacccggcctacaggccaaggcaacccgggaggcccaaaaacgaacagctgccgggatcatgaagaacccaactgttgatggaatagtggcaattgacctggatcctgtagtgtatgacgctaagtttgaaaaacagctcggccagatcatgcttctgatcttgtgtacgagccagattctgctcatgagaaccacatgggccctgtgcgagtccatcactttagcgaccggtccccttacaaccctgtgggaggggtctccaggaaagttctggaatactacgatagccgtctcaatggcaaacatttttaggggcagctacctcgctggtgccggcctagcattctccctgatgaaaagtctagggggaggccgccgggggacaggagctcaaggcgaaaccctgggtgagaagtggaaaagacagctcaatcagctttctaagagcgagttcaacacttataagcgttcagggatcatggaggttgacaggtccgaagccaaagagggactgaagcggggcgagaccacaaaacacgccgtgagtcgcggtactgcgaagttgcgatggtttgtcgaaagaaatctggtgaaacctgagggcaaggtaattgatctcgggtgtggaaggggcgggtggagctactattgcgctggattaaagaaagtgaccgaagttaagggctacacaaaaggtgggcccggacacgaggaaccgatcccaatggcaacgtacggctggaacctggtgaaacttcattctggcaaagacgtcttctttatacctcccgagaagtgtgataccctgctatgcgacatcggggagtcctcaccaaatcccactattgaagagggacggacactccgcgtgctgaaaatggtcgaaccttggttgagaggtaaccagttctgtatcaagattctgaatccgtatatgcccagcgtggttgagaccctcgagcaaatgcagaggaagcacggcgggatgcttgtacgaaacccactgtcgagaaattctactcatgaaatgtactgggtgagttgcggaacaggcaacatcgtctccgccgtgaatatgaccagccgtatgttactgaacagatttacgatggctcaccgcaaacctacctatgagagggatgttgacttgggtacagggactcggcacgtggccgtcgaacccgaggtggcaaacctcgatattatcggacagagaatagaaaatattaagcatgagcacaaatcaacctggcattacgacgaggataacccttataagacatgggcctaccacggctcctatgaagtaaaaccatctggcagcgctagttccatggtgaatggggttgtcaagctgctaactaagccctgggacgtgatccctatggtgacccagatcgcgatgacagataccactccattcggacaacagcgcgtctttaaagagaaggttgacacgaggacacccaaagccaagcgaggtaccgcacagattatggaagtgactgctcggtggctttggggcttcctgagcagaaacaaaaagccgaggatatgtacccgcgaggaatttacacgtaaggtacggtctaatgccgcaatcggggccgtgttcgtcgacgagaaccaatggaactcagctaaagaggccgtggaagatgagagattttgggacctcgttcatagggaacgcgagctgcacaagcagggaaaatgcgcgacgtgcgtgtacaacatgatgggcaagcgagagaagaagttgggtgagttcgggaaggcaaaaggaagtcgggccatttggtacatgtggctgggcgctagatttctcgagttcgaagcccttggcttcatgaatgaggatcactggttttccagggaaaacagcctgtctggggtcgagggagagggtttacataagctgggctatatcttgcgcgacatttcgaaaatccctgggggaaatatgtacgcagatgacaccgctggctgggatactagaataacagaagacgatctccagaacgaggccaagatcaccgacattatggaaccagagcacgctctgctagccaaagcaatcttcaaacttacttatcagaataaagtggtacgggttcaaaggcccgcgaagaacggtacagtgatggatgtcatttcacgtcgagaccagcgcgggagcggacaggtgggcacctacggcctgaatacatttactaacatggaagcccagctcatcagacaaatggagtccgaggggatattcagtccttctgaactggagaccccaaacttggctgaacgggccttagattggctggagaagtatggagtggaaaggctcaaacgcatggcaattagcggtgacgactgtgtcgttaagcccatcgatgacagatttgctacggcccttaccgcactgaatgatatgggcaaagtgcggaaggacatcccgcagtgggagccttccaaagggtggaacgattggcagcaggtacccttctgctcacatcactttcaccaactaattatgaaggacggaagggagatagtggtcccatgtcgaaatcaggatgaactggtgggccgtgccagagttagtcagggtgcggggtggtctctccgcgagacagcttgcttgggaaagagctacgcccagatgtggcaactgatgtatttccataaacgggaccttaggctggcagccaacgctatctgttccgccgtgcctgtcgattgggtgcccacttcaagaaccacatggagcattcacgcacatcaccagtggatgactaccgaagacatgctctctgtatggaatcgcgtttggatcgaggaaaacccatggatggaggataagacgcatatttccagttgggaggacgtgccctacttaggcaaacgggaagaccagtggtgcggcagcctgatcgggttgacagctagggccacctgggcgactaatatacaagtcgctatcaaccaggtgcgaagactgattggaaatgagaactacctcgattatatgacatcgatgaagcggtttaaaaatgaatccgaccctgagggtgccctttggtga

SEQ ID NO: 13861 - RNA, 9879 nt, synthetic construct
  misc_feature 1..9879: note = derived and/or modified CDS sequence (opt3) from DENV-1__FJ898421__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggagaactgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctcagcatttcgatcatgatcgaagaggtgatgcgctcccgatggtctcggaaaatgctgatgaccggaactctagccgtctttttcctgctcattatgggccagctgacatggaacgatcttatccgtttgtgtattatggtgggggcaaatgctagcgacagaatgggaatgggcaccacatacctggccttaatggcaacttttaagatgaggcctatgttcgccgttggtctcctgtttcgccggcttacctcaagagaggtgctgctactcacgatagggctgagtttggtcgcttccgtggaactgccaaactctttagaggaactcggagatggcctggcgatgggcatcatgattcttaaactgttgacagacttccaaagccatcagctctgggccaccctgctatccctgacttttatcaagaccacattctcacttcactatgcatggaaaactatggctatggttctcagcattgtgagtctgtttcccttgtgcctgtctaccacgtcccagaagacaacctggttaccggtcctcctggggagccttggatgtaagcctctgactatgttcttgatcgccgagaataaaatatggggtaggaagtcgtggccactcaacgaaggcatcatggccgtagggattgtgtcaatcctgctatctagtctgcttaaaaacgatgttcccctcgctggacctctgattgcaggcggtatgttgatcgcctgctacgtgatatccgggagctctgcggacttaagcctggagaaggctgccgaggtctcctgggaagaggaagcagagcattcaggagccagtcacaatattctcgtggaagtacaggatgacggcacaatgaaaatcaaggatgaggagcgagacgataccctgactatccttctgaaagctacattgctagcagtgagcggcgtctatcccctgtctattccagccaccctctttgtttggtacttctggcaaaagaagaaacagcgctccggggtgctgtgggacacgccttcacccccagaagtggagcgggcggtccttgatgacggaatatatagaatcatgcagaggggtttactgggccgtagtcaggtgggggttggagtattccaagaaaacgtgtttcatactatgtggcacgtcacccgcggcgctgtgctcatgtaccagggtaagcggttggagccgagctgggcctccgttaaaaaggacctgatttcttacgggggaggctggagactcaggggctcgtggaatacaggggaggaagtgcaggtcatcgcagtggagcctggcaaaaaccccaagaatgtacagaccgccccaggtacattcaagactcccgaaggcgaggtcggggctattgccctggattttaaacctggaaccagcggctcaccaatcgtgaaccgagaaggtaagatagttgggctttatggaaatggcgtggtcacgacatccggcacttacgtgagtgcaatcgctcaagccaaagcgtctcaggaggggcccctgcctgagattgaagacgaggttttccggaagcgcaacttgaccatcatggatctacacccgggaagcggtaaaacaagaaggtatctgccagccattgtgcgggaagcaatcaagcgaaagctcagaaccttaatactggctcccactcgcgtcgtggcctccgagatggctgaagcacttaaaggcatgcctattaggtaccagaccacagccgtaaagtcagagcatacggggaaagagatcgtggacctgatgtgtcacgccacttttaccatgcgtctcttgtctccagttcgggtccccaattataacatgatcattatggatgaagctcatttcacagaccctagcagtatcgcggcaagaggatacatatccaccagggtgggcatgggtgaggccgctgccatttttatgactgcaacaccgcccgggagcgtggaagccttcccacaatctaatgctgtcatccaggatgaggaacgcgacattcctgagcgatcatggaactccggatatgagtggatcaccgattttcccggcaagacggtatggttcgtgccaagtataaaaagcggcaatgacattgcgaactgcctgagaaagaatgggaagcgggttatccagctctcgaggaaaacttttgatacagaataccagaagaccaaaaacaacgactgggactacgtggtcaccactgatatctctgagatgggagccaatttccgcgcagaccgtgtgattgatcctagacggtgtctgaagcccgttatccttaaagacggtccagaaagggtgattctagctggcccgatgcctgtcacagtggcctccgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggagaaaagcgcagccgtagatggcgagtatcgcctcagaggagaggctaggaagacttttgtggaactgatgcggcgtggcgaccttccagtttggctgtcatacaaagtcgccagtgaggggttccagtattctgatcgccgatggtgctttgacggagaaagaaacaatcaagtgctcgaggaaaacatggatgtggagatttggacgaaggagggtgaaaggaaaaagttgcggccccgctggctggacgctagaacctactccgaccctctagcactgagggagttcaaagaatttgccgctggccggcgaagcgtctcaggggatctcatacttgagatcggaaagctgccgcagcacttaacacagagagcccagaatgcattggacaacctggttatgctccataatagtgaacaaggcggtcgcgcgtataggcacgccatggaggagctgccagatactattgaaacccttatgctgctcgctttgatcgccgtgctgacagggggcgtaaccttattctttctaagcggacggggcctggggaagacttccattggactcctttgcgtgatggcatctagcgtcctgttgtggatggcttccgtggagccccattggatcgccgcatcaataatcctggagttctttctcatggttctgcttattcctgagcccgaccgtcagagaacgccacaggataaccagctcgcctacgtggtcatcggtctgttgttcatgattctgaccgtagctgcgaatgagatgggcttactagaaacaactaaaaaggacctggggatcggacacgtggccgttgagaaccaccatcacgcagctatgctcgatgtggaccttcatcctgcctctgcctggaccctgtacgcagtcgctacaaccataattactcccatgatgaggcacacaatcgaaaacacgaccgccaatattagtttgactgcgatcgctaaccaagccgcaatactgatgggcctcgataaaggttggccaatctcgaagatggacattggggtgcctctgcttgccttaggctgttatagccaggtcaatccgctgacactcaccgctgcagtgttgatgctggttgcccattacgcgatcattggacccggcctacaggctaaagccacccgcgaggcacaaaagcggacagccgctgggatcatgaagaacccaactgtggatggaatagtagccattgacctggatcctgtggtctatgacgcaaaatttgaaaagcagctcggccagatcatgcttctgatcttgtgcacgtcccagattctgctcatgcgaaccacatgggctctgtgtgagtctatcactttagccaccggtccccttacaaccctgtgggaggggtcaccaggaaaattctggaatactacgatagcggttagcatggccaacatttttagaggctcctacctcgcaggagctggcctagccttcagtctgatgaagtctctagggggtggcaggcgcgggacaggagcacaaggcgaaaccctgggtgagaaatggaagcggcagctcaatcagcttagcaagtcagagttcaacacttataaaagatccgggatcatggaggtggaccgtagtgaagctaaggagggactgaaaaggggcgagaccacaaagcacgccgtcagccggggtactgccaaattgcgctggtttgtggaacgaaatctggtaaagcctgagggcaaggtgattgatctcgggtgcggaagaggcgggtggtcttactattgtgcgggactaaagaaggttaccgaagtgaaaggctacacaaagggtgggcccggacacgaggaaccgatcccaatggctacgtacggctggaacctggtcaaacttcattccggcaaggacgtgttctttatacctcccgagaaatgcgataccctgctatgtgacatcggggagtcaagcccaaatcccactattgaagagggaaggacactccgggtcctgaagatggtggaaccttggttgcgcggtaaccagttctgcatcaagattctgaatccgtatatgccctcggttgtagagaccctcgagcaaatgcagagaaaacacggcgggatgcttgtgaggaacccactgtctcgaaatagtactcatgaaatgtactgggtctcctgtggaacaggcaacatcgtgagcgcagttaatatgacctcacggatgttactgaaccgttttacgatggcccacagaaagcctacctatgagcgcgatgtggacttgggtacagggactaggcacgtcgctgtggaacccgaggtagccaacctcgatattatcggacagcggatagaaaatattaaacatgagcacaagtccacctggcattacgacgaggataacccttataaaacatgggcataccacggctcttatgaagtgaagccaagcggcagtgcctccagcatggttaatggggtcgtgaagctgctaactaaaccctgggacgtgatccctatggtcacccagatcgctatgacagataccactccattcggacaacagagagtttttaaggagaaagtggacacgcgcacacccaaggcgaaaaggggtaccgcccagattatggaagtaactgcacgatggctttggggcttcctgtctcggaacaagaagccgagaatatgcaccagggaggaatttacacgcaaagtgcgttcaaatgctgccatcggggcagtcttcgtggacgagaaccaatggaatagtgccaaggaggctgttgaagatgagcggttttgggacctcgtgcatagagaaagggagctgcacaaacagggaaagtgtgccacgtgcgtctacaacatgatgggcaaacgcgaaaagaagttgggtgagttcgggaaagcgaagggatcccgagcaatttggtacatgtggctgggcgcccggtttctcgagttcgaagctcttggcttcatgaatgaggatcactggtttagcagagaaaactctctgtcgggggtggagggagagggtttacataaactgggctatatcttgagggacatttcaaagatccctgggggaaatatgtacgccgatgacaccgcaggctgggatactcgcataacagaagacgatctccagaacgaggctaaaatcaccgacattatggaaccagagcacgccctgctagctaaggccatcttcaaacttacttatcagaataaggtagttagagtgcaacggcccgcaaagaacggtacagtcatggatgtgattagcaggcgtgaccagcgagggtccggacaggtgggcacctacggcctgaatacatttactaacatggaagcgcagctcatccgccaaatggagagtgaggggatattctctcctagcgaactggagaccccaaacttggccgaaagagctttagattggctggagaaatatggagtcgaacggctcaagaggatggccatttccggtgacgactgcgttgtgaaacccatcgatgaccgctttgcaacggctcttaccgccctgaatgatatgggcaaggtaagaaaagacatcccgcagtgggagccttcaaaggggtggaacgattggcaacaggtgcccttctgtagtcatcactttcaccaactaattatgaaggacggacgggagatagtcgtgccatgcaggaatcaggatgaactggttggccgagcacgtgtgtctcagggtgccgggtggagcctcagagagacagcgtgtttgggaaaatcctacgctcagatgtggcaactgatgtatttccatcgccgggaccttaggctggccgcaaacgccatctgctcagctgtccctgtggattgggtacccactagcagaaccacatggtctattcacgcccatcaccagtggatgactaccgaagacatgctctccgtttggaatcgcgtgtggatcgaggaaaacccatggatggaggataagacgcatattagtagctgggaggacgtcccctacttaggcaaacgggaagaccagtggtgtggctcgctgatcgggttgacagcaagggctacctgggccactaatatacaagtggcgatcaaccaggttcgaagactgattggaaatgagaactacctcgattatatgacatccatgaagcggtttaaaaatgaatctggtcctgagggcgctctttggtga

SEQ ID NO: 13862 - RNA, 9879 nt, synthetic construct
  misc_feature 1..9879: note = derived and/or modified CDS sequence (opt3) from DENV-1__FJ898423__SS-prME
  source 1..9879: mol_type = other RNA
agcgtgacaatgctgctcatgcttatgcccacagcactggctttccacttgactacgagaggaggggaacctcatatgatcgtctccaagcaggaaagggggaaatctttactgtttaagacctcagccggtgttaacatgtgcacactaattgccatggacctcggagaactgtgtgaagatactatgacctacaaatgcccacggataacagaagtggaaccggacgatgtagactgttggtgcaataccactgatacatgggtgacctatgggacgtgtagtcaaactggagaacaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaaactttgcattgaagccaaaatctctaatacgaccacagatagcagatgtccaactcaaggagaggctaccctggttgaagaacaggacgccaacttcgtgtgccggcgcacatttgtagatcgaggctggggtaatgggtgtggattgttcggcaagggctccctcataacttgcgcaaagtttaaatgcgtgaccaagctggaggggaaaattatccagtacgaaaacttaaagtattcagtcattgtgacagttcacaccggagaccagcatcaagtgggtaatgagagtactgaacacggcacgatcgctacaatcacaccccaggcccctactagcgagattcagctgaccgactacggggcgctcacacttgattgttctccaagaaccggactggacttcaacgaaatggtcttgctaactatgaaagagaagtcctggctggtgcataaacagtggtttctcgatctgccgcttccctggacatcaggcgccagcacgagtcaagagacctggaataggcaggacctgttggtaactttcaagacagcacacgctaagaaacaggaagttgtggtcctcggttctcaagagggggccatgcacaccgctctgacaggcgccactgaaatacagaccacgggaaccacaactatctttgcaggccatttaaagtgccggctgaaaatggataagctaaccctcaaagggatgtcctatgtgatgtgtacaggcagcttcaagctggagaaggaagtcgccgagactcagcacggtaccgtgcttgttcagattaaatacgagggcacggacgctccttgcaagatcccattctcgacacaagatgaaaaaggggtgacccagaacggacgtttgataactgcgaatcccattgtaacagacaaggagaaacctgtcaacatcgaagcagagccaccctttggcgagtcttatatcgtgattggtgccggggaaaaggctctgaagctctcctggttcaaaaagggctcaagtatcggaaaaatgtttgaggccaccgcacgcggcgccagaaggatggctattctgggggatactgcctgggacttcggaagcataggtggcgtttttacctccgtggggaaacttgtccatcagatcttcggaacagcatacggcgtgctgttttctggtgtaagctggacgatgaaaattgggatcggcgtgttgctcacctggctgggattaaattcacggagtacttccctgagcatgacatgtatcgcggttggcctaattaccctctacctgggggtcatggtgcaggctgattctggatgcgtgataaactggaagggccgagaacttaagtgtggttcagggatcttcgtcacaaatgaggttcacacttggaccgaacaatataaatttcaggccgacagtccgaagcgcttgagcgcagccattggaaaggcttgggaggagggcgtgtgcggtatcagatccgccacgaggctggaaaacattatgtggcggcagatctctaacgagctcaatcatatactgttagaaaacgacatgaagttcacagtggtagtcggcgatgtggttgggatcctggcacagggcaagaagatggtgcgccctcaacccatggagcacaaatactcgtggaaaagctggggcaaggctaagattatcggggccgacgtccagaataccacttttattatcgatggaccaaacacccctgaatgtcccgacgatcagagagcgtggaatatatgggaggtggaggactatggcttcggtatttttacaactaacatctggcttaagttgagggattcctacacccaggtttgcgaccaccgtctcatgtcagccgctattaaagatagtaaggcagtgcatgccgacatggggtattggatcgaatctgagaaaaatgaaacatggaagctggctcgggccagcttcatagaggtaaagacgtgtatctggccaaaatcccacaccctatggtcaaacggagtcctggaaagcgagatgattatccccaagatttacggcggtcctatctctcaacataattatcgaccaggctacttcactcagacagcagggccgtggcacctcggaaaactggagcttgattttgacttgtgcgaaggcaccactgtggtggtcgatgagcactgcgggaacagaggaccctccctgaggacaaccacggttactggcaagataattcatgaatggtgttgccgcagttgtaccttacctccactccggttcaaaggtgaggacgggtgctggtacggaatggagatcagacccgtgaaggaaaaggaggaaaatctggtaaaaagcatggtgtctgcgggctccggtgaggtcgactcatttagtcttggcctgttgtgtatcagcattatgatcgaagaggtgatgaggtcgcgctggtcccgaaagatgctcatgacagggaccctggccgttttctttctactgattatgggacagctcacttggaacgatctgatacggtcttgcatcatggtgggcgctaatgccagcgaccgtatggggatgggaacaacctatcttgcattgatggctacattcaaaatgagacctatgtttgccgtcggcctgttattcaggcgcctcacttcacgggaggtgctgcttctgaccattggtctaagtctcgttgcatccgtggaactgccaaactctttggaggaactgggggatggattagccatgggcatcatgattctcaagctgcttacggactttcaaagctaccagctgtgggctacattgctctccctgaccttcatcaaaactaccttttcactacactatgcgtggaagacaatggccatggtcctgagcatagtaagtcttctccccctgtgtttgtctactacctcccagaagacgacatggctgccggtgttactcggcagcctggggtgcaaacctcttaccatgttcctgatcgcagagaataagatttggggaagaaaatcgtggccattgaacgaaggtatcatggctgttggcattgtgtcaatcctcctgtctagtctactgaagaacgatgtcccccttgccgggcctctcatagccggaggcatgctgattgcttgttacgtgatctccggtagctctgcagacttgagcttagagaaagccgcggaggtatcctgggaagaggaagctgagcattcaggggccagtcacaatatcctggtggaagtccaggatgacggaactatgaagattaaagatgaggagagggacgatacactcaccatactgcttaaggcaactctgttggccgttagcggcgtgtatcccctatctatcccagctacactgtttgtgtggtacttctggcaaaagaaaaagcagcgatccggcgtcctctgggacaccccttcacccccagaagtggagcgcgcagttctggatgacgggatttatcggatcatgcagagaggacttttaggtaggagtcaggtaggcgtgggggtcttccaagaaaacgtgtttcatacgatgtggcacgttactcgtggagccgtgctgatgtaccagggcaaacgcctcgagccgagctgggcgtccgtcaagaaagacttgatttcttacggtgggggatggcggctgcagggctcgtggaataccggcgaggaagtgcaggtaatcgctgtcgagcctgggaagaaccccaagaatgtgcaaacagccccaggaaccttcaaaacacccgaaggtgaggttggcgcaatagccctcgattttaagcctgggactagcggatcaccaatcgtgaacagagaaggcaaaattgtcggtctgtatgggaatggagtggttaccacgtccggcacatacgtgagtgctatcgcccaggcaaaggcttctcaggagggcccccttcctgagattgaagacgaggtcttcaggaaacgaaacctgactatcatggatttgcacccggggagcggaaagacccggcgctatctaccagccatagtgagagaagcgattaagaggaaactgcggacactcatcttagcccccacccgagtagtggcatccgagatggctgaagccctgaagggtatgcctatcagataccaaactaccgctgttaaatcagagcatacaggccgcgagattgtcgaccttatgtgccacgcaacgtttactatgaggctgctctctccagtgcgtgtgcccaattataacatgatcataatggatgaagcccatttcaccgaccctagcagtattgccgctcgggggtacatctccacaagagtcggaatgggcgaggcggcagccatttttatgaccgctactccgcccggtagcgtagaagccttcccacagtctaatgcagtgatccaggatgaggaaagggacatacctgagcgctcatggaactccgggtatgagtggattacagattttcccggaaagaccgtttggttcgtgccaagtatcaaaagcggcaatgacatcgccaactgtttgcgaaagaatggcaagagagtcattcagctgtcgcggaaaacgtttgatactgaataccaaaagaccaagaacaacgactgggactacgtggttaccaccgatatctctgagatgggggctaatttcagggcggaccgcgtgattgatcctcgtagatgcctcaagcccgtcatactgaaagacggaccagaacgggtgatccttgccggtccgatgcctgtaactgtggcatccgctgcccagaggcgcggccgaattgggagaaaccacaataaggagggagatcagtatatctacatgggccagcccctaaacaatgacgaggatcatgcacactggacagaagccaagatgctgttggacaacatcaataccccagagggtattatacccgctttattcgaacctgagcgggagaaaagcgccgcgatcgatggggagtataggctgcgcggcgaggcaagaaagacatttgttgaactcatgaggcggggagacctgccagtctggctttcatacaaagtggccagtgagggcttccaatattctgatcgtcgctggtgctttgacggggaacgaaacaatcaggtgctggaggaaaacatggatgtcgagatttggactaaggagggagaaaggaaaaagctcaggccccggtggttggacgctcgcacgtactccgaccctctggccctaagagagttcaaagaatttgctgcaggtaggcggagcgtttcaggcgatctgatcctcgagattgggaaacttccgcagcacctgacccagcgagcccaaaatgctttagacaacttggtgatgctgcataatagtgaacagggaggcagagcctatcgccacgcaatggaggagctcccagatacaatcgaaactctgatgcttctggcgctcatagccgtattgaccggtggggtgacactgttctttttaagcggcaggggactaggcaagacctccatcgggctgctctgtgtcatggcttctagcgcccttctgtggatggcatccgtggagccccattggattgctgcctcaatcattttggagttctttctgatggttctcctgatccctgagcccgaccggcagcgtactccacaggataaccaacttgcatacgtggtcataggactcctgttcatgattttgacggtagccgctaatgagatgggtctgttagaaaccaccaaaaaggacctaggcatcgggcacgtggcggttgagaaccaccatcacgccactatgctggatgtggacctccatcctgcatctgcttggaccctttacgccgtcgccacaaccattatcactcccatgatgagacacacaatagaaaacacgaccgcaaatatcagtctgactgctattgccaaccaggcggctatcttgatgggactggataaaggctggccaatttcgaagatggacatcggtgtgcctctcctggcccttgggtgctatagccaggtcaatccgttaacactgaccgcagccgtgctcatgttggttgctcattacgcaataattggccccggactgcaagccaaagcgaccagggaggctcagaagcgcacagccgcaggcatcatgaagaacccaactgtggatgggatcgtagccattgacctagatcctgtggtctatgacgctaaatttgaaaagcagctgggacagatcatgctccttatactgtgtacgtcccaaattttgctgatgcggaccacatgggccctctgcgagtctatcactctggcaaccggccccttaacaaccctttgggagggttcaccagggaaattctggaatactacgattgctgttagcatggccaacatctttcgaggatcctacctggcgggcgccggtctcgcattcagtctaatgaagtctctgggcgggggaagaaggggcacaggggctcagggagaaaccttgggcgagaaatggaagcgccagctgaatcagctcagcaagtcagagttcaacacttataaacggtccggtataatggaggtggacagaagtgaagccaaggaggggcttcgtaggggagagaccacaaaacacgcagtcagccggggcactgctaagctgcgctggtttgtggaacgaaatttggtaaaacctgagggtaaggtgatcgatctgggctgtgggagaggaggctggtcttactattgcgccgggctcaagaaagttaccgaagtgaagggatacacaaaaggcggtcccgggcacgaggaaccgattccaatggccacgtacggatggaacttagtcaagctgcattccggcaaagacgtgttctttatccctcccgagaagtgtgatacccttctgtgcgacattggcgagtcaagcccaaatcccactatcgaagaggggaggacactacgggtcctcaaaatggtggaaccttggctgcgcggaaaccaattctgtattaagatcttgaatccgtatatgccctcggttgtagagaccctggagcacatgcagagaaagcatggtggcatgctcgtgaggaacccactttctcgaaatagtactcacgaaatgtactgggtctcctgcgggacaggaaacatagtgagcgcggttaatatgacctcacggatgctgttaaaccgttttacgatggctcacagaaaacctacctatgagcgcgatgtggacctgggcgcaggtacaaggcatgtcgccgtggaacccgaggtagctaacttggatattatcgggcagcggatcgaaaatattaagcacgagcataaatccacttggcactacgacgaggataacccttataagacctgggcctaccatggatcttatgaagtgaaaccaagcggcagtgcatccagcatggttaatggcgtcgtgaagctcctgacaaagccctgggacgtgatacctatggtcactcagatcgccatgaccgatacaaccccattcgggcaacagagagtttttaaagagaaggtggacactcgcacgcccaaagctaagaggggaacagcgcagattatggaagtaaccgcccgatggctatggggtttcctttctcggaacaaaaagccgagaatctgtactagggaggaatttacccgcaaggtgcgttcaaatgcagctattggcgccgtcttcgtggacgagaaccaatggaatagtgcaaaagaggccgttgaagatgagcggttttgggacctggtgcacagagaaagggagctccacaagcaggggaaatgcgctacatgcgtctacaacatgatgggaaagcgcgagaaaaagctgggcgagttcggtaaggccaaagggtcccgagcgatctggtacatgtggttgggagcacggtttctggagttcgaagccctcggcttcatgaatgaggatcattggtttagcagagaaaactctctttcgggcgtggagggggagggactgcacaagttaggttatatactgagggacatctcaaaaattcctggcgggaatatgtacgctgatgacacggccggatgggatacccgcatcactgaagacgatttgcagaacgaggcaaagattacagacatcatggaaccagagcatgctctcctggccaccagcatattcaaactaacttatcagaataaggtagttagagtgcaacggcccgctaaaaacggcacagtcatggatgtgatttccaggcgtgaccagcgaggtagtggacaggtgggaacctacggccttaatacatttactaacatggaagcccagctgatccgccaaatggagtctgagggcatcttcagcccttccgaactcgagaccccaaacctggcagaaagagtcttggattggttagagaagtatggggttgaacggctgaagaggatggcgatttcaggagacgactgtgtggtaaaacccatagatgaccgctttgccacggctctcaccgcccttaatgatatgggtaaggtgagaaaagacatcccgcagtgggagcctagtaagggctggaacgattggcagcaggtccccttctgctctcaccactttcatcaactgattatgaaagacgggcgggagatcgtggttccatgtaggaatcaggatgagctagtgggacgagcacgtgtcagccagggcgctggttggtccctgagagagacagcctgcctcgggaagtcatacgcacagatgtggcaattgatgtatttccaccgccgggacctgaggcttgccgcgaacgctatttgtagcgccgtgcctgtagattgggttcccacttctagaaccacatggtccatccatgcacaccatcagtggatgactaccgaagacatgctgagtgtgtggaatcgcgtctggatagaggaaaacccatggatggaggataagacgcacatcagctcgtggggagacgtgccctacctcggcaaacgggaggaccagtggtgcggctccttaattgggctgacagccagggctacctgggccactaatatccaagttgcaattaaccaggtgcgaagattgatcggaaatgaaaactacctggattatatgacatctatgaagcggtttaaaaatgagtcagaccctgaaggtgctctctggtga

SEQ ID NO: 13863 - RNA, 9879 nt, synthetic construct
  misc_feature 1..9879: note = derived and/or modified CDS sequence (opt3) from DENV-1__FJ898424__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcaacaggtgttaacatgtgcactctaattgcaatggacctcggcgagctgtgtgaagataccatgacatacaaatgcccacggataaccgaggtggaaccggacgatgtagactgttggtgcaatactacagatacctgggtgacgtatgggacttgtagtcaaaccggagagcaccgccgagacaagcgtagcgtcgcccttgcgccccatgtgggcctgggtttggagacaagagctgaaacttggatgtcctctgagggggcctggaaacagatccagaaggttgaaacctgggcactcaggcaccctggattcacagtgattgccctgtttctggctcatgcaatcggcacctcgattacgcagaagggcatcatattcatcctcttaatgctggtcactccatcaatggccatgcggtgcgtggggattggaagccgcgattttgtagagggtcttagtggcgctacatgggttgacgtggtcttggagcacgggtcctgtgtgaccactatggccaaagataagcccacactggacatcgaactactcaaaaccgaggtgacgaaccctgcggtcctgagaaagctttgcattgaagcaaaaatctctaataccacaactgatagcaggtgtccaacccaaggagaggccacactggttgaagagcaggacgctaacttcgtgtgccggcgcacttttgtagatcgaggctggggtaatgggtgtggattgttcggcaagggctccctcataacctgcgccaagtttaaatgcgtgacaaagctggaggggaaaattgtccagtacgaaaacttaaagtattcagtgatcgttaccgtgcacactggagaccagcatcaagtcggtaatgagagtacggaacacggcacaaccgcaactattaccccccaggctcctacaagcgagatccagctgaccgactacggggccctcactcttgattgttctccaagaacaggactggacttcaacgaaatggtgttgctaacgatgaaagagaagtcctggctggtacataaacagtggtttctcgatctgccgcttccctggacctcaggcgcgagcactagtcaagagacatggaataggcaggacctgttggttaccttcaagacagcccacgcaaagaaacaggaagtggtcgtgctcggttctcaagagggggctatgcacactgccctgaccggcgctacggaaatccagacctccggaacaactaccatttttgccggccatttaaagtgccggctgaaaatggataagctaacactcaaagggatgagctatgtcatgtgtactggatcgttcaagctggagaaggaagtggcagagacccagcacggtacggttcttgtgcagataaaatacgagggcacagacgccccttgcaagatcccattctctacccaagatgaaaaaggggtaactcagaacggacgtttgattacagctaatcccatcgtcaccgacaaggagaaacctgtgaacatagaagcggagccaccctttggcgagtcctatattgttatcggtgcaggggaaaaggccctgaagctctcatggttcaaaaagggcagtagcatcggaaaaatgtttgaggctactgcccgcggcgcaagaaggatggccattctgggggataccgcttgggacttcggatccatcggtggcgtgtttacatctgtcgggaagcttgtgcatcagattttcggaacggcctacggcgtactgtttagcggtgtgtcatggaccatgaaaatagggatcggcgttttgctcacttggctgggattaaatagtcggtccacaagcctgtctatgacctgtattgcagtcggcctagtgacactctacctgggggtgatggtccaggcggattcaggatgcgttatcaactggaagggccgagaacttaagtgtggtagtgggatcttcgtgactaatgaggtgcacacctggacggaacaatataaatttcaggctgacagcccgaagcgcttgtccgccgcaattggaaaagcctgggaggagggcgtatgcggtataagatctgctacaaggctggaaaacatcatgtggcggcagatttcgaacgagctcaatcatatcctgttagaaaacgacatgaagttcaccgtcgtggttggcgatgtggtcgggattctggcccagggaaaaaagatgatccgccctcaacccatggagcacaaatacagctggaagtcctggggcaaggcaaaaataatcggggctgacgtgcagaatactacctttattatcgatggaccaaacacacctgaatgtcccgacgatcagagagcctggaatatttgggaggttgaggactatggcttcggtatctttactaccaacatatggcttaagttgagggattcatacacacaggtgtgcgaccaccgtctcatgagtgcggccattaaagattctaaggctgtacatgcagacatggggtattggatcgaaagcgagaaaaatgaaacgtggaagctggcccgggcttccttcattgaggtcaagacctgtatctggccaaaatcacacactctatggagcaacggagtgctggaatctgagatgataatccccaagatttacggcggtcctatctcccaacataattatcgaccaggctacttcacacagaccgccgggccgtggcacctcggaaaactggagcttgattttgacttgtgcgaaggcactacagtggtcgttgatgagcactgcgggaacagaggacccagtctgaggaccacgactgtgaccggcaagattatccatgaatggtgttgccgcagctgtacattacctccactccggttcaaaggtgaggacgggtgctggtacggaatggagataagacccgtaaaggaaaaggaggaaaatctggtgaaatctatggtctccgcaggctcaggtgaggtggacagttttagccttggcctgttgtgtatttcgatcatgatcgaagaggttatgaggtcccgctggtctcgaaagatgctcatgaccgggactctggcggtgttctttctactgattatgggacagctcacatggaacgatctgatccggagctgcattatggtcggcgccaatgcttcagaccgtatggggatgggaaccacatatcttgccttgatggcaactttcaaaatgagacctatgtttgctgtgggcctgttattcaggcgcctcaccagtcgggaggttctgcttctgacgataggtctatccctcgtggcctctgtcgaactgccaaacagcttggaggaactgggggatggattagcaatgggcatcatgattctcaagctgcttacagactttcaatcctaccagctgtgggccaccttgctctcactgactttcatcaaaaccacatttagcctacactatgcttggaagactatggcgatggtactgagtattgtgtctcttctccccctgtgtttgtccaccacgagccagaagacaacctggctgccggttttactcggctcgctggggtgcaaacctcttactatgttcctgatcgccgagaataagatatggggaagaaaatcatggccattgaacgaaggtatcatggcagtgggcattgtctctatcctcctgagttccctactgaagaacgatgtgccccttgctgggcctctcattgccggaggcatgctgatcgcctgttacgtaataagcggttctagcgctgacttgtccttagagaaagcagccgaggtgtcatgggaagaggaagcggagcatagtggggctagccacaatattctggtcgaagttcaggatgacggaacaatgaagatcaaagatgaggagagggacgataccctcactatcctgcttaaggccacactgttggcagtgtctggcgtgtatcccctatccattccagccaccctgtttgtctggtacttctggcaaaagaaaaagcagcgatcaggcgtgctctgggacacgcctagtcccccagaagttgagcgcgctgtactggatgacgggatatatcggatcatgcagagaggacttttaggtaggagccaggtgggcgtcggggtgttccaagaaaacgtttttcatactatgtggcacgtgacccgtggagcagtcctgatgtaccagggcaaacgcctcgagccgtcctgggcctctgtgaagaaagacttgatttcgtacggtgggggatggcggctgcagggcagctggaatacaggcgaggaagtacaggtcatcgcggtggagcctgggaagaaccccaagaatgttcaaaccgctccaggaacattcaaaactcccgaaggtgaggtgggcgccattgcactcgattttaagcctgggacctcaggatccccaatcgtcaacagagaaggcaaaatagtgggtctgtatgggaatggagttgtgacgacaagtggcacttacgtctctgccatcgctcaggccaaggcaagccaggagggcccccttcctgagattgaagacgaggtgttcaggaaacgaaacctgaccatcatggatttgcacccggggtccggaaagacacggcgctatctaccagctattgtaagagaagccatcaagaggaaactgcggaccctcatattagcgcccactcgagtggttgcctcagagatggcagaagctctgaagggtatgcctattagataccaaaccacagccgtcaaatctgagcatacgggccgcgagatcgtggaccttatgtgccacgctacttttaccatgaggctgctcagcccagtgcgtgtccccaattataacatgatcattatggatgaagcacatttcacagaccctagttccatcgccgcccgggggtacataagcaccagagtaggaatgggcgaggctgcggcaatttttatgactgccacaccgcccggttctgtggaagctttcccacagtcaaatgccgttatccaggatgaggaaagggacattcctgagcgctcctggaacagtgggtatgagtggatcaccgattttcccggaaagacggtgtggttcgtcccaagcataaaatcgggcaatgacattgcaaactgtttgcgaaagaatggcaagagagtgatccagctgtctcggaaaacttttgatacagaataccaaaagaccaaaaacaacgactgggactacgttgtgaccactgatatctccgagatgggggccaatttcagggctgaccgcgtcattgatcctcgtagatgcctcaagcccgtgatcctgaaagacggaccagaacgggtaattcttgcgggtccgatgcctgtgacagttgccagcgcagctcagaggcgcggccgaatagggagaaaccacaataaggagggagatcagtatatctacatgggccagcccctaaacaatgacgaggatcatgcccactggaccgaagcaaagatgctgttggacaacattaatacaccagagggtatcatccccgccttattcgaacctgagcgggaaaaatcagctgccattgatggggagtataggctgcgcggcgaggcgagaaagacttttgtcgaactcatgaggcggggagacctgccagtgtggcttagttacaaagtggcatctgagggcttccaatattccgatcgtcgctggtgctttgacggggaacgaaacaatcaggtcctggaggaaaacatggatgttgagatatggacgaaggagggagaaagaaaaaagctcaggccccggtggttggacgcccgcacctacagcgaccctctggctctaagagagttcaaagaatttgccgctggtaggcggtcagtgagtggcgatctgatcctcgagattgggaagcttccgcagcacctgacacagcgagcacaaaatgccttagacaacttggtaatgctgcataatagcgaacagggaggcagagcttatcgccacgccatggaggagctcccagatactatcgaaaccctgatgcttctggcactcattgcggtgttgacaggtggggtcaccctgttctttttatccggcaggggactaggcaagacttctatcgggctgctctgtgtgatggccagctccgctcttctgtggatggcctcagttgagccccattggatagcagcttctatcattttggaattctttctgatggtgctcctgatccctgagcccgaccggcagcgtacgccacaggataaccaacttgcctacgtcgtaattggactcctgttcatgatcttgaccgtggcagccaatgagatgggtctgttagaaacaactaaaaaggacctaggcatagggcacgttgctgtggagaaccaccatcacgcgaccatgctggatgtcgacctccatcctgccagtgcatggacactttacgctgtggccaccactattatcacacccatgatgagacacacgattgaaaacaccactgccaatatctcgctgacagcaatagctaaccaggccgcgatcttgatgggactggataaaggctggccaattagcaagatggacatcggtgtccctctcctggctcttgggtgctattcccaggtgaatccgttaaccctgaccgccgcagttctcatgttggtggcccattacgctattatcggccccggactgcaagcaaaagccacaagggaggcgcagaagcgcactgctgccggcataatgaagaacccaacggtagatgggattgtggcaatcgacctagatcctgtcgtttatgacgccaaatttgaaaagcagctgggacagatcatgctccttattctgtgtacctctcaaatcttgctgatgcggacaacttgggctctctgcgagtcaataaccctggccacaggccccttaaccactctttgggagggtagcccagggaaattctggaatacgacaattgcagtgtccatggctaacatctttcgaggaagttacctggccggcgcgggtctcgccttctctctaatgaagagcctgggcgggggaagaaggggcaccggggcacagggagaaactttgggcgagaaatggaagcgccagctgaatcagctctcaaagtccgaattcaacacctataaacggagtggtattatggaggtcgacagaagcgaagctaaggaggggcttcgtaggggagagacaactaaacacgccgtgtctcggggcaccgcaaagctgcgctggtttgtagaacgaaatttggtgaaacctgagggtaaggttatcgatctgggctgtgggagaggaggctggtcctactattgcgctgggctcaagaaagtgacagaagtcaagggatacacgaaaggcggtcccgggcacgaggaaccgataccaatggccacctacggatggaacttagtgaagctgcattcaggcaaagacgtcttctttatccctcccgagaagtgtgatactcttctgtgcgacattggcgagagctcgccaaatcccacaatcgaagaggggaggaccctacgggtgctcaaaatggttgaaccttggctgcgcggaaaccaattctgtattaagatcttgaatccgtatatgccctctgtagtggagactctggagcagatgcagagaaagcacggtggcatgctcgtcaggaacccacttagtcgaaattccacacatgaaatgtactgggtgagctgcgggaccggaaacattgtttcagccgtgaatatgacgtcccggatgctgttaaaccgttttaccatggcgcacagaaaacctacatatgagcgcgatgtcgacctgggcgctggtactaggcacgtggcagtagaacccgaggtggccaacttggatatcatagggcagcggattgaaaatatcaagcatgagcacaaatctacctggcattacgacgaggataacccttataagacatgggcttaccacggaagctatgaagttaaaccaagtggctccgccagctctatggtcaatggcgtggtgaagctcctgactaagccctgggacgtcatccctatggttacccaaattgcaatgacagataccactccattcgggcagcagagagtgtttaaagagaaggtagacacgcgcacacccaaagccaagaggggaaccgctcaaataatggaagtgactgcgcgatggctatggggtttcctttcacggaacaaaaagccgagaatctgtaccagggaggaatttacacgcaaggtccgtagtaatgccgcaattggcgctgtgttcgttgacgagaaccagtggaattccgccaaagaggcagtggaagatgagcggttttgggacctggtccatagagaaagggagctccacaagcaggggaaatgcgccacgtgcgtgtacaacatgatgggaaagcgcgaaaaaaagctgggcgagttcggtaaggctaaagggagccgagccatctggtacatgtggttgggagcgcggtttctggagttcgaagcactcggcttcatgaatgaggatcactggttttctagagaaaactcgctttcaggcgtagagggggagggactgcataagttaggttatattctgagggacatcagcaaaatacctggcgggaatatgtacgccgatgacaccgctggatgggatactcgcatcacagaagacgatttgcagaacgaggccaagattaccgacatcatggaaccagagcacgcactcctggctacttccattttcaaactaacatatcaaaataaggttgtgagagtccagcggcccgccaggaacggcaccgtgatggatgtgatcagtcgtcgagaccagcgcggttctgggcaggtcggaacatacggccttaatacttttaccaacatggaagctcaactgataagacagatggagagcgagggcattttctccccttcagaactcgagacgccaaacctggccgaacgggttttggattggttagagaaacatggggtggaaaggctgaagcgcatggcaatcagtggagacgactgtgtagtgaagcccatcgatgacagatttgcgaccgccctctctgctcttaatgatatgggtaaagtccggaaggacattccgcagtgggagcctagcaaaggctggaacgattggcagcaagtgcccttctgctcccaccactttcatcagctgataatgaaggacgggagggagatcgttgtgccatgtcgaaatcaggatgaactagtcggacgtgccagagtgtcacagggcgcaggttggagcctgcgcgagacagcttgcctcgggaaatcttatgcccaaatgtggcagttgatgtacttccaccggagggacctgagacttgcagccaacgcgatttgttccgctgtacctgttgattgggtgcccactagtcgcaccacatggagcatccatgcccaccatcagtggatgactaccgaagacatgctgtcggtctggaatcgggtgtggattgaggaaaacccatggatggaggataagacgcacatctcctcttggggagacgttccctatctcggcaagagggaggaccaatggtgcggctcattaatagggctgacagcacgagccacctgggctactaatatccaggtggccattaaccaggtcagacggttgatcggaaatgaaaactacctggattacatgacaagcatgaaaaggtttaagaatgagagtgaccctgaaggtgcactctggtga

SEQ ID NO: 13864 - RNA, 9879 nt, synthetic construct
  misc_feature 1..9879: note = derived and/or modified CDS sequence (opt3) from DENV-1__FJ898425__SS-prME
  source 1..9879: mol_type = other RNA
agcgtgaccatgctgctcatgcttatgcccaccgccctggctttccacttgactacgagaggaggggaacctcatatgatcgtcaccaagcaggaaaggggaaaatccttactgtttaagacatctgccggtgttaatatgtgcactttaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccattgggaaacttgttcatcagatattcggaacggcgtacggcgtgctgttttctggtgtcagctggaccatgaagatcgggattggcgtgttgctcacttggctgggattaaattcacgaagtacatccctgagcatgacctgtatcgctgtaggcctagtgacactctacctgggggttatggtccaggccgattctggatgcgtgatcaactggaaaggccgcgaacttaagtgtggttcagggattttcgtgactaatgaggtccacacctggacggaacaatataagtttcaggcagacagtccgaaaagattgagcgccgctataggaaaggcctgggaggagggcgtttgcggtatcaggtccgcaacacggctggaaaacattatgtggaaacagatctctaacgagctcaatcatattctgttagaaaacgacatgaagttcaccgtggtggtaggcgatgtcgtggggatcctggctcagggcaagaagatgatacgccctcaacccatggagcacaaatactcgtggaaaagctggggcaaggccaaaatcattggggcggacgttcagaatactacctttatcattgatggaccaaacacacctgaatgtcccgacgatcagagagcctggaatatctgggaggtggaggactatggcttcggtatatttactaccaacatttggcttaagatgagggattcctacacacaggtctgcgaccaccgtttgatgtcagctgcaatcaaagatagtaaggccgtgcatgctgacatggggtattggattgaatctgagaaaaatgaaacgtggaagctcgcccgggcatccttcatcgaggttaagacctgtatatggccaaaatcccacactctgtggtcaaacggagtgctagaaagcgagatgatcattcccaagatctacggcggtcctatttctcaacataattatcgaccaggctacttcacacagaccgcggggccgtggcacctgggaaaactcgagctggattttgacctttgcgaaggcactacagtagtcgtggatgagcactgcgggaacagaggaccctccttgaggaccacgactgtgaccggcaagatcatacatgaatggtgttgccgcagttgtacactgcctccattacggttcaaaggtgaggacgggtgctggtacggaatggagattagacccgtcaaggaaaaggaggaaaatctcgttaaaagcatggtgtctgccggctccggtgaggtagactcatttagtctgggccttctgtgtatcagcatcatgattgaagaggtgatgaggtcgcgctggtcccgaaagatgttgatgaccgggactctcgctgtcttcctgctactgatcatgggacagctcacatggaacgatctgattcggctttgcataatggtgggcgccaatgcatctgaccgtatggggatgggaaccacatatttggctctgatggccacttttaaaatgagacctatgttcgcagttggcttactctttaggcgcctgaccagccgggaggtgcttctgctaacgatcggtctctcactggtcgccagtgtggaattgccaaactccctggaggaattaggggatggactcgctatgggcattatgatcctgaaacttctgacagacttccaatctcaccagttgtgggcgaccctcctgagcctaacttttattaaaaccacactgtcccttcattacgcctggaagactatggcaatggttctctcaatcgtgagcctgatacccttgtgtctgagtaccacgtctcagaagacaacctggttaccggtcctcctgggctcccttgggtgcaaacctctgactatgttcttgatcgctgagaataagatttggggaagaaaaagctggccactcaacgaaggtatcatggccgtaggcgtggtttcgattctgctatcatctctgcttaagaacgatgtgcccctcgccgggcctctgatcgctggaggcatgttgatagcatgttatgtcattagtggttccagcgccgacttatctctggagaaagcggctgaggtgagctgggaagaggaagccgagcactccggggcatcacataatatcctcgtagaagtgcaggatgacggaacaatgaagatcaaagatgaggagagggacgataccctgactattcttctgaaggccacattgctagctgtcagtggcgtttaccccctgagcataccagcaaccctctttgtgtggtatttctggcaaaagaaaaagcagcgatctggcgtgctgtgggacacgccttcacccccagaagtcgagcgcgccgtgcttgatgacgggatctaccggattatgcagagaggattactgggtaggagccaggttggcgtaggggtgtttcaagaaaacgtcttccacactatgtggcacgtgacccgtggagcggttctcatgtatcagggcaaacgcttggagccgagttgggctagcgtgaagaaagacctgatctcctacggtgggggatggcggctccagggctcttggaatacaggcgaggaagtccaggtgattgccgtagagcctgggaagaaccccaagaatgtccaaaccgcaccaggaacattcaaaactcccgaaggtgaggtgggcgccatcgctctggattttaagcctgggacctcgggaagcccaatagttaacagagaaggcaaaatcgtgggtctttacgggaatggagtcgtgacgacatcaggcacttatgtttccgccattgcacaggctaaggccagtcaggagggccccctgcctgagatcgaagacgaggtgttcaggaaacgaaacttgaccattatggatctacatccggggtctggaaagacacggcgctacctgccagcgatcgtcagagaagccataaagaggaaactccggaccttaattctggcacccactcgagtggtagctagcgagatggccgaagctcttaagggtatgcctatcagatatcaaaccacagcagtgaaatccgagcacacgggcaaggagatcgttgacctgatgtgccatgccacttttaccatgcgcctcttgtcaccagtcagggtgcccaattacaacatgattatcatggatgaagcccacttcacagacccttctagcatagctgcgcgtgggtatattagtacccgggtgggaatgggcgaggcagccgctatctttatgactgccacaccgcccggttccgtcgaagcattcccacagagcaatgccgtaattcaggatgaggaaagagacatccctgagaggtcttggaactcagggtacgagtggataaccgattttcccggaaaaacggtgtggttcgttccatccattaagagtggcaatgacatcgctaactgtctgcgcaagaatggcaaacgagtgatccagctcagcagaaagacttttgatacagaatatcagaagaccaagaacaacgactgggactacgtcgtgaccactgatatttcggagatgggggcgaatttccgggccgacagggttatcgatcctcgccgttgcctgaaacccgtgattcttaaggacggaccagaaagagtcatactagcaggtccgatgcctgtgacagtagcttctgccgcacagcggaggggccgcatcgggcgaaaccataataaggagggagatcagtacatttatatgggccagcccctgaacaatgacgaggatcacgcccactggaccgaagctaaaatgttgttagacaacatcaatacaccagagggtatcattcccgccctgtttgaacctgagagagaaaagtccgcggcaatagatggggagtaccggctcaggggcgaggcccgcaaaactttcgtggaactgatgagaaggggagaccttccagtttggctgagctataaggtcgcttcagagggcttccaatacagtgatcggcgttggtgctttgacggggaacgcaacaatcaggtgctcgaggaaaacatggatgtggagatctggacgaaagagggagaacgaaagaaattgagacccaggtggctggacgcccggacctattctgaccctctagctctgcgcgagttcaaggaatttgcagccggtagaaggtccgtcagcggcgatctcattcttgagatcgggaagctgccgcagcatttaacacagcgggctcaaaatgccttggacaacctggttatgctccacaattcagaacagggaggccgagcatacagacatgcgatggaggagctgccagatactattgaaacccttatgctgctcgccttgatcgctgtgctgacaggtggggtaaccttattctttctaagtggccgcggactgggcaaaactagcatagggctcctttgtgtgatggcctcctctgtcctgttgtggatggcaagcgtggagccccactggatcgctgcctccattatcctggagttctttctcatggttctgcttattcctgagcccgacaggcagcggacgccacaggataaccaactcgcatatgtggtcatcggactgttgttcatgatactgaccgtagccgctaatgagatgggtttactagaaacaactaagaaagacctgggcattgggcacgtggcggttgagaaccatcaccatgccaccatgctcgatgtggaccttcaccctgcatcagcttggacactgtacgccgtcgccaccactatcattacacccatgatgcgtcatacgatcgaaaacaccactgcaaatatatctttgacagctatcgccaaccaggcggctattctgatgggactcgataagggctggccaatcagtaaaatggacattggtgtgcctctgcttgccttagggtgctactcgcaggtcaatccgctgaccctcaccgcagccgtgttgatgctggttgctcactatgcaatcataggccccggactacaagccaaggcgacaagagaggctcagaagaggactgccgcaggcattatgaaaaacccaacggtggatgggatcgtagccatcgacctggatcctgtggtctacgacgctaagtttgaaaaacagctcggacagattatgcttctgatcttgtgtaccagccaaatactgctcatgcgcacaacttgggccctgtgcgagtccattaccttagcaacaggcccccttaccactctgtgggagggttctccagggaagttctggaatacgacaatcgctgtttcaatggccaacatttttcggggaagctatctcgcgggcgccggtctagcattctccctgatgaaaagtttgggcgggggacgaagaggcaccggggctcagggagaaactctgggcgagaagtggaagaggcagctcaatcagctttctaaaagcgaatttaacatctacaagcgctcaggtataatggaggtggaccggtccgaagccaaagaggggctgaagagaggagagaccacacgtcacgcagtcagtaggggcactgctaaattgcggtggttcgtggaacgcaatctggtaaagcctgagggtaaggtgatcgatctcggctgtgggcgaggaggctggagctattactgcgccgggctaaagaaggttaccgaagtgaaaggatatacaaagggcggtcccgggcatgaggaaccgattccaatggccacgtacggatggaacctggtcaaacttcactctggcaaggacgtgttctttacccctcccgagaaatgtgatactctgctatgcgacatcggcgagtcctcaccaaatcccacaattgaagaggggagaaccctcagggtcctgaagatggtggaaccttggttgcggggaaaccaattctgtatcaagattctgaatccgtacatgcccagcgttgtagagactctcgagcagatgcagcgcaaacatggtggcatgcttgtgagaaacccactgtcgagaaattctacacacgaaatgtattgggtcagttgcgggaccggaaacatcgtgtccgcggttaatatgacgagccgaatgttactgaaccggtttaccatggctcaccgtaagcctacatacgagaaagatgtggacttgggcgcaggtactagacatgtcgccgtggaacccgaggtagctaacctcgatataattgggcagcgcatcgaaaatatcaagcacgagcataaatcaacctggcactatgacgaggataacccttacaagacatgggcctatcatggatcctacgaagtgaagccatctggcagcgcaagttccatggttaatggcgtcgtgaaactgctaactaagccctgggacgtgattcctatggtcacccaaatagccatgacagataccactccattcgggcagcagagggtttttaaagagaaggtggacacgcggacacccaaagctaagagaggaaccgtacaaatcatggaagtgactgcgcgctggctttggggtttcctgagcaggaacaagaaaccgcgaatttgtacccgggaggaatttacaagaaaggtcaggtctaatgccgcaatcggcgctgtgttcgttgacgagaaccagtggaactcagccaaagaggcagtggaagatgagcgcttttgggacctcgtccagaaggaacgtgagctgcacaaacaggggaagtgcgccacgtgcgtgtataacatgatgggaaagcgggagaaaaagttgggcgagttcggtaaagctaaggggagtagagccatttggtacatgtggctgggagcgaggtttctcgagttcgaagcacttggctttatgaatgaggatcactggttctcccgcgaaaacagcctgtctggcgtagagggggagggattacataaactgggttacatcttgcgagacatatcgaagatccctggcgggaatatgtatgccgatgacaccgctggatgggatactcggattacagaagacgatctccaaaacgaggccaaaatcaccgacattatggaaccagagcacgcactgctagctacttcaatcttcaaacttacataccagaataaggttgtgagagtccagaggcccgccaaaaacggcaccgtgatggatgtgataagccgcagagaccagcggggttccgggcaagtcggaacatatggcctgaatacttttaccaacatggaagctcagctcattaggcagatggagagtgagggcatcttcctgccttctgaattggagacgccaaacttagccgaacgtgttctggattggctcgagaagtacggggtggaacgacttaaacgcatggcaatcagcggagacgactgtgtagtgaagcccattgatgacagatttgcgaccgccctgacagctctaaatgatatgggtaaagtccggaaggacataccgcagtgggagccttccaagggctggaacgattggcaacaggtgcccttctgctcacatcactttcaccagctgatcatgaaagacgggagggagattgttgtgccatgtcgcaatcaggatgaactcgtcggaagggcacgggtgagtcaaggcgcaggttggtctttgagggagactgcttgcctgggaaagagctatgcccagatgtggcagcttatgtacttccatcgacgtgacctgagactcgcagccaacgcgatctgttccgctgtacctgttgattgggtgcccacctcacgcacaacttggagcattcacgcccatcaccaatggatgaccacggaagacatgttatctgtctggaatcgggtgtggatcgaggaaaacccatggatggaggataaaacacatgtttccagttggggagacgtgccctatctgggcaagagggaggaccagtggtgcggcagcttgatagggctgaccgcaagagccacttgggcttcgaatatccaggtcgccattaaccaggtgcgccggctcatcggaaatgaaaactaccttgattacatgacatccatgaaaaggtttaagaatgagggtgaccctgaaggcgcactgtggtga

SEQ ID NO: 13865 - RNA, 9879 nt, synthetic construct
  misc_feature 1..9879: note = derived and/or modified CDS sequence (opt3) from DENV-1__FJ898426__SS-prME
  source 1..9879: mol_type = other RNA
agcgtgaccatgctgctaatgcttatgcccaccgcactggctttccacttgactacgcgaggcggggaacctcatatgatcgtctccaagcaggaaagggggaaatctttactgtttaagacctcagccggtgttaacatgtgcaccctaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagggatttcgtggagggtctgagtggcgcgacttgggtagacgttgtgcttgagcacgggtcctgtgtcacaaccatggcaaaggataaacccactttggacatcgaactgctaaagacagaggtggccaaccctgctgtgctcaggaaactgtgcattgaagccaagatctctaataccacgaccgatagccggtgtccaacacaaggagaggcaactcttgtcgaagaacaagacgctaactttgtttgccgccgaaccttcgtggatagaggctggggtaatgggtgtggactgtttggcaaaggctccttgataacatgcgccaagttcaagtgcgtaactaaactcgaggggaagattgtgcagtacgaaaacctgaaatattcagtcatcgtgaccgttcacacaggagaccagcatcaagtgggtaatgagagtaccgaacacggcactacggcgacaattacaccccaggcccctagcactgagatccagttaaccgactacggggcactgacactcgattgttctccaaggaccggacttgactttaacgaaatggtcctgttgactatgaaggagaaatcctggctagtgcataagcagtggttcctggatctcccgctgccctggacatcaggcgctagcacgagtcaagagacctggaatcggaaagaccttctggtaacttttaagacagcccacgctaagaaacaggaagttgtggtcttgggttctcaggagggggccatgcacaccgcactcacaggcgccactgaaatccaaacctccggaacgaccacaattttcgctggccatctgaagtgccgtttaaaaatggataagctgactctaaaagggatgagctatgtgatgtgtaccggatcgttcaagctcgagaaggaagtcgcggagacacagcacggtactgtgctggttcagataaaatacgagggcaccgacgcaccttgcaagatcccattttctacgcaggatgaaaaaggggtgacacaaaacggacgccttattaccgccaatcccatcgtaactgacaaggagaaacctgtcaacatagaagctgagccacccttcggcgagtcctatattgtgatcggtgccggggaaaaggcattgaagctgtcatggtttaaaaagggcagtagcatcggaaaaatgttcgaggccacagctagaggcgccaggcggatggcaattctcggggataccgcgtgggactttggatccatcggtggcgttttcacttctgtggggaagctggtccatcagatttttggaaccgcttacggcgtgcttttcagcggtgtatcatggacaatgaaaatagggatcggcgtgctgttgacgtggctcggactgaatagtcgatccaccagcttatctatgacttgtattgccgttggcctggtcacactatacctcggggtgatggtgcaggcagattcaggatgcgtcatcaactggaagggccgcgaactgaagtgtggtagtgggatctttgttaccaatgaggtgcacacatggactgaacagtataaattccaagccgacagcccgaagagactttccgctgccattggaaaagcatgggaggagggcgtgtgcggtataaggtctgctacccggttggaaaacatcatgtggaagcagatttcgaacgagctgaatcatatcctcctggaaaacgacatgaaatttacggtagtcgtgggcgatgttgccgggattttagcgcagggaaagaaaatgatccgccctcagcccatggagtacaagtatagctggaagtcctggggcaaagccaagataatcggggctgacgtgcaaaatacaaccttcattatcgatggaccaaacactcctgaatgtcccgacgatcagagagcatggaatatttgggaggtcgaggactacggctttggtatcttcaccacaaacatatggctgaaacttagggattcatatactcaggtgtgcgaccaccgtttgatgagtgccgctattaaggattctaaagccgttcacgcagacatggggtactggatcgaaagcgagaagaatgaaacctggaagctcgcgcgggcctccttcattgaggtgaaaacatgtatctggccaaagtcacatacgctgtggagcaacggagtactagaatctgagatgataatccccaaaatttatggcggtcctatctcccagcacaattaccgaccaggctactttacccaaactgctgggccgtggcatctgggaaagctcgagctggatttcgacctttgcgaaggcacaaccgtcgtggtggatgagcactgcgggaacagaggacccagtttgaggactacaaccgtcacgggcaaaattatccacgaatggtgttgccgcagctgtactctgcctccattacggtttaagggtgaggacgggtgctggtatggaatggagataagacccgttaaggaaaaagaggaaaatctcgtgaagtctatggtatccgccggctcaggtgaggtggacagtttcagcctgggccttctgtgtatttcgatcatgatcgaagaggtcatgaggtcccgctggtctcgaaaaatgttgatgaccgggacactcgcagtgtttttcctgctaattatgggacagctgacctggaacgatctcatccggctgtgcattatggttggcgctaatgccagcgaccgtatggggatgggaactacataccttgcattgatggccacctttaagatgagacctatgttcgctgtgggcctgttatttaggcgcctcacatcacgggaggtcctgcttctgactataggtctaagtctcgtggcgtccgttgaactgccaaactctttggaggaactgggggatggattagccatgggcatcatgattctcaaactgcttaccgacttccagagccatcaactgtgggcaacgttgctctccctgacatttatcaagaccactttctcactacactatgcttggaagaccatggccatggtgctgagcattgtcagtctttttcccctctgtctgtctacaacttcccagaaaaccacgtggttgccggtactgttaggcagcctcgggtgcaagcctctgacaatgttccttatcgccgagaataaaatatggggaagaaagtcgtggccactgaacgaaggtatcatggctgtgggcattgtttcaatcttgctctctagtctgctcaagaatgatgtgcccctggcagggcctcttattgccggaggcatgctcatcgcgtgttacgtcatatccggtagctctgctgacctgagcttggagaaggccgcagaggtgtcctgggaagaggaagccgagcattcaggggctagtcacaatattttagtagaagtgcaggatgacggaaccatgaaaatcaaggatgaggagagggacgatactctgacaatcctcctgaaggcaacccttctggccgtcagcggcgtttatcccttgtctattccagcgactctattcgtgtggtacttttggcagaaaaagaaacaacgatccggcgtgctgtgggacacaccttcacccccagaagtcgagcgcgctgtgctcgatgacgggatatatcggatcatgcagagaggactgcttggtaggagtcaggttggcgtaggggtgttccaggaaaacgtctttcataccatgtggcacgtgacgcgtggagccgttttaatgtaccaaggcaagcgcctggagccgagctgggcatccgtgaaaaaggacctcatttcttacggtgggggatggcggttgcagggctcgtggaatactggcgaggaagtccaggtgatcgccgtagagcctgggaagaaccccaaaaatgtccagaccgctccaggaacattcaagaccagcgaaggtgaggtgggcgccattgcactggattttaaacccgggacatcaggatcccctatcgttaacagagaaggcaagatagtgggtctctatgggaatggagtcgtgactaccagtggcacgtacgtttctgctatcgcccaagcgaaagccagccaggagggcccactgcccgagattgaagacgaggtgttcaggaagcgaaaccttacaatcatggatctgcaccctgggtccggaaagactcggcgctatttgccggcaattgtcagagaagctatcaaaaggaagctacggaccctgatactcgccccaacacgagtggtagcttcagagatggcagaagccttaaaaggtatgcccattagataccagaccactgccgtgaagtctgagcataccggcaaagagatcgttgacctgatgtgccacgctacatttacgatgcgccttctgagccctgtcagggtgccaaattataacatgatcattatggatgaagcgcatttcactgaccccagttccatcgcagcccgtgggtacataagcacccgggtgggaatgggcgaggctgccgcaatttttatgacagccacccctccgggttctgtcgaggctttcccccaatcaaatgcggtaatccaggatgaggaaagagacattccagagaggtcctggaacagtgggtatgagtggatcactgattttcctggaaagacagtgtggttcgttcccagcataaagtcgggcaatgacattgccaactgtctccgcaaaaatggcaagcgagtgatccagttgtctagaaaaaccttcgatacggaataccagaagactaaaaacaacgactgggactacgtcgtgacaaccgatatctccgagatgggggcaaattttcgggctgacagggttattgatccacgccgttgcctgaagcctgtgatcctcaaggacggacccgaaagagtcattctggccggtccaatgccggtgaccgtagcaagcgccgctcaacggaggggccgcatagggcgaaaccacaataaagagggagatcagtatatctacatgggccagcctcttaacaatgacgaggatcatgcccactggactgaagcgaagatgctactggacaacattaatacacccgagggtatcatcccagcattgttcgaacccgagagagaaaaatcagccgctattgatggggagtatcggttaaggggcgaggcccgcaagacctttgtggaactgatgagaaggggagacctccctgtttggctgagttacaaagtcgcttctgagggcttccagtattccgatcggcgttggtgctttgacggggaacgcaacaatcaagtgcttgaggaaaacatggatgtggagatatggacaaaggagggagaaagaaagaagctgagaccaaggtggctcgacgcacggacttacagcgaccccttggccctgcgcgagttcaaggaatttgctgccggtagaaggtcagtcagtggcgatctaatcctggagattgggaaactccctcagcaccttacgcagcgggcacagaatgcgctggacaacttagttatgttgcataatagcgaacaaggaggccgagcctatagacacgctatggaggagctgccggataccatcgaaacactcatgctgcttgccctgattgcagtgctcactggtggggtaaccttgttctttctgtccggccgcggattaggcaagacatctatcgggctactgtgtgtgatggctagctccgtcctcctttggatggcctcagtggagccacattggatagcagcctctatcattctggagttctttttgatggttctgctcatccccgagcctgacaggcagcggacaccccaggataaccagctggcttacgtggtcattggacttctcttcatgatcctgactgtagcggccaatgagatgggtttgctggaaacgaccaaaaaggacttaggcatagggcacgtggcagttgagaaccaccatcacgctgccatgctagatgtggacctgcatccagccagtgcatggacactctacgctgtcgccactaccattatcacacctatgatgcgtcacaccattgaaaacactacagcgaatatctcgcttacggctatagccaaccaagcagccatcctgatgggattggataaaggctggcccattagcaagatggacatcggtgtgccactgctcgctctggggtgctattcccaggtcaatcctcttaccttaactgcagccgtgctgatgctcgttgcgcattacgctattatcggcccgggattgcaggccaaggcaacaagagaggcccagaaaaggaccgctgccggcataatgaagaaccccaccgtggatgggattgtagcaatcgacctggatccagtggtctatgacgctaaatttgaaaagcagctaggacagatcatgctgctcattctttgtacatctcagatcctgttgatgcgcactacgtgggccctgtgcgagtcaataaccctcgcgacaggccctctgactaccttatgggagggtagccccgggaaattctggaatacaaccattgccgtttccatggcaaacatcttccggggaagttaccttgctggcgccggtctggcattttctctcatgaaaagcctaggcgggggacgaagaggcactggggctcaaggagaaacgctgggcgagaagtggaaaaggcagttgaatcagctgtcaaagtccgagttcaacacatataaacgcagtggtattatggaggtggaccggagcgaagccaaggaggggctcaaaagaggagagaccactaagcacgccgtctctcgtggcaccgcgaaacttaggtggtttgtggaacggaatctggtaaaaccagagggtaaggtgatcgatttgggctgtgggcgcggaggctggtcctactattgcgctgggctgaaaaaggttacagaagtgaaaggatacactaagggcggtcctgggcacgaggaacccataccgatggcaacctacggatggaacctcgtcaaattacattcaggcaaggacgtgttctttatcccacctgagaagtgtgatacactgctttgcgacattggcgagagctcgcccaatccaacgatcgaagaggggcgaaccctgagagtcctaaaaatggtggaaccctggctcaggggaaaccagttctgtattaagatcctgaatccttatatgccgtctgttgtagagactttggagcaaatgcagcggcgccacggtggcatgctggtgagaaaccccctcagtagaaattccacacatgaaatgtactgggtcagctgcgggaccggaaacattgtgtcagccgttaatatgacttcccgaatgcttctgaaccggtttacaatggctcaccgtaaaccaacctatgagagagatgtggacttaggcgccggtacgcgccacgtcgcagtggaacctgaggtagccaacctggatatcatagggcagaggattgaaaatatcaagcatgagcacaaatctacctggcattacgacgaggataacccctataagacatgggcttaccacggaagctatgaagtgaagcctagtggctccgcgagctctatggttaatggcgtcgtgaaattgctcactaagccatgggacgtgatccccatggtcacccagattgccatgacagatactacccctttcgggcaacagcgggtttttaaagagaaggtggacacaagaaccccaaaagcaaagcgcggaactgctcagataatggaagtaacggccaagtggctgtggggtttcctatcaaggaacaaaaagccccgaatctgtacacgggaggaatttaccagaaaagtgaggagtaatgcagccattggcgctgtcttcgtggacgagaaccaatggaactccgccaaggaggcggttgaagatgagcgcttttgggaccttgtgcatcgtgaacgggagctgcacaaacaggggaagtgcgcaacttgcgtctacaacatgatgggaaagagagagaaaaagctcggcgagttcggtaaagccaaggggagcagggctatctggtacatgtggctgggagcccgcttcttggagtttgaagcactgggcttcatgaatgaggatcactggttttctcgagaaaactcgctctcaggcgtggagggggagggacttcataaactgggttatattttacgggacatcagcaagataccgggcgggaatatgtacgctgatgacaccgccggatgggatacaagaatcacggaagacgatctgcagaacgaggctaaaattaccgacatcatggaacctgagcacgccttgctcgcaaagtccattttcaagctgacttatcagaataaagtagttagggtgcaacgcccagcgaagaacggcacagtcatggatgtgatcagtagacgggaccagaggggttctggacaggtgggaacctacggcctaaatacttttacaaacatggaagcccagcttatacgtcaaatggagagcgagggcattttctccccctcagaactggagacccctaacctcgctgggcgagtcctggattggttggaaaaacatggagttgagcgcttaaagagaatggccatcagtggtgacgactgtgtggtaaaaccaatcgatgaccggtttgcaacagctctgactgccctcaatgatatgggcaaggtgaggaaggacattccccagtgggaaccgtctaaagggtggaacgattggcagcaggtccctttctgcagccaccactttcatcaacttataatgaaggacggacgcgagatcgtggttccctgtagaaatcaggatgagctggtgggccgggcaagggtctcccagggtgccgggtggtcactacgagaaaccgcgtgcctgggaaaaagctatgctcagatgtggcaactcatgtacttccaccgtagagacttgcgcctggccgcaaacgccatttgttctgctgtgccagtagattgggttcctacgtcccggaccacatggagtatccatgcccaccatcagtggatgactaccgaggacatgcttagcgtgtggaatagggtctggattgaagagaacccctggatggaagataagacacacatctcgtcctggggcgacgtgccatatctgggcaaaagagaggaccagtggtgcgggtctctcataggattaactgcacgcgctacctgggccacgaatatccaagttgcgattaaccaggtgcggaggctgatcggtaatgagaactacttggattacatgacatcaatgaagcgatttaagaatgaaagcgaccccgagggcgctctgtggtga

SEQ ID NO: 13866 - RNA, 9879 nt, synthetic construct
  misc_feature 1..9879: note = derived and/or modified CDS sequence (opt3) from DENV-1__GQ199856__SS-prME
  source 1..9879: mol_type = other RNA
agcgtgaccatgctgctcatgcttatgcccacagcactggctttccacttgactacgagaggcggggaacctcatatgatcgtctccaagcaggaaaggggaaaatctttactgtttaagacctcagccggtgttaacatgtgcaccctagtggccatggacctcggcgagttctgtgaagatactatgacctacaaatgcccacggattacagaagcggaaccggacgatgtagactgttggtgcaatgctaccgatacttgggtgacatatgggacctgtagtcagacgggagaacaccgccgagacaagcgtagcgtcgccctggcaccccatgtgggccttggtctggagactagaaccgaaacatggatgtcctctgagggggcctggaaacagatacagagggttgaaacttgggctttgcggcaccctggatttaccgtgatcgcactcttcctggcccatgctattggcacatcgatcacccagaagggcattatctttatactgctcatgttagtcacgccatcaatggccatgcgctgcgtggggatcggaagcagagatttcgttgagggtctgagtggcgcgacttgggttgacgtggtccttgagcacgggtcctgtgtgacaaccatggcaaaggataaacccactttggacattgaactgctaaagacagaggtgaccaaccctgccgtcctcaggaaactgtgcatcgaagctaagatttctaatacgaccacagatagccggtgtccaactcaaggagaggccacccttgttgaagaacaggacgcaaactttgtgtgccgccgaacattcgtagatagaggctggggtaatgggtgtggactgtttggcaaaggctccttgatcacttgcgctaagttcaagtgcgtgaccaaactcgaggggaagacagtccagtacgaaaacctgaaatattcagtgatagttaccgtgcacactggagaccagcatcaagtcggtaatgagagtacggaacacggcacaaccgccactattacaccccaggcgcctagcacagagatccagttaaccgactacggggccctgactctcgattgttctccaaggacaggacttgactttaacgaaatggtgctgttgacgatgaaggagaaatcctggctagtacataagcagtggttcctggatctcccgctgccctggacctcaggcgcaagcacaagtcaagagacatggaatcggaaagaccttctggttacctttaagacagctcacgccaagaaacaggaagtggtcgtgttgggttctcaggagggggctatgcacactgccctcaccggcgcaacggaaattcaaacctccggaacaactaccatcttcgccggccatctgaagtgccgtttaaaaatggataagctgacactaaaagggatgagctatgtcatgtgtactggatcgttcaagctcgagaaggaagtggctgagacccagcacggtacggttctggtgcagatcaaatacgagggcacagacgcgccttgcaagattccattttctacccaggatgaaaaaggggtaactcaaaacggacgccttataacagcaaatcccatcgtcaccgacaaggagaaacctgtgaacattgaagccgagccacccttcggcgagtcctatatcgttataggtgctggggaaaaggccttgaagctgtcatggtttaaaaagggcagtagcattggaaaaatgttcgaggcaactgccagaggcgctaggcggatggccatcctcggggataccgcatgggactttggatccatcggtggcgtgttcacatctgtcgggaagctggtgcatcagatttttggaacggcgtacggcgtacttttcagcggtgtgtcatggaccatgaaaatcgggattggcgttctgttgacttggctcggactgaatagtcgatccactagcttatctatgacctgtatagctgtcggcctggtgacactatacctcggggtgatggtccaggccgattcaggatgcgttatcaactggaagggccgcgaactgaagtgtggtagtgggatttttgtgactaatgaggtgcacacctggacggaacagtataaattccaagcagacagcccgaagagactttccgccgctatcggaaaagcctgggaggagggcgtatgcggtatcaggtctgcaacacggttggaaaacattatgtggaagcagatatcgaacgagctgaatcatatcctcctggaaaacgacatgaaatttaccgtcgtggttggcgatgtggctgggattttagcccagggaaagaaaatgatccgccctcagcccatggagtacaagtatagctggaagtcctggggcaaagcgaagattatcggggccgacgtccaaaatactaccttcataatcgatggaccaaacacacctgaatgtcccgacgatcagagagcttggaatatttgggaggtggaggactacggctttggtatcttcactaccaacatttggctgaaacttagggattcatatacacaggtttgcgaccaccgtttgatgagtgcagccatcaaggattctaaagctgtgcacgccgacatggggtactggatagaaagcgagaagaatgaaacgtggaagctcgcacgggcgtccttcattgaggtaaaaacctgtatctggccaaagtcacatactctgtggagcaacggagtcctagaatctgagatgattatccccaaaatatatggcggtcctatctcccagcacaattaccgaccaggctactttacacaaaccgccgggccgtggcatctgggaaagctcgagctggatttcgacctttgcgaaggcactacagtggtggtcgatgagcactgcgggaacagaggacccagtttgaggaccacgactgttaccggcaaaattatccacgaatggtgttgccgcagctgtacactgcctccattacggtttaagggtgaggacgggtgctggtatggaatggagattagacccgtgaaggaaaaagaggaaaatctcgtaaagtctatggtgtccgctggctcaggtgaggtcgacagtttcagcctgggccttctgtgtatctcgataatgattgaagaggtgatgaggtcccgctggtctcgaaaaatgttgatgaccgggactctcgccgtatttttcctgctaatcatcggacagctgacatggaacgatctcattcggctgtgcatcatggtgggcgcaaatgctagcgaccgtatggggatgggaaccacataccttgccttgatggcaacttttaagatgagacctatgttcgccgtcggcctgttatttaggcgcctcacctcacgggaggtgctgcttctgacgattggtctaagtctcgttgcttccgtggaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtcctgagcatcgtaagtctttttcccctctgtctgtctaccacgtcccagaaaacaacctggttgccggtgctgttaggcagcctcgggtgcaagcctctgactatgttccttattgccgagaataaaatctggggaagaaggtcgtggccactgaacgaaggtataatggccgttggcatcgtgtcaattttgctctctagtctgctaaagaacgatgtccccctggctgggcctcttatcgcaggaggcatgctcattgcctgttacgtgatctccggtagctctgcggacctgagcttggagaaagctgccgaggtatcctgggaagaggaagcagagcattcaggggccagtcacaatatattagtggaagtccaggatgacggaacaatgaagattaaagatgaggagcgagacgataccctgactatcctcctgaaggctacacttctggcagttagcggcgtgtatcccttgtctatcccagccaccctattcgtgtggtacttttggcagaagaaaaagcaacgctccggcgtcctgtgggacacgccttcacccccagaagtggagcgggcggttctcgatgacgggatttatagaataatgcagaggggactgcttggtcgtagtcaggtaggcgtgggggtcttccaggaaaacgtgtttcatactatgtggcacgttacccgcggagctgtgttaatgtaccaaggcaaacggctggagccgagctgggcctccgtcaagaaagacctcatctcttacggtgggggatggagattgcagggctcgtggaatacaggcgaggaagtgcaggtaattgcagtcgagcctgggaagaaccccaagaatgtgcagaccgccccaggaacattcaaaactagcgaaggtgaggttggcgctatcgccctggattttaagcccgggacctcaggatcccctattgtgaacagggaaggcaaaatcgtcggtctctatgggaatggagtggttacgacaagtggcacttacgtgtctgcaatagctcaagccaaggcgagccaggagggcccactgcccgagatcgaagacgaggtcttccgaaaacggaaccttaccattatggatctgcaccctgggtccggaaagacacgcagatatttgccggccatcgtgagggaagcaattaagcggaaactacgaaccctgatcctcgctccaactagagtagtggcctcagagatggctgaagcattaaagggtatgcccatacgctaccagaccacagccgttaaatctgagcatacgggcaaggagattgtcgacctgatgtgccacgccacttttaccatgaggcttctgagccctgtgcgtgtgccaaattataacatgatcatcatggatgaagctcatttcacagaccccagttccattgcggcacgggggtacatcagcaccagagtcggaatgggcgaggccgctgccatatttatgactgcaacacctccgggttctgtagaagccttcccccaatcaaatgctgtgattcaggatgaggaaagggacatcccagagcgctcctggaacagtgggtatgagtggattaccgattttcctggaaaaacggtttggttcgtgcccagcatcaagtcgggcaatgacatagcgaactgtctccgaaagaatggcaaaagagtcattcagttgtctcggaagactttcgatacagaataccagaaaaccaagaacaacgactgggactacgtggttaccactgatatctccgagatgggggccaattttagggcagaccgcgtgatcgatccacgtagatgcctgaaacctgtcattctcaaggacggacccgaacgggtgatcctggctggtccaatgccggtaacagtggccagcgcagcccaaaggcgcggccgaattgggagaaaccacaataaggagggagatcagtatatatacatgggccagcctcttaacaatgacgaggatcatgctcactggaccgaagccaaaatgctactggacaacatcaatacacccgagggtattatcccagcgttgttcgaacccgagcgggaaaagtcagcagccatcgatggggagtataggttacgcggcgaggctagaaaaacttttgttgaactgatgaggcggggagacctccctgtctggctgagttacaaggtggcctctgagggcttccagtattccgatcgtcgctggtgctttgacggggaacgaaacaatcaagtgcttgaggaaaacatggatgtcgagatttggacgaaagagggagaaagaaagaaactgaggccacggtggctcgacgctcgcacctacagcgaccccttggcactgagagagttcaaggaatttgccgctggtaggcggtcagttagtggcgatctaatactggagatcgggaagctccctcagcaccttacacagcgagcccagaatgcactggacaacttagtgatgttgcataatagcgaacaaggaggcagagcgtatcgccacgccatggaggagctgccggatactattgaaaccctcatgctgcttgctctgatcgccgtactcacaggtggggtgaccttgttctttctgtccggcaggggattaggcaaaacttctattgggctactgtgtgtcatggcaagctccgtgctcctttggatggcttcagttgagccacattggatcgccgcatctataatcctggagttctttttgatggtgctgctcattcccgagcctgaccggcagcgtacgccccaggataaccagctggcctacgtcgtaatcggacttctcttcatgattctgaccgtggctgcgaatgagatgggtttgctggaaacaactaagaaagacttaggcatcgggcacgttgccgtggagaaccaccatcacgcagctatgctagatgtcgacctgcatccagccagtgcctggaccctctacgcagtggctacaaccataattactcctatgatgagacacacaatcgaaaacacgaccgccaatatttcgcttactgcgatcgctaaccaagccgcaatactgatgggattggataagggctggcccatcagcaaaatggacattggtgtcccactgctcgccctggggtgctattcccaggtgaatcctcttacattaaccgctgcagttctgatgctcgtggcccattacgcgatcattggcccgggattgcaggctaaggccaccagggaggcacaaaagcgcacagccgctggcatcatgaaaaaccccactgtagatgggatagtggccattgacctggatccagtcgtttatgacgcaaagtttgaaaaacagctaggacagatcatgctgctcatcctttgtacgtctcagattctgttgatgcggaccacatgggctctgtgcgagtcaatcactctcgccaccggccctctgacaaccttatgggagggtagccccgggaagttctggaatactacgatagcggtgtccatggccaacattttccgaggaagttaccttgcaggcgctggtctggccttttctctcatgaaaagcctaggcgggggaagaaggggcacaggggcacaaggagaaaccctgggcgagaagtggaagcgccagttgaatcagctgtcaaaatccgagttcaacacttataagcggagtggtatcatggaggtcgacagaagcgaagctaaagaggggctcaagcgtggagagaccacaaaacacgccgtgtctaggggcactgccaaacttcggtggtttgtagaacgcaatttcgtgaagccagagggtaaagttattgatctgggctgtgggcgaggaggctggtcctactattgcgcggggttgaagaaagtgaccgaagtcaagggatacacaaaaggcggtcctgggcacgaggaacccatcccgatggctacgtacggatggaacctggtgaagctccattcaggcaaagacgtctttttcataccacctgagaagtgtgataccttactgtgcgacatcggcgagagctcgcccaatccaactattgaagaggggagaacacttagggtgctgaagatggttgaaccctggctacggggaaaccagttttgtatcaaaattctcaatccttatatgccgtctgtagtggagaccctggagcgcatgcaaagaaagcacggtggcatgttggtcaggaaccccctgagtcgaaattccactcatgaaatgtactgggtgagctgcgggacaggaaacatcgtttcagcagtgaatatgacctcccggatgctccttaaccgtttcacgatggcccacagaaaaccaacctatgagcgcgatgtcgacctgggcgctggtacaaggcacgtggccgtagaacctgaggtggcaaacttagatattatcgggcagcggatagaaaatattaagcatgagcacaaactgacttggcattacgacgaggataacccctataagacctgggcctaccacggatcttatgaagttaagcctagcggcagtgcttccagcatggtcaatggcgtggtgaaattgctcacaaagccatgggacgtcatccccatggttactcagatcgcgatgaccgatacaaccccttttgggcagcaaagagtgttcaaagagaaggtagacactcgcacgccaaaagccaagaggggaacagcacagattatggaagtgaccgctaagtggctgtggggttttctatctcgaaacaaaaagccccggatatgtactagagaggagttcaccaggaaagtccgctcaaatgccgcaatcggcgccgtgtttgttgacgagaaccagtggaatagtgctaaggaggccgtggaagatgagcgtttctgggaccttgtccatcgggaaagagagctgcacaaacaagggaagtgcgcgacatgcgtgtacaacatgatgggaaagagggagaagaagctcggcgagttcggtaaagcaaaggggtcccgcgccatttggtacatgtggctgggagctcgatttttggagttcgaagccctgggctttatgaatgaggatcactggttcagccgggaaaactctctctcgggcgtagagggggagggacttcataaactgggttatatcttaagagacatttcaaagatcccgggcgggaatatgtacgcagatgacacggctggatgggataccaggataactgaagacgatctgcagaacgaggccaaaatcacagacattatggaacctgagcacgctttgctcgccaagagcatctttaagctgacctatcagaataaagttgtgcgcgtccagagaccagcaaagaacggcactgtgatggatgtgatttcccggagggaccaacgtggtagtgggcaggtcggaacatacggcctaaataccttcacaaacatggaagcgcagcttatccgacagatggagtctgagggcatatttagcccctccgaactggagactcctaacctcgccgggcgcgttctggattggttggaaaaacatggagtggagagattaaagcggatggctatttcaggtgacgactgtgtagtgaaaccaatcgatgacaggttcgccaccgcactgacggctctcaatgatatgggcaaggtccgcaaggacatcccccaatgggaaccgagtaaagggtggaacgattggcaacaggtgcctttttgctctcaccacttccatcagcttattatgaaggacggaagagagatagttgtgccctgtcggaatcaagatgagctggtcggcagggcccgagtgagccagggtgcagggtggtccctacgtgaaaccgcctgcctgggaaaatcatatgcgcagatgtggcagctcatgtactttcacagacgcgacttgcggctggctgccaacgcaatctgtagcgccgtaccagttgattgggtgcctacatctaggactacctggtccattcatgctcaccatcaatggatgacaactgaggacatgcttagtgtctggaatagagtgtggatcgaagagaacccctggatggaagataagacccacattagctcgtggggcgacgttccatatctgggcaaacgcgaggaccagtggtgcgggtccctcatcggattaacggcccgggcaacatgggctaccaatatacaggtggccatcaaccaagtcaggcgactgattggtaatgagaactacttggattacatgacttctatgaagagattcaagaatgaatcagaccccgagggcgcgctgtggtga

SEQ ID NO: 13867 - RNA, 9879 nt, synthetic construct
  misc_feature 1..9879: note = derived and/or modified CDS sequence (opt3) from DENV-1__FJ898427__SS-prME
  source 1..9879: mol_type = other RNA
agcgtgaccatgctgctcatgcttatgcccaccgcactggctttccacttgactacgagaggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattgtgcctggaagactatggcaatggtcctgtcaatcgctagcttgttccccctgtgcttaagtaccacgtctcagaagacaacctggctcccggtactgcttggctccctggggtgtaaacctttgactatgtttctcattacagagaccaagatctggggaagaaaaagctggccactgaatgaaggtataatggccgtgggcgttgtgtcgatcctactgtcatctcttctcaagaacgatgtccccctggccgggcctttgattgctggaggcatgttaatcgcatgctacgtgattagtggttccagcgccgacctgtctctcgagaaagcggctgaggtaagctgggaagaggaagccgagcactccggggcatcacataacatcctggtggtcgttcaggatgacggaactatgaagataaaagatgaagagagggacgatacacttaccattctgttgaaggccacgctactggctgtgagtggcgtgtatcccctcagcatcccagcaactctgttcgtctggtacttttggcaaaagaaaaagcagcgatctggcgtgctttgggacaccccttcacccccagaggttgaacgcgccgtattagatgacgggatctatcggattatgcagagaggactgctcggtaggagccaggtgggcgtcggggtgttccaagagaatgttttccacacaatgtggcacgtgacccgtggagcggtcttgatgtaccagggcaaacgcctggaaccgagttgggctagcgtgaagaaagacctcatatcctatggtgggggatggcggctgcagggctcttggaacacaggcgaggaggtacaggtcatcgccgtggaacctgggaagaatcccaagaacgttcaaactgcaccaggaacctttaaaacgcccgagggtgaagtgggcgccattgctcttgatttcaagcctgggacatcgggaagcccaatcgtcaatagagagggcaaaattgtgggtctgtacgggaacggagttgtgactacctcaggcacatacgtctccgccatcgcacaggctaaggccagtcaggaaggccccttgcctgagatagaggacgaagtgtttaggaaacgaaatctaaccatcatggatctgcatccggggtctggaaagactcggcgctatctcccagcgattgtaagagaggccatcaagaggaaattacggaccctgattcttgcacccacacgagtggttgctagcgaaatggccgaggctctgaagggtatgcctatcagataccaaacgactgcagtcaaatccgaacacaccggcaaggagatagtggacctcatgtgtcatgccacattcaccatgcgcttgctgtcaccagtgagggtccccaactataatatgattatcatggatgaggcccactttactgacccttctagcatcgctgcgcgtgggtacattagtacacgggtaggaatgggcgaagcagccgctatcttcatgaccgccacgccgcccggttccgtggaggcatttccacagagcaacgccgttatacaggatgaagagagagacattcctgaaaggtcttggaactcagggtatgagtggatcactgatttccccggaaaaacagtgtggtttgtcccatccattaagagtggcaacgacatcgctaattgcctccgcaagaacggcaaacgagtgatacagctgagcagaaagaccttcgataccgagtaccagaaaactaagaataacgactgggactatgttgtgacaaccgatatttcggaaatgggggcgaactttcgggccgacagggtcatcgatcctcgccgttgccttaaacccgtgatcctaaaggacggaccagagagagtaattctggcaggtccgatgcctgtgacagttgcttctgccgcacagcggaggggccgcatcgggcgaaatcataacaaggaaggagatcagtacatttacatgggccagcccttgaataacgacgaggatcacgcccactggactgaggctaaaatgttactggacaatataaacacgccagaaggtatcattcccgccctcttcgagcctgaaagagagaagtccgcggcaatcgatggggaatatcggctgaggggcgaggcccgcaaaaccttcgtcgagcttatgagaaggggagacctgccagtgtggctcagctacaaggtggcttcagaaggctttcaatatagtgatcggcgttggtgtttcgacggggagcgcaataaccaggtcttggaagagaatatggatgttgaaatctggacaaaagagggagagcgaaagaaactgagacccaggtggctagacgcccggacttactctgaccctctggctctccgcgaatttaaggagttcgcagccggtagaaggtccgtgagcggcgatcttattctggaaatagggaagttaccgcagcatttgacccagcgggctcaaaacgccctggacaatctcgtaatgctgcacaactcagagcagggaggccgagcatatagacatgcgatggaggaacttccagatacaatcgagaccctgatgctcttggccctgattgctgtgttaactggtggggtcacgctatttttcctgagtggccgcggactcggcaaaaccagcatcgggcttctgtgcgtgatggcctcctctgttttgctgtggatggcaagcgtggaaccccactggattgctgcctccatcatactcgagtttttcctgatggtccttctcatccctgaacccgacaggcagcggacaccacaggataatcaactggcatacgtagtgattggattgctgtttatgatcttaactgttgccgctaacgagatgggtctactggagaccacaaagaaagacctcggcattgggcacgtggcggtcgaaaatcatcaccatgccaccatgcttgatgtggacctgcaccctgcatcagcttggactttgtatgccgtcgccacaacgatcataacccccatgatgcgtcatactattgagaacacaaccgcaaacatctctctgaccgctattgccaatcaggcggctatcctcatgggactggataagggctggccaataagtaaaatggacatcggtgtgcctcttttagccctggggtgttactcgcaggttaacccgctcacattgactgcagccgtgctgatgctagtagctcactacgcaattatcggccccggactgcaagccaaggcgacgagagaagctcagaagaggaccgccgcaggcattatgaaaaatccaacagtggatgggatcgtcgccatagacctcgatcctgttgtgtatgacgctaagttcgagaaacagcttggacagattatgctgttgatcctgtgcactagccaaatcctcctgatgcgcaccacatgggccttatgtgaatccattacccttgcaactggccccctgacgacactctgggagggttctccagggaagttttggaacaccactatcgctgtctcaatggccaatatattccggggaagctacctagcgggcgccggtctggcattttccttgatgaaaagtctgggcgggggacgaagaggcaccggggctcagggagagacactcggcgaaaagtggaagaggcagcttaaccagctgtctaaaagcgagttcaatatttataagcgctcaggtatcatggaagtggaccggtccgaggccaaagaagggttgaagagaggagagactacccgtcacgcagtaagtaggggcacagctaaactgcggtggttcgtggagcgcaacctcgttaagcctgaaggtaaggtgattgatttaggctgcgggcgaggaggctggagctactattgtgccgggctgaaaaaggtcacggaggtgaaaggatacaccaagggcggtcccgggcatgaggagccgatcccaatggccacttatggatggaatcttgtcaaactgcactctggcaaggacgtgtttttcacacctcccgaaaaatgcgataccctactctgtgacataggcgagtcctcaccaaaccccactatcgaggaagggagaacactgagggttttgaagatggtagagccttggctgcggggaaatcaattttgcattaagatcctcaacccgtacatgcccagcgtggtcgaaacccttgagcagatgcagcgcaaacatggtggcatgctggtgagaaatccattatcgaggaactctacgcacgagatgtactgggttagttgtgggaccggaaatattgtgtccgcggtcaacatgacaagccgaatgctgttgaatcggttcactatggctcaccgtaagcctacctatgaaagagatgtggacctcggcgcaggtacacgccatgtagccgtggagcccgaagttgctaacctggatatcattgggcagaggatcgagaacataaaacacgaacataagtcaacttggcactacgacgaggataatccttataaaacctgggcctaccatggatcctatgaggtcaagccatctggcagcgcaagttccatggtgaacggcgtggtcaagctacttacaaaaccctgggacgttattcctatggtgacccaaatcgccatgactgatacgacaccatttgggcagcagcgggtattcaaggaaaaagtggacaccagaactcccaaggctaaacgcggaaccgcgcaaatcatggaggtcacagccaggtggctgtggggttttctcagccgaaataagaagccgcggatttgcacgagagaagagttcaccaggaaagtgcgctctaacgcagctataggcgccgtttttgtggacgaaaatcagtggaactcagcaaaggaggccgtcgaggatgaacgtttctgggacctggtgcagaaagagcgggaattgcacaagcaggggaaatgcgctacttgtgtatacaatatgatgggaaagagagagaagaaactgggcgaatttggtaaggccaaagggagtagggcgatctggtatatgtggctcggagcacgcttccttgagtttgaggccctgggcttcatgaacgaagatcactggttctcccgagagaatagcttatctggcgttgaaggggagggactgcataagttgggttacattctccgggacatctcgaaaattcctggcgggaacatgtacgctgatgacacagccggatgggataccagaatcactgaggacgatctgcaaaatgaagcaaagataacagacatcatggagccagaacacgctctacttgccacctcaatttttaaactgacatatcagaacaaggtggtcagggtgcagcgccccgctaagaatggcactgtgatggatgtcatcagcagacgggaccagaggggttccgggcaagttggaacctacggcctcaacacgttcaccaatatggaggcccagctgattcgtcagatggaaagtgagggcatctttttgccttctgagttagaaacaccaaacctggcagagcgagtgctcgattggcttgaaaaatatggggtagagcgcctgaagagaatggcgataagcggagacgactgcgtggtcaaacccattgatgaccggttcgccactgctctaaccgccctgaacgatatgggtaaggtgaggaaagacatcccgcagtgggaaccttccaagggctggaatgattggcaacaggttcccttttgttcacatcacttccaccagctcatcatgaaggacgggcgcgagattgtggtcccatgcagaaaccaggatgagttggtgggacgggcaagggtaagtcaaggcgctggttggtctctgcgagaaacagcctgtcttgggaaaagctacgcacagatgtggcagctgatgtattttcatcgtagagacctccgcttagccgcgaatgctatatgctccgccgttcctgtggattgggtccccacttcacggaccacgtggagcatccacgcacatcaccaatggatgacaaccgaggacatgctgtctgtgtggaacagggtttggattgaagagaatccatggatggaagataagactcatgtgtccagttggggagacgtcccctacttgggcaaaagagaggaccagtggtgtggcagcctgatcgggctcacagcccgcgctacctgggcctcgaacattcaggtggcaatcaatcaggtacggaggcttataggaaacgagaattatctggattacatgacttccatgaagcgattcaaaaacgaaggtgaccctgagggcgctctatggtga

SEQ ID NO: 13868 - RNA, 9879 nt, synthetic construct
  misc_feature 1..9879: note = derived and/or modified CDS sequence (opt3) from DENV-1__JF937599__SS-prME
  source 1..9879: mol_type = other RNA
agcgtgaccatgctgctcatgcttatgcccaccgccctggctttccacttgactgccagaggaggggaacctcatatgatcgtctccaagcaggaaagaggaaaatctttactgtttaagacgtcagccggtgttaacatgtgcaccctaattgcgatggacctcggcgagttctgtgaagataccatgacttacaaatgcccacggataaccgaagctgaaccggacgatgtggactgttggtgcaatgccacagatacctgggtaacttatgggacatgtagtcaaaccggagagcaccgccgagacaagcgtagcgtggcactggcaccccatgtcggccttggtctggagacgagaactgaaacctggatgtcctctgagggggcttggaaacagatccagagggtggaaacatgggcattgcggcaccctggatttactgttattgccctcttcctggctcatgccatcggcacctcgattacacagaagggcatcatatttatcctgctcatgttagtgaccccatcaatggcgatgcgctgcgtcgggattggaagcagagatttcgtggagggtctgagtggcgcaacgtgggtagacgttgtgcttgagcacgggtcctgtgtcactacaatggccaaggataaacccaccttggacatcgaactgctaaagactgaggtgacaaaccctgctgtgctcaggaaactgtgcattgaagccaagatctctaataccacgaccgatagccggtgtccaacacaaggagaggcaactcttgtcgaagaacaagacgctaactttgtttgccgccgaaccttcgtggatagaggctggggtaatgggtgtggactgtttggcaaaggctccttgataacatgcgccaagttcaagtgcgtaactaaactcgaggggaagattgtgcagtacgaaaacctgaaatattcagtcatcgtgaccgttcacacaggagaccagcatcaagtgggtaatgagagtaccgaacacggcactacggcgacaattacaccccaggcccctagcactgagatccagttaaccgactacggggcactgacactcgattgttctccaaggaccggacttgactttaacgaaatggtcctgttgactatgaaggagaaatcctggctagtgcataagcagtggttcctggatctcccgctgccctggacatcaggcgctagcacgagtcaagagacctggaatcggcaggaccttctggtaacttttaaaacagcccacgctaagaagcaggaagttgtggtcttgggttctcaagagggggccatgcacaccgcactcacaggcgccactgaagtgcagacctccggaacgaccacaatcttcgctggccatctgaaatgccgtttaaagatggataaactgactctaaaggggatgagctatgtcatgtgtaccggatcgttcaaactcgagaaggaagtggcggagacacagcacggtactgttctggtgcagattaagtacgagggcaccgacgcaccttgcaaaataccattttctacgcaagatgaaaagggggtaacacagaacggacgccttatcaccgccaatcccattgtcactgacaaagagaagcctgtgaacatcgaagctgagccacccttcggcgagtcctatatagttattggtgccggggaaaaagcattgaagctgtcatggtttaagaaaggcagtagcatcggaaagatgttcgaggccacagctagaggcgccaggcggatggcaatcctcggggataccgcgtgggactttggatccattggtggcgtgttcacttctgtcgggaaactggtgcatcagatctttggaaccgcttacggcgtacttttcagcggtgtgtcatggacaatgaagattgggataggcgttctgttgacgtggctcggactgaatagtcgatccaccagcttatctatgacttgtatcgccgtcggcctggtgacactatacctcggggtgatggtccaggcagattcaggatgcgttattaactggaaaggccgcgaactgaagtgtggtagtgggatctttgtgaccaatgaggtgcacacatggactgaacaatataagttccaggccgacagcccgaaaagactttccgctgccatcggaaaggcatgggaggagggcgtatgcggtattaggtctgctacccggttggaaaacataatgtggaaacagatctcgaacgagctgaatcatattctcctggaaaacgacatgaagttaacggtcgtggttggcgatgtggccgggatcctggcgcagggcaagaagatgattcgccctcaacccatggagtacaaatatagctggaagtcctggggcaaggccaaaatcataggggctgacgtccagaatacaacctttatcattgatggaccaaacactcctgaatgtcccgacgatcagagagcatggaatatctgggaggtggaggactacggcttcggtatttttaccacaaacatctggcttaagttgagggattcatatactcaggtttgcgaccaccgtctcatgagtgccgctataaaagattctaaggccgtgcacgcagacatggggtactggattgaaagcgagaaaaatgaaacctggaagctggcgcgggcctccttcatcgaggtaaagacatgtatttggccaaaatcacatacgctatggagcaacggagtcctggaatctgagatgatcatacccaagatctatggcggtcctatttcccaacacaattaccgaccaggctacttcacccagactgctgggccgtggcatctcggaaaactggagcttgattttgacttgtgcgaaggcacaaccgtggtggtcgatgagcactgcgggaacagaggacccagtctgaggactacaaccgttacgggcaagatcattcacgaatggtgttgccgcagctgtactttacctccactccggttcaaaggtgaggacgggtgctggtatggaatggagatcagacccgtgaaggaaaaggaggaaaatctggtaaaatctatggtgtccgccggctcaggtgaggtcgacagttttagccttggcctgttgtgtatatcgattatgatcgaagaggtgatgaggtcccgctggtctcgaaagatgctcatgaccgggacactggcagttttctttctactgatcatgggacagctcacctggaacgatctgattcggctttgcatcatggtgggcgctaatgccagcgaccgtatggggatgggaactacatacttggcactgatggccaccttcaaaatgagacctatgtttgctgtcggcttactcttcaggcgcctgacatcacgggaggtgcttctgctaactattggtctcagtctggttgcgtccgtggaattgccaaactctctggaggaattaggggatggactcgccatgggcataatgatcctgaaacttctgaccgactttcaaagccatcagttgtgggcaacgctcctgtccctaacattcattagaaccactttttcactgcactatgcttggaaaaccatggccatggtccttagcatcgtaagtctcttccccctgtgtttgtctacaacttcccagaagaccacgtggctgccggtgttactcggcagcctggggtgcaagcctcttacaatgtttctgattgccgagaataaaatctggggaaggaagtcgtggccattgaacgaaggtataatggctgttggcatcgtgtcaattctcctgtctagtctactgaaaaacgatgtcccccttgcagggcctctcatcgccggaggcatgctgattgcgtgttacgtgatctccggtagctctgctgacttgagcttagagaaggccgcagaggtatcctgggaagaggaagccgagcattcaggggctagtcacaatatactggtggaagtccaggatgacggaaccatgaaaattaaggatgaggagcgagacgatactctcacaatcctgcttaaagcaaccctgttggccgttagcggcgtgtatcccctatctatcccagcgactctgttcgtgtggtacttctggcaaaagaagaaacagcgctccggcgtcctctgggacacaccttcacccccagaagtggagcgggctgttctggatgacgggatttatagaataatgcagaggggacttttaggtcgtagtcaggtaggcgtgggggtctttcaagaaaacgtgttccataccatgtggcacgttacgcgcggagccgtgctgatgtaccagggcaagcggctcgagccgagctgggcatccgtcaaaaaggacttgatctcttacggtgggggatggagactgcagggctcgtggaatactggcgaggaagtgcaggtaattgccgtcgagcctgggaaaaaccccaagaatgtgcaaaccgctccaggaacatttaagaccagcgaaggtgaggttggcgccatcgcactcgatttcaaacccgggacatcaggatcccctattgtgaacagggaaggcaagatcgtcggtctgtatgggaatggagtggttactaccagtggcacgtacgtgtctgctatagcccaggcgaaagccagccaggagggcccacttcccgagatcgaagacgaggtctttcgaaagcggaacctgacaattatggatttgcaccctgggtccggaaaaactcgcagatatctaccggcaatcgtgagggaagctattaagcggcgactgagaaccctcatcttagccccaacacgcgtagtggcttcagagatggcagaagccctgaagggtatgcccataaggtaccaaaccactgccgttaaatctgagcataccggcaaggagattgtcgaccttatgtgccacgctacattcacgatgcgtctgctcagccctgtgcgggtgccaaattataacatgatcatcatggatgaagcgcattttactgaccccagttccattgcagccagagggtacatcagcaccagggtcggaatgggcgaggctgccgcaatattcatgacagccacccctccgggttctgtagaggcttttccccagtcaaatgcggtgattcaggatgaggaacgcgacatcccagagcgatcctggaacagtgggtatgagtggattactgatttccctggaaaaacagtttggtttgtgcccagcatcaagtcgggcaatgacatagccaactgtttgaggaaaaatggcaagcgggtcattcagctgtctaggaagaccttcgatacggaataccagaaaactaagaacaacgactgggactacgtggttacaaccgatatctccgagatgggggcaaatttccgcgctgaccgtgtgatcgatccaagacggtgcctcaaacctgtcattctgaaggacggacccgaaagggtgatccttgccggtccaatgccggtaaccgtggcaagcgccgctcagcgccgaggcagaattgggcggaaccacaataaagagggagatcagtatatatacatgggccagcctctaaacaatgacgaggatcatgcccactggactgaagcgaagatgctgttggacaacatcaatacacccgagggtattatcccagcattatttgaacccgagagggaaaagtcagccgctatcgatggggagtatcgcctgagaggcgaggccaggaaaaccttcgttgaactcatgcggcgtggagacctgcctgtctggcttagttacaaggtggcttctgagggctttcaatattccgatcgccgatggtgcttcgacggggaaagaaacaatcaggtgctggaggaaaacatggatgtcgagatttggacaaaagagggagaaaggaagaaactccggccacgctggttggacgcaagaacttacagcgaccccctggccctaagggagtttaaggagttcgctgccggtcggcgatcagttagtggcgatctgatactcgagatcgggaaacttcctcagcacctgacgcagagagcacaaaatgcgttagacaacttggtgatgctgcataatagcgaacagggaggccgcgcctataggcacgctatggaggagctcccggataccattgaaacactgatgcttctggccctcatcgcagtattgactggtggggtgaccctgtttttcttatccggccggggactaggcaagacatctattgggctgctctgtgtcatggctagctccgtgcttctgtggatggcctcagttgagccacattggatcgcagcctctataatcttggaatttttcctgatggtgctcctgattcccgagcctgaccgtcagagaacaccccaggataaccaacttgcttacgtcgtaatcggactcctgtttatgattttgactgtggcggccaatgagatgggtctgttagaaacgaccaagaaagacctaggcatcgggcacgttgcagtggagaaccaccatcacgctgccatgctggatgtcgacctccatccagccagtgcatggacactttacgctgtggccactaccataattacacctatgatgaggcacaccatcgaaaacactacagcgaatatttcgctgacggctatcgccaaccaggcagccatattgatgggactggataagggctggcccatcagcaaaatggacattggtgtcccactcctggctcttgggtgctattcccaggtgaatcctttaaccctgactgcagccgttctcatgttggtggcgcattacgctatcattggcccgggactgcaagccaaggcaacacgcgaggcccagaaacggaccgctgccggcatcatgaagaaccccaccgtagatgggatagtggcaattgacctagatccagtcgtttatgacgctaagttcgaaaaacagctgggacagatcatgctccttatcctgtgtacatctcaaattttgctgatgcgaactacgtgggccctctgcgagtcaatcaccctggcgacaggccctttaactaccctttgggagggtagccccgggaagttttggaatacaaccatagccgtgtccatggcaaacattttcagaggaagttacctggctggcgccggtctcgcattctctctaatgaaaagcctgggcgggggaaggcgcggcactggggctcagggagaaacgttgggcgagaagtggaaacggcagctgaatcagctctcaaagccagaatttaacacatataagagatccggtatcatggaggtcgaccgtagtgaagccaaagaggggcttaagaggggagagaccactaaacacgccgtgagccggggcaccgcgaagctgcgctggttcgtagaacgaaatttggtgaaacctgagggtaaggttattgatctgggctgtgggagaggaggctggtcttactattgcgctgggctcaagaaagtgacagaagtcaagggatacactaaaggcggtcccgggcacgaggaaccgatcccaatggcaacctacggatggaacttagtgaagctgcattccggcaaagacgtctttttcatacctcccgagaagtgtgatacacttctgtgcgacatcggcgagtcaagcccaaatcccacgattgaagaggggaggaccctacgggtgctcaaaatggttgaaccttggctgcgcggaaaccaattttgtatcaagattttgaatccgtatatgccctcggtagtggagactctggagcagatgcagagaaagcacggtggcatgctcgtcaggaacccactttctcgaaatagtacacatgaaatgtactgggtgtcctgcgggaccggaaacatcgttagcgccgtgaatatgacttcacggatgctgttaaaccgtttcacaatggctcacagaaaacctacctatgagcgcgatgtcgacctgggcgccggtacgaggcacgtggcagtagaacccgaggtggccaacttggatattatcgggcagcggatagaaaatattaagcatgagcacaaatccacctggcattacgacgaggataacccttataagacatgggcttaccacggatcttatgaagttaaaccaagcggcagtgcgtccagcatggtcaatggcgtggtgaagctcctgactaagccctgggacgtcatccctatggttacccaaatcgccatgacagatactaccccatttgggcagcagagagtgttcaaagagaaggtagacacacgcacccccaaagcaaagaggggaactgctcaaattatggaagtgacggccaaatggctatggggttttctttctcgaaacaagaagccgcggatatgtacaagagaggagttcaccaggaaagtccgctcaaatgcagccatcggcgctgtgtttgttgacgagaaccagtggaatagtgccaaggaggcggtggaagatgagcgtttctgggacctggtccatcgggaaagagagctccacaaacaggggaagtgcgcaacttgcgtgtacaacatgatgggaaaaagggaaaagaagctgggcgagtttggtaaagccaaggggtcccgcgctatttggtacatgtggttgggagcccgattcctggagttcgaagcactcggctttatgaatgaggatcactggttcagccgggaaaactctctttcgggcgtagagggggagggactgcataaattaggttatatcctgagagacatttcaaagatccctggcgggaatatgtacgctgatgacaccgccggatgggatacaaggataacggaagacgatttgcagaacgaggctaaaatcaccgacattatggaaccagagcacgccctcctggcaaagagcatctttaaactaacttatcaaaataaggttgtgcgcgtccagagacccgcgaagaacggcacagtgatggatgtgatttcccggagggaccagcgtggtagtgggcaggtcggaacctacggccttaatactttcacaaacatggaagcccaactgatccgacagatggagtctgagggcatatttagcccttccgaactcgagaccccaaacctggctgggcgcgttttggattggttagaaaaacatggagtggagagactgaagcggatggccatttcaggtgacgactgtgtagtgaaacccatcgatgacaggttcgcaacagctctcactgcccttaatgatatgggcaaggtccgcaaagacatcccgcagtgggaacctagtaaggggtggaacgattggcagcaagtgcccttttgctctcaccacttccatcagctgattatgaaggacggaagagagatagttgtgccatgtcggaatcaggatgagctagtcggcagggcacgagtgagccagggtgccgggtggtccctgcgtgaaaccgcgtgcctcggaaaatcatatgctcaaatgtggcagttgatgtactttcacagacgcgacctgcggcttgccgcaaacgccatctgtagcgctgtacctgttgattgggtgcccacgtctaggaccacatggtccattcatgcccaccatcagtggatgactaccgaggacatgctgagtgtctggaatagagtgtggatcgaagagaacccatggatggaagataagacacacgttagctcgtggggcgacgtgccctatctcggcaaacgcgaggaccaatggtgcgggtccttaattggactgactgcacgggctacctgggccacgaatatccaggtcgcgataaaccaggtgaggcgattgctgggtaatgagaactacctcgattacatgacatctatgaagagattcaaaaatgaatcagaccctgagggcgctctttggtga

SEQ ID NO: 13869 - RNA, 9879 nt, synthetic construct
  misc_feature 1..9879: note = derived and/or modified CDS sequence (opt3) from DENV-1__FJ898431__SS-prME
  source 1..9879: mol_type = other RNA
agcgtgaccatgctgctcatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgctgtttctactgatcatgggacagctcacatggaacgatctgattcggctttgcatcatggttggcgcaaatgctagcgaccgtatggggatgggaaccacatacttggccctgatggcaactttcaagatgagacctatgtttgccgtgggcttactcttcaggcgcctgacctcacgggaggtccttctgctaacgattggtctcagtctggtggcttccgttgaattgccaaactctctggaggaattaggggatggactcgcgatgggcataatgatcctgaaacttctgacagactttcagagccatcaattgtgggccaccctcctgtccctaactttcattaagaccacattttcactgcactatgcatggaagactatggctatggtgcttagcatcgtcagtctcttccccctgtgtttgtctaccacgtcccagaaaacaacctggctgccggtattactcggcagcctggggtgcaagcctcttactatgtttctgattgccgagaataaaatctggggaagaaagtcgtggccattgaacgaaggtataatggccgtgggcatcgtttcaattctcctgtctagtctactgaaaaacgatgtgccccttgctgggcctctcatcgcaggaggcatgctgattgcctgttacgtcatctccggtagctctgcggacttgagcttagagaaggctgccgaggtgtcctgggaagaggaagcagagcattcaggggccagtcacaatatactggtagaagtgcaggatgacggaacaatgaaaattaaggatgaggagagggacgataccctcactatcctgcttaaggctacactgttggcagtcagcggcgtttatcccctatctatcccagccaccctgttcgtgtggtacttctggcagaaaaagaaacaacgatccggcgtgctctgggacacgccttcacccccagaagtcgagcgcgcggtgctggatgacgggatttatcggataatgcagagaggacttttaggtaggagtcaggttggcgtaggggtgtttcaggaaaacgtcttccatactatgtggcacgtgacccgtggagctgttctgatgtaccaaggcaagcgcctcgagccgagctgggcctccgtgaaaaaggacttgatctcttacggtgggggatggcggctgcagggctcgtggaatacaggcgaggaagtccaggtgattgcagtagagcctgggaagaaccccaaaaatgtccagaccgccccaggaacatttaagactagcgaaggtgaggtgggcgctatcgccctcgatttcaaacccgggacctcaggatcccctattgttaacagagaaggcaagatcgtgggtctgtatgggaatggagtcgtgacgacaagtggcacttacgtttctgcaatagctcaagccaaagcgagccaggagggcccacttcccgagatcgaagacgaggtgtttaggaagcgaaacctgaccattatggatttgcaccctgggtccggaaagacacggcgctatctaccggccatcgtcagagaagcaattaaaaggaagctgcggaccctcatcttagctccaactcgagtggtagcctcagagatggctgaagcactgaaaggtatgcccataagataccagaccacagccgtgaagtctgagcatacgggcaaagagattgttgaccttatgtgccacgccactttcaccatgcgcctgctcagccctgtcagggtgccaaattataacatgatcatcatggatgaagctcattttacagaccccagttccattgcggcacgtgggtacatcagcacccgggtgggaatgggcgaggccgctgccatattcatgactgcaacacctccgggttctgtcgaagcctttccccaatcaaatgctgtaattcaggatgaggaaagagacatcccagagaggtcctggaacagtgggtatgagtggattaccgatttccctggaaagacggtgtggtttgttcccagcatcaagtcgggcaatgacatagcgaactgtttgcgcaaaaatggcaagcgagtgattcagctgtctagaaaaactttcgatacagaataccagaagaccaaaaacaacgactgggactacgtcgtgaccactgatatctccgagatgggggccaatttccgggcagacagggttatcgatccacgccgttgcctcaagcctgtgattctgaaggacggacccgaaagagtcatccttgctggtccaatgccggtgacagtagccagcgcagcccaacggaggggccgcattgggcgaaaccacaataaagagggagatcagtatatatacatgggccagcctctaaacaatgacgaggatcatgctcactggaccgaagccaagatgctgttggacaacatcaatacacccgagggtattatcccagcgttatttgaacccgagagagaaaaatcagcagccatcgatggggagtatcggctgaggggcgaggctcgcaagactttcgtggaactcatgagaaggggagacctgcctgtttggcttagttacaaagtcgcctctgagggctttcagtattccgatcggcgttggtgcttcgacggggaacgcaacaatcaagtgctggaggaaaacatggatgtggagatttggacgaaggagggagaacgaaagaaactcagaccaaggtggttggacgctcggacctacagcgaccccctggcactacgcgagtttaaagagttcgccgctggtagaaggtcagtcagtggcgatctgatactcgagatcgggaaacttcctcagcacctgacacagcgggcccagaatgcattagacaacttggttatgctgcataatagcgaacaaggaggccgagcgtatagacacgccatggaggagctcccggatactattgaaaccctgatgcttctggctctcatcgccgtgttgacaggtggggtaaccctgtttttcttatccggccgcggactaggcaagacttctattgggctgctctgtgtgatggcaagctccgtccttctgtggatggcttcagtggagccacattggatcgccgcatctataatcttggaatttttcctgatggttctcctgattcccgagcctgacaggcagcggacgccccaggataaccagcttgcctacgtggtcatcggactcctgtttatgattttgaccgtagctgcgaatgagatgggtctgttagaaacaactaaaaaggacctaggcatcgggcacgtggccgttgagaaccaccatcacgcagctatgctggatgtggacctccatccagccagtgcctggaccctttacgcagtcgctacaaccataattactcctatgatgcgtcacacaatcgaaaacacgaccgccaatatttcgctgactgcgatcgctaaccaagccgcaatattgatgggactggataaaggctggcccatcagcaagatggacattggtgtgccactcctggcccttgggtgctattcccaggtcaatcctttaacactgaccgctgcagtgctcatgttggttgcccattacgcgatcattggcccgggactgcaggctaaggccaccagagaggcacaaaagaggacagccgctggcatcatgaagaaccccactgtggatgggatagtagccattgacctagatccagtggtctatgacgcaaaattcgaaaagcagctgggacagatcatgctccttatcctgtgtacgtctcagattttgctgatgcgcaccacatgggctctctgcgagtcaatcactctggccaccggccctttaacaaccctttgggagggtagccccgggaaattttggaatactacgatagcggtttccatggccaacattttccggggaagttacctggcaggcgctggtctcgccttctctctaatgaaaagcctgggcgggggacgaagaggcacaggggcacaaggagaaaccttgggcgagaagtggaaaaggcagctgaatcagctctcaaagtccgaatttaacacttataaacgcagtggtatcatggaggtggaccggagcgaagctaaggaggggcttaaaagaggagagaccacaaagcacgccgtctctcgtggcactgccaagctgaggtggttcgtggaacggaatttggtaaaaccagagggtaaggtgattgatctgggctgtgggcgcggaggctggtcctactattgcgcggggctcaaaaaggttaccgaagtgaaaggatacacaaagggcggtcctgggcacgaggaacccatcccgatggctacgtacggatggaacttagtcaaactgcattcaggcaaggacgtgtttttcataccacctgagaagtgtgatacccttctgtgcgacatcggcgagagctcgcccaatccaactattgaagaggggcgaacactaagagtcctcaaaatggtggaaccctggctgaggggaaaccagttttgtatcaagattttgaatccttatatgccgtctgttgtagagaccctggagcaaatgcagcggaaacacggtggcatgctcgtgcgcaacccccttagtagaaattccactcatgaaatgtactgggtcagctgcgggacaggaaacatcgtgtcagcagttaatatgacctccaggatgctgttaaaccgattcacgatggcccaccggaagccaacctatgagcgtgatgtggacctgggcgctggtacaagacacgtcgccgtggaacctgaggtagcaaacttggatattatcgggcagcgcatagaaaatattaaacatgagcacaagtctacttggcattacgacgaggataacccctataagacctgggcctaccacggaagctatgaagtgaaacctagtggctccgctagctctatggttaatggcgtcgtgaagctcctgacaaaaccatgggacgtgatccccatggtcactcagatcgcgatgaccgatacaaccccttttgggcaacagagggttttcaaggagaaagtggacactcggacgccaaaggccaagagaggaacagcacagattatggaagtaaccgctaaatggctatggggttttctttcacgcaacaagaaacccaggatatgtactcgagaggagttcacccggaaggtgagaagtaatgccgcaatcggcgccgtctttgtggacgagaaccaatggaactccgctaaagaggccgttgaagatgagaggttctgggacctggtgcatcgcgaacgtgagctccacaagcaggggaagtgcgcgacatgcgtctacaacatgatgggaaaacgggaaaagaaactgggcgagtttggtaaggcaaaagggagcagagccatttggtacatgtggttgggagctaggttcctggagttcgaagccctcggctttatgaatgaggatcactggttctctcgcgaaaactcgctttcaggcgtggagggggagggactgcataagttaggttatatcctgcgagacattagcaaaatcccgggcgggaatatgtacgcagatgacacggctggatgggatacccggataactgaagacgatttgcagaacgaggccaagatcacagacattatggaacctgagcacgctctcctggccaagtccatctttaaactaacctatcagaataaggtagttagagtgcaaaggccagccaagaatggcactgtcatggatgtgattagtcgcagagaccagcggggttctggacaggtgggaacatacggccttaataccttcacaaacatggaagcgcagctgatcaggcaaatggagagcgagggcatattttccccctcagaactcgagactcctaacctggccgggcgtgtcttggattggttagaaaagcatggagttgagcgactgaaacgcatggctattagtggtgacgactgtgtggtaaagccaatcgatgacagattcgccaccgcactcacggctcttaatgatatgggcaaggtgcggaaagacatcccccagtgggaaccgtctaaggggtggaacgattggcagcaggtccctttttgcagccaccacttccatcaactgattatgaaagacggaagggagatagtggttccctgtcgcaatcaggatgagctagtgggcagagcccgggtctcccagggtgcagggtggtcactgagggaaaccgcctgcctcggaaagagctatgcgcagatgtggcaattgatgtactttcaccgacgtgacctgagacttgctgccaacgcaatctgttctgccgtgccagtagattgggttcctacatcccgcactacctggagtattcatgctcaccatcagtggatgacaactgaggacatgctgagcgtgtggaatcgggtctggatcgaagagaacccctggatggaagataaaacccacatttcgtcctggggcgacgtgccatatctcggcaagagggaggaccagtggtgcgggtctttaatcggactgacggccagagcaacatgggctaccaatatacaagttgccatcaaccaggtgcgccggttgattggtaatgagaactacctggattacatgacttcaatgaagaggttcaaaaatgaaagcgaccccgagggcgcgctctggtga

SEQ ID NO: 13870 - RNA, 9879 nt, synthetic construct
  misc_feature 1..9879: note = derived and/or modified CDS sequence (opt3) from DENV-1__GU131678__SS-prME
  source 1..9879: mol_type = other RNA
agcgtgacaatgctgctcatgcttatgcccacagcactggctttccacttgactacgagaggcggggaacctcatatgatcgtctccaagcaggaaaggggaaaatctttactgtttaagacctcagccggtgttaacatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctgctcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcatgaccaaattagaagggaagatagtacagtacgagaacctgaaatattcagtgattgtcacagtgcacaccggagatcagcatcaagttggtaatgaaagtactgagcacggcacgacagccaccatcactccccaggcgcctaccacagaaattcagctcaccgactacggggcccttactctggactgtagcccaaggacaggattggatttcaacgagatggtgctactgacgatgaaggagaaatcttggctcgtccataagcagtggtttctggaccttccgctgccctggacctccggcgcatcaactagccaagaaacatggaatcggcaggatttgctcgtgaccttcaaaacagctcacgccaagaagcaggaggtagttgtgctgggtagtcaagaaggggctatgcacactgccttaaccggcgcaacggagatccagacctctggaacaactaccatctttgccggccatctgaaatgccgtctaaagatggacaaactcacactgaaggggatgtcctatgtcatgtgtactggtagcttcaaacttgaaaaggaggtggctgagacccagcacggaacggtcttggtgcagattaagtacgaaggcacagatgcgccttgcaaaataccattctcgacccaagacgagaagggggttactcagaacggacgcctgatcacagcaaatcccattgtgaccgataaagaaaagcctgtaaacatcgaggccgagccaccctttggcgaatcttatatagtcattggtgctggggagaaagccctcaagctgtcctggttcaagaaaggctcaagtatcggaaagatgtttaaagcaactgccagaggcgctaggcggatggccatccttggggacaccgcatgggatttcggaagcattggtggcgtgtttacatccgttgggaagctggtgcatcagatcttcggaacggcgtacggcgtcttgttttctggtgtgagctggaccatgaaaattgggataggcgtactcctgacttggttaggactaaattcacgaagtacatccctaagcatgacctgtatcgctgtgggcctcgttacactgtaccttggggtcatggtgcaggccgactctggatgcgtgattaactggaagggccgcgaattgaagtgtggttcagggatcttcgtcactaatgaggttcacacctggacggaacaatataaatttcaggcagatagtccgaagagactgagcgccgctatcggaaaagcctgggaggagggcgtgtgcggtattaggtccgcaacacggctcgaaaacataatgtggaagcagatctctaacgagctgaatcatattttactggaaaacgacatgaaattcaccgtggtagtcggcgacgtggctgggatccttgttcagggaaagaaaatgattcgccctcaacccatggagtacaagtattcgtggaagtcctggggcaaagccaagatcataggggcggatgtgcaaaattccacttttatcattgacggaccaaacacccctgaatgtcccgatgaccagagagcctggaatatctgggaggtcgaggattacggcttcggtatttttacaactaacatctggttgaaactcagggactcatatacccaggtgtgcgatcaccgtctgatgagtgctgcaataaaggactctaaagccgttcacgctgatatggggtactggattgaaagcgagaagaatgaaacatggaagctagcccgggcatccttcatcgaggtgaaaacgtgtatttggccaaagtcacataccctgtggagcaacggagtactcgaatctgagatgatcatacccaaaatccacggcggtcctatttcccaacataattatcgaccaggctacttcactcagacagcggggccgtggcacctgggaaaacttgagttggactttgatctgtgcgaaggcaccactgtcgtggtggacgagcactgcgggaacagaggacccagtttaaggacaaccacggtcactggcaaaatcattcatgaatggtgttgccgcagctgtaccctccctccactgcggttcagaggtgaggatgggtgctggtacggaatggagatcaggcccgttaaggaaaaggaggaaaatcttgtgaaatctatggtatccgccggctcaggtgaggtggacagttttctgttgggcctcctgtgtataagcattatgatcgaagaggtcatgcgctcgcgatggtcccggaagatgctaatgacagggaccctggctgtgttctttctcctgatcatgggacagcttacttggaacgacttgattcgtctgtgcatcatggttggcgccaatgcatctgatagaatggggatgggaacaacctatttagctctcatggccacattcaaaatgaggcctatgtttgcagtgggcctgcttttccgccggctgactagcagagaggtcctactcctgaccattggtttgtcactggtggccagtgttgaattaccaaactccctcgaggaactgggggacggacttgctatgggcataatgatcctgaagttgctcacggattttcaatcttaccagctgtgggcgacactactgagccttaccttcattaaaactaccttttccctccactatgcctggaagacaatggcaatggtgctgtcaatcgtcagcttgttccccctgtgtttaagtactacctctcagaagacgacatggctcccggtactgcttggctccctggggtgcaaacctttgaccatgtttctcattgctgagaataagatctggggaaggaaaagctggccactgaacgaaggtataatggccgtgggcatcgtttcgattctactgtcatctcttctcaagaacgacgtgcccctggccgggcctttgatcgctggaggcatgttaattgcatgttacgtcatcagtggttccagcgccgatctgtctctcgagaaagcggctgaggtgagctgggaagaggaagccgagcattccggggcatcacacaatatactggtagaagtgcaggacgatggaactatgaagattaaagacgaggagcgagatgacacacttaccatcctgttgaaggccactctactggctgtcagtggcgtttatcccctcagcatcccagcaacactgttcgtgtggcatttctggcaaaagaaaaagcagcgctctggcgtgctttgggataccccttcacccccagaagtcgagcgggccgtgttagacgatgggatttacagaataatgcagaggggactgctcggtcgtagccaggttggcgtaggggtgtttcaagaaaacgtcttccacacgatgtggcacgtgactcgcggagcggttttgatgtatcagggcaaacggctggagccgagttgggctagcgtgaagaaagacctcatctcctacggtgggggatggagatttcagggctcttggaataccggcgaggaagtccaggtgattgccgtagagcctgggaagaaccccaagaatgtccaaacagcaccaggaaccttcaaaacacccgaaggtgaggtgggcgccatcgctctggactttaagcctgggacttcgggaagcccaattgttaacagggaaggcaaaatcgtgggtctttacgggaatggagtcgtgaccacgtcaggcacatatgtttccgccatagcacaggctaaggccagtcaggagggccccctgcctgagatcgaagatgaggtgttccgaaaacggaacttgactattatggacctacatccggggtctggaaagacccgcagatacctgccagcgatcgtcagggaagccattaagcggaaactccgaacattaatcctggcacccaccagagtggtagctagcgagatggccgaagctcttaagggtatgcctatacgctatcaaactaccgcagtgaaatccgagcacacaggcaaggagattgttgatctgatgtgccatgccacgtttactatgaggctcttgtcaccagtccgtgtgcccaattacaacatgatcatcatggacgaagcccacttcaccgatccttctagcattgctgcgcgggggtatatcagtacaagagtgggaatgggcgaggcagccgctatatttatgaccgccactccgcccggttccatggaagcattcccacagagcaatgccgtcattcaggacgaggaaagggatatccctgagcgctcttggaactcagggtacgagtggattacagactttcccggaaaaaccgtatggttcgtgccatccatcaaggctggcaatgatatagcgaactgtctgcgaaagaatggcaaaagagttattcagctcagtcggaagacgttcgacactgaatatcagaagactaagaacaacgattgggactacgtggtcaccaccgacatcagcgagatgggggccaattttagggcagatcgcgtgatcgaccctcgtagatgcctgaaacccgttattcttaaggatggaccagaacgggtgatcctagctggtccgatgcctgtcactgtggcctcggcagcccagaggcgcggccgaattgggagaaaccccaataaggagggagaccagtacatatatatgggccagccactgaacaatgatgaggaccatgctcactggacagaagccaaaatgttgttagataacatcaatacccccgagggtattatccctgcgctgttcgaaccagagcgggaaaagtctgcagccatcgacggggagtacaggctccgcggcgaggctagaaaaacatttgtagaactgatgaggcggggagatcttcccgtgtggctgtcctataaggttgccagcgagggcttccaatactcagaccgtcgctggtgctttgctggggaacgaaacaatcaggtcctcgaggaaaacatggatgtggagatttggactaaagagggagaaagaaagaaattgctgcctaggtggctagacgcacggacgtatagtgatccgctggccctccgcgagttcaaggaatttgctgccggtagaaggtctgtgtccggcgaccttatactggagatcgggaagttaccacagcacttgacccagcgggcacaaaatgcgctggacaacctcgtcatgctgcataatagcgaacagggaggccgagcctacagacacgctatggaggagcttcccgatacaattgaaactctgatgctcttggccctgatcgcagttttaaccggtggggtgacactattctttctgtcaggcaaaggactcggcaagaccagtattgggcttctgtgtgtaatggctagctccgtgttgctgtggatgggatctgtcgagcctcattggatcgccgcaagcataatcctcgagttctttctgatggtgcttctcattcccgagccagaccgccagaggactcctcaggataaccaactggcctatgttgtgatcggtttgctgttcatgattttaacggtcgctgcgaatgagatgggcctactggaaaccaccaaaaaggacctcgggatcggacacgtagccgtggagaaccaccatcacgcagctatgcttgatgttgacctgcatcccgcctccgcctggactttgtacgcagtggctaccacaataattaccccaatgatgcggcacactatcgaaaacacaacggccaatatttcactgaccgcgatcgctaaccaggccgcaatactcatgggcctggccaaaggttggcctatctctaagatggatattggggtcccgcttttagctctgggctgctacagtcaggtgaatcccctcactttgacagcagccgtcctgatgctagtggcgcattatgctatcattggaccaggcctgcaagccaaggcaacccgtgaggcccagaaaagaaccgctgccgggatcatgaagaaccctacaatagacggaattgttgcaatcgatctcgaccccgtggtatacgatgctaaatttgaaaagcagcttggccagatcatgctgttgattctgtgtacttcgcaaatcctcctgatgaggacgacctgggccttatgcgagagcataacacttgcgactggtccactgaccacactctgggaggggtcccctggaaaattctggaataccactattgccgtgtctatggcaaacatcttccgcggctcatatctagctggtgccggcctggcatttagcttgatgaagtccctagggggaggccggcgagggacgggagctcagggcgaaacactcggtgagaagtggaaaagacagcttaatcagctgagtaagtctgagttcaacacctacaaaaggagcgggattatggaagtcgaccgctcagaagccaaggagggattgaaacggggcgagactaccaagcacgccgtttccagaggtcccgcgaagctgcgttggtttgtggaaaggacactcgtcaatccggagggcaaagtgatcgctttagggtgtggacggggcgcatggagttattactgcgccgggctgaagaaaggaactgaagtaaagggctataccaaaggtgggccaggacacgaggaacctatacccatggctacatacggctgggatcttgtgaagctgcatagcggcaaagacgttttctttatcccacccgagaagtgtgacacgctactctgcgatattggggagtcttcccctaacccgaccatcgaagagggacgcactctgcgagtgttgaagatggtcgaaccctggctgagaggtaatcaattctgtattaaaatcctcaacccatacatgccttcagtggtcgagacacttgagcagatgcagaggaagcacggcgggatgctggtgcggaatcccttaagccgcaactcgacccatgaaatgtattgggtttcttgcggaactggcaatattgtaagtgccgtgaacatgacatccagaatgctgttgaataggtttaccatggcacaccgaaaacctacgtacgagcgggacgtcgatctcggtgccgggacccgtcacgtggctgttgacccagaagtggcgaacctggatatcataggacagagaattgagaacatcaagcatgaacacaaaagcacatggcattatgacgaggataatccctacaagacttgggcctatcacggctcatacgaggtcaagccttccggctctgcaagcagtatggtgaacggggtagtgaaactacttaccaagccatgggacgttatccccatggtcacacaaattgctatgactgataccacaccgttcggacagcagcgcgtgtttaaagaaaaggtggacaccaggactcctaaagccaagcggggtacggcacaaataatggaggtcacagccagatggctgtggggcttcctctcccgcaataagaaaccaaggatctgtacccgagaagagtttactcggaaggttagaagcaacgctgccattggggcggtgttcgtagatgaaaatcagtggaactctgcaaaagaggccgtggaggacgacaggttttgggatctggtccatcgcgaacgtgagttgcacaagcagggaaaatgccctacctgcgtgtataatatgatgggcaagcgggaaaagaaactgggtgagttcgggaaggctaaaggatcaagacccatctggtacatgtggctcggcgccaggttccttgaatttgaggcactgggcttcatgaacgaggaccactggtttagtcgcgaaaattccttaagcggggttgagggagaagctctgcataagttgggttacattctccgagatatctctaaaataccaggcgggaacatgtatgccgacgatacagctggatgggacacgcggatcaccgaggatgacctgcagaatgagggcaagattactgatatcatggaacccgagcacgccctacttgcaaaatcgattttcaagctgacataccaaaacaaggtggtcagagtgcagaggccggcgaaaaatggtaccgtaatggacgttatctcacgcagagatcagcgggggagcggacaggtgggcacttatggcctcaacacatttaccaatatggaagcccaactgataaggcagatggagtccgaagggattttcttgcctaacgagttagagacacccaacctggctggacgtgtcctcgactggcttgaaaagtacggtgtggagcgactgaaacgcatggccatcagtggcgatgactgtgtggtcaagccaatcgacgatagatttgcaactgctctaaccgccctgaatgacatggggaaagttcggaaggatattcctcagtgggaaccctctaagggatggaacgactggcagcaagtgccattctgcagccatcactttcaccagctcataatgaaagatggcagggagatcgtagtgccctgtcgcaatcaggacgaattggtcggtagagcacgggtgtcccagggggccggatggacgctgagggagaccgcgtgccttggcaagtcatatgctcaaatgtggcagctgatgtacttccctcgacgtgccctcagattagcagccaacgctatttgtagtgccgttccagtggattgggtcccgacatctcgcactacctggagcatccatgcacaccatcagtggatgacaactgaggacatgctgtccgtgtggaatcgggtatggattgaagagaacccctggatggaagataaaaccaggatctcaagctgggaggacgttccttatttgggcaagagagaagatcaatggtgcgggtctctgataggactcacgccacgcgctacatggcccaccaatatccaggtggccattaaccaggtccggaggcttatcggtaatgagaactactccgactacatgacaagtatgaaacgatttaagaatgagagcgaacctgagggcgcgctgtggtga

SEQ ID NO: 13871 - RNA, 9879 nt, synthetic construct
  misc_feature 1..9879: note = derived and/or modified CDS sequence (opt3) from DENV-1__GU131679__SS-prME
  source 1..9879: mol_type = other RNA
agcgtgaccatgctgctaatgcttatgcccaccgcactggctttccacttgactacgcgaggcggggagcctcatatgatcgtctccaagcaggaaaggggaaaatctttactgtttaagacctcagccggtgttaacatgtgcaccctgattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaagcatggctagtgcataagcagtggttcctggatctcccgctgccctggacctccggcgcttcaactagccaagagacatggaatcggaaagaccttctggtaacctttaagacagcccacgctaagaaacaggaagttgtggtcttgggtagtcaggagggggccatgcacactgcactcaccggcgccacggaaatccaaacctctggaacaactaccatcttcgctggccatctgaagtgccgtttaaaaatggataagctgacactaaaagggatgtcctatgtgatgtgtactgggagcttcaagctcgagaaggaagtcgcggagacccagcacggtacggtgctggttcagattaaatacgagggcacagacgcaccttgcaagataccattttcgacccaggatgaaaaaggggtgactcaaaacggacgccttatcacagccaatcccattgtaaccgacaaggagaaacctgtcaacatcgaagctgagccacccttcggcgagtcttatatagtgattggtgccggggaaaaggcattgaagctgtcctggtttaaaaagggctcaagtatcggaaaaatgttcgaggccactgctagaggcgccaggcggatggcaatcctcggggataccgcgtgggactttggaagcattggtggcgttttcacatccgtggggaagctggtccatcagatctttggaacggcttacggcgtgcttttctctggtgtaagctggaccatgaaaattgggataggcgtgctgttgacttggctcggactaaattcacgaagtacatccttaagcatgacctgtatcgccgttggcctggtcacactatacctcggggtgatggtgcaggcagattctggatgcgtcattaactggaagggccgcgaactgaagtgtggttcagggatctttgttactaatgaggtgcacacctggacggaacagtataaattccaagccgacagtccgaagagacttagcgctgccatcggaaaagcatgggaggagggcgtgtgcggtattaggtccgctacacggttggaaaacataatgtggaagcagatctctaacgagctgaatcatattctcctggaaaacgacatgaaatttaccgtagtcgtgggcgatgttgccgggatcttagcgcagggaaagaaaatgattcgccctcagcccatggagtacaagtattcgtggaaaagctggggcaaagccaagatcataggggctgacgtgcaaaatgcaactttcatcattgatggaccaaacacccctgaatgtcccgacgatcagagagcctggaatatctgggaggtcgaggactacggctttggtattttcacaactaacatctggctgaaacttagggattcctatacccaggtgtgcgaccaccgtttgatgtcagctgccataaaggatagtaaagcagttcacgcggacatggggtactggattgaatctgagaagaatgaaacatggaagctcgcccgggctagcttcatcgaggtgaaaacgtgtatttggccaaagtcccataccctgtggtcaaacggagtactagaaagcgagatgatcatacccaaaatctatggcggtcctatttctcagcacaattaccgaccaggctactttactcaaacagccgggccgtggcatctgggaaagctcgagctggatttcgacctttgcgaaggcaccactgtcgtggtggatgagcactgcgggaacagaggaccctccttgaggacaaccacggtcactggcaaaatcattcacgaatggtgttgccgcagttgtaccctgcctccattacggtttaagggtgaggacgggtgctggtatggaatggagatcagacccgttaaggaaaaagaggaaaatctcgtgaagtccatggtatctgcaggctccggtgaggtggactcattcagtctgggccttctgtgtataagcattatgatcgaagaggtcatgaggtcgcgctggtcccgaaaaatgttgatgacagggaccctcgctgtgtttttcctgctaatcatgggacagctgacttggaacgatctcattcggctgtgcatcatggttggcgccaatgcatctgaccgtatggggatgggaacaacctaccttgccttgatggctacatttaagatgagacctatgttcgcggtgggcctgttatttaggcgcctcactagccgggaggtcctgcttctgaccattggtctatcactcgtggccagtgttgaactgccaaactccttggaggaactgggggatggattagcaatgggcataatgatcctcaaactgcttacggacttccagtctcatcaactgtgggctacattgctcagcctgacctttattaagactaccttctccctacactatgcctggaagacaatggccatggtgctgtcaatcgtcagcctttttcccctctgtctgagtactacctctcagaaaacgacatggttgccggtactgttaggctccctcgggtgcaagcctctgaccatgttccttattgctgagaataaaatctggggaagaaagagctggccactgaacgaaggtataatggcagtgggcatcgtttcgattttgctctcatctctgctcaagaacgatgtgcccctggccgggcctcttatcgcgggaggcatgctcattgcttgttacgtcatcagtggttccagcgccgacctgtctttggagaaggcagccgaggtgagctgggaagaggaagctgagcattccggggcatcacacaatatattagtagaagtgcaggatgacggaactatgaaaattaaggatgaggagagggacgatatgctgacaatcctcctgaaggccacccttctggcggtcagtggcgtttatcccttgagcatcccagctactctattcgtgtggtacttttggcagaaaaagaaacaacgatctggcgtgctgtgggacacaccttcacccccagaagtcgagcgcgccgtgctcgatgacgggatttatcggataatgcagagaggactgcttggtaggagccaggttggcgtaggggtgttccaggaaaacgtctttcataccatgtggcacgtgacgcgtggagcagttttaatgtaccaaggcaagcgcctggagccgagttgggccagcgtgaaaaaggacctcatctcctacggtgggggatggcggttgcagggctcttggaatactggcgaggaagtccaggtgattgctgtagagcctgggaagaaccccaaaaatgtccagaccgccccaggaacattcaagacctcggaaggtgaggtgggcgcaatcgctctggattttaaacccgggacaagcggatcacctattgttaacagagaaggcaagatcgtgggtctctatgggaatggagtcgtgactacctccggcacgtacgttagtgccatagcgcaagccaaagcatctcaggagggcccactgcccgagatcgaagacgaggtgttcaggaagcgaaaccttacaattatggatctgcaccctgggagcggaaagactcggcgctatttgccggctatcgtcagagaagccattaaaaggaagctacggaccctgatcctcgctccaacacgagtggtagcatccgagatggccgaagccttaaaaggtatgcccataagataccagaccactgctgtgaagtcagagcataccggcaaagagattgttgacctgatgtgccacgcgacatttacgatgcgccttctgtctcctgtcagggtgccaaattataacatgatcatcatggatgaagcacatttcactgaccccagcagtattgccgctcgtgggtacatctccacccgggtgggaatgggcgaggccgcagccatatttatgacagctacccctccgggtagcgtcgaagcgttcccccaatctaatgccgtaattcaggatgaggaaagagacatcccagagaggtcatggaactccgggtatgagtggattactgattttcctggaaagacagtgtggttcgttcccagtatcaagagcggcaatgacatagcaaactgtctccgcaaaaatggcaagcgagtgattcagttgtcgagaaaaaccttcgatacggaataccagaagactaaaaacaacgactgggactacgtcgtgacaaccgatatctctgagatgggggctaattttcgggccgacagggttatcgatccacgccgttgcctgaagcctgtgattctcaaggacggacccgaaagagtcatcctggcaggtccaatgccggtgaccgtagcctccgctgcccaacggaggggccgcattgggcgaaaccacaataaagagggagatcagtatatatacatgggccagcctcttaacaatgacgaggatcatgcgcactggactgaagcaaagatgctactggacaacatcaatacacccgagggtattatcccagccttgttcgaacccgagagagagaaaagcgctgccatcgatggggagtatcggttaaggggcgaggctcgcaagacctttgtggaactgatgagaaggggagacctccctgtttggctgtcatacaaagtcgcaagtgagggcttccagtattctgatcggcgttggtgctttgacggggaacgcaacaatcaagtgcttgaggaaaacatggatgtggagatttggacaaaggagggagaaagaaagaagctgagaccaaggtggctcgacgcccggacttactccgaccccttggctctgcgcgagttcaaggaatttgccgcaggtagaaggagcgtctcaggcgatctaatactggagatcgggaaactccctcagcaccttacgcagcgggcgcagaatgccctggacaacttagttatgttgcataatagtgaacaaggaggccgagcttatagacacgccatggaggagctgccggataccattgaaacactcatgctgcttgcactgatcgctgtgctcactggtggggtaaccttgttctttctgagcggccgcggattaggcaagacatccattgggctactgtgtgtgatggcctctagcgtcctcctttggatggcatccgtggagccacattggatcgccgcttcaataatcctggagttctttttgatggttctgctcattcccgagcctgacaggcagcggacaccccaggataaccagctggcgtacgtggtcatcggacttctcttcatgattctgactgtagccgcaaatgagatgggtttgctggaaacgaccaaaaaggacttaggcatcgggcacgtggctgttgagaaccaccatcacgccgccatgctagatgtggacctgcatccagcatctgcttggacactctacgccgtcgcgactaccataattacacctatgatgcgtcacaccatcgaaaacactacagctaatattagtcttacggccatcgcaaaccaagccgctatactgatgggattggataaaggctggcccatctcgaagatggacattggtgtgccactgctcgcactggggtgctatagccaggtcaatcctcttaccttaactgccgcggtgctgatgctcgttgctcattacgccatcattggcccgggattgcaggcaaaggccacaagagaggctcagaaaaggaccgccgcaggcatcatgaagaaccccaccgtggatgggatagtagctattgaactggacccagtggtctatgatacaaaatttgagaagcagctaggacagatcatgctgctcatcctttgtacttcccagattctgttgatgcgcacgacctgggccctgtgcgagtctatcacactcgcgactggccctctgaccacattatgggaaggttcacccgggaaattctggaataccactatagccgttagcatggcaaacattttccggggatcctaccttgctggcgccggtctggcatttagtctcatgaagtctctaggcgggggacgaagaggcacgggggctcaaggagagacactgggcgaaaagtggaaaaggcagttgaatcagctgagcaagtcagagttcaacacctataaacgctccggtatcatggaagtggaccggagtgaggccaaggaggggctcaaaagaggagaaactaccaagcacgccgtcagccgtggcacagcgaaacttaggtggtttgtggagcggaatctggtaaaaccagaaggtaaggtgattgacttgggctgtgggcgcggaggctggtcttactattgcgctgggctgaaaaaggttactgaggtgaaaggatacaccaagggcggtcctgggcacgaagaacccatcccgatggcaacatacggatggaacctcgtcaaattacattccggcaaggatgtgttctttataccacctgagaagtgtgacacgctgctttgcgatatcggcgaatcaagccccaatccaaccattgaggaagggcgaactctgagagtcctaaaaatggtggagccctggctcaggggaaaccagttctgtatcaagattctgaatccttatatgccgtcggttgtagagacattggaacaaatgcagcggaaacacggtggcatgctggtgcgcaaccccctctctagaaatagtacccatgagatgtactgggtctcctgcgggactggaaacatcgtgagcgccgttaatatgacatcaaggatgcttctgaaccgatttaccatggctcaccggaagccaacgtatgaacgtgacgtggatttaggcgccggtaccagacacgtcgcagtggagcctgaagtagccaacctggacattatcgggcagcgcatagagaatattaaacatgagcacaagtccacatggcattacgatgaagacaacccctataagacttgggcttaccacggatcttatgaggtgaaacctagcggcagtgcgtccagcatggttaatggcgtcgtgaagttgctcaccaaaccatgggatgtgatccccatggtcacacagatcgccatgactgacaccacacctttcgggcaacagagggtttttaaggaaaaagtggatacccggactccaaaggcaaagagaggaacggctcagattatggaggtaacagccaaatggctgtggggtttcctatctcgcaacaagaaacccaggatatgtacccgagaagagtttactcggaaggtgagatcaaatgcagccatcggcgctgtcttcgtggacgagaaccaatggaatagtgccaaagaagcggttgaggacgaaaggttttgggatcttgtgcatcgcgagcgtgaactgcacaagcaggggaagtgcgcaacctgcgtctacaacatgatgggaaaacgggagaagaaactcggcgagttcggtaaggccaaagggtccagagctatttggtacatgtggctgggagccaggttcttggaatttgaggcactgggcttcatgaatgaagaccactggtttagccgcgagaactctctctcgggcgtggagggggaaggacttcataagctgggttatatcttacgagatatttcaaaaatcccgggcgggaatatgtacgctgacgatacagccggatgggacacgcggataaccgaggatgacctgcagaacgaagctaagatcactgatattatggagcctgaacacgccttgctcgcaaagagcatcttcaaactgacatatcagaataaggtagttagagtgcaaaggccagcgaaaaacggcaccgtcatggacgtgatttcccgcagagatcagcggggtagtggacaggtgggaacttacggcctaaatacatttaccaacatggaggcccagcttatcaggcaaatggagtctgaaggcatattcagcccctccgagctggaaacacctaacctcgctgggcgtgtcctggactggttggagaagcatggagttgaacgattaaaacgcatggccatttcaggtgatgactgtgtggtaaagccaatcgacgatagatttgcaactgctctgaccgccctcaatgacatgggcaaggtgcggaaagatatcccccagtgggagccgagtaaggggtggaacgactggcagcaggtccctttctgctctcaccactttcatcaacttattatgaaagatggaagggagatagtggttccctgtcgcaatcaggacgaactggtgggcagagcacgggtcagccagggtgccgggtggtccctaagggagacggcgtgcctgggaaagtcatatgctcagatgtggcaactcatgtacttccaccgacgtgatttgagactggccgcaaacgccatctgtagcgctgtgccagtagactgggttcctacctctcgcacaacttggtccattcatgcccaccatcagtggatgaccacagaagatatgcttagtgtgtggaatcgggtctggatcgaggaaaacccctggatggaggacaaaactcacattagctcgtggggcgatgtgccatatctgggcaagagggaggaccagtggtgcgggtccctcatcggattaaccgcaagagctacgtgggccacaaatatacaagttgcgatcaaccaggtgcgccggctgattggtaatgaaaactacttggactacatgacctctatgaagaggtttaaaaatgagatcgatcccgaaggcgctctgtggtga

SEQ ID NO: 13872 - RNA, 9879 nt, synthetic construct
  misc_feature 1..9879: note = derived and/or modified CDS sequence (opt3) from DENV-1__GU131680__SS-prME
  source 1..9879: mol_type = other RNA
agcgtgaccatgctgctcatgcttatgcccacagccctggctttccacttgactacgagaggcggggagcctcatatggtcgtttccaagcaggaaaggggaaaatctttactgtttaagacctcagcaggtgtgaacatgtgcacactaatcgccatggacctcggcgagctgtgtgaagatactatgacctacaaatgcccacggattacagaggcggaaccggacgatgtagactgttggtgcaatgctaccgatacttgggtgacatatgggacctgtagtcaaacgggagagcaccgccgagagaagcgtagcgtcgcccttgcaccccatgtgggcctgggtttggaaactagaaccgagacatggatgtcctctgaaggggcctggaaacagatacagagggttgagacttgggctctccggcaccctggattcaccgtgatcgcactgtttctggcccatgctattggcacatcgatcacccagaagggcattatcttcatactcttaatgctggtcacgccatcaatggccatgcgctgcgtggggatcggaagcagagactttgtagagggtcttagtggcgcgacttgggttgatgtggtcttggaacacgggtcctgtgtgacaaccatggcaaaggacaaacccactctggatattgagctactcaagacagaagtgaccaaccctgccgtcctgaggaaactttgcatcgaggctaagatttctaatacgaccacagacagccggtgtccaactcaaggagaagccaccctggttgaggagcaggatgcaaacttcgtgtgccgccgaacatttgtagacagaggctggggtaatgggtgtggattgttcggcaaaggctccctcctgacttgcgctaagtttaagtgcgtgaccaaattagaagggaagatcgtccagtacgagaacctgaaatattcagtgatagttacagtgcacaccggagatcagcatcaagtcggtaatgaaagtactgagcacggcacgacagccaccattactccccaggcgcctaccacagaaatccagctcaccgactacggggcccttactctggactgtagcccaaggacaggattggatttcaacgagatggtgctactgacgatgaaggagaaatcttggctcgtacataagcagtggtttctggaccttccgctgccctggacctccggcgcatcaactagccaagaaacatggaatcggcaggatttgctcgttaccttcaaaacagctcacgccaagaagcaggaggtggtcgtgctgggtagtcaagaaggggctatgcacactgccttaaccggcgcaacggagattcagacctctggaacaactaccatctttgccggccatctgaaatgccgtctaaagatggacaaactcacactgaaggggatgtcctatgtcatgtgtactggaagcttcaaacttgaaaaggaggtggctgagacccagcacggtacggttttggtgcagatcaagtacgaaggcacagatgcgccttgcaaaattccattctcgacccaagacgagaagggggtaactcagaacggacgcctgataacagcaaatcccatcgtcaccgataaagaaaagcctgtgaacattgaggccgagccaccctttggcgaatcttatatcgttataggtgctggggagaaagccctcaagctgtcctggttcaagaaaggctcaagtattggaaagatgtttgaagcaactgccagaggcgctaggcggatggccatccttggggacaccgcatgggatttcggaagcatcggtggcgtgtttacatccgtcgggaaactggtgcatcagattttcggaacggcgtacggcgtattgttttctggtgtgagctggaccatgaagatcgggattggcgttctcctgacttggttaggactgaattcacgaagtacatccctaagcatgacctgtatagctgtcggcctcgtgacactgtaccttggggtgatggtccaggccgactctggatgcgttatcaactggaaaggccgcgagttgaagtgtggttcagggattttcgtgactaatgaagtgcacacctggacggagcaatataagtttcaggcagatagtccgaaaagactgagcgccgctatcggaaaggcctgggaggaaggcgtatgcggtatcaggtccgcaacacggctcgagaacattatgtggaaacagatatctaacgaactgaatcatatcttactggagaacgacatgaagttcaccgtcgtggttggcgacgtggctgggattcttgtccagggaaaaaagatgatccgccctcaacccatggaatacaaatattcgtggaagagctggggcaaggccaaaattatcggggcggatgtgcagaattccacttttataatcgacggaccaaacacccctgagtgtcccgatgaccagagagcctggaatatttgggaggttgaagattacggcttcggtatctttacaactaacatttggttgaagctcagggactcatatacccaggtgtgcgatcaccgtctgatgagtgctgcaatcaaagactctaaggccgtacacgctgatatggggtactggatagagagcgaaaaaaatgagacatggaagctagcccgggcatccttcattgaagtcaagacgtgtatctggccaaaatcacataccctgtggagcaacggagtgctcgagtctgagatgattatccccaagatacacggcggtcctatctcccaacataattatcgaccaggctacttcactcagacagcggggccgtggcacctgggaaaacttgaattggactttgatctgtgcgagggcaccactgtggtcgttgacgaacactgcgggaacagaggacccagtttaaggacaaccacggtgactggcaagattatccatgagtggtgttgccgcagctgtaccctccctccactgcggttcagaggtgaggatgggtgctggtacggaatggaaattaggcccgtaaaagagaaggaagagaatcttgtgaagtctatggtctccgccggctcaggtgaagtggacagttttagcctgggcttgctctgtatctcgataatgattgaggaggttatgcgctcccgatggtctcggaaaatgctgatgacagggaccctagctgtgttctttctgctcatcatgggacagctgacttggaacgaccttatccgtttgtgcattatggtcggcgccaatgcaagcgatagaatggggatgggaacaacctatctggctttaatggccacattcaagatgaggcctatgtttgcagtgggcctcctgttccgccggcttacttcaagagaagttctgctactcaccatcggtctgagtttggtggcctccgtcgagctgccaaactctttagaagagctcggggacggactggctatgggcattatgatacttaaactgttgacggattttcaaagctaccagctctgggcgacactgctatccctgaccttcatcaagactaccttttcacttcactatgcctggaaaacaatggcaatggtactcagcattgtgagtctgttccccttgtgtctgtctactacctcccagaagacgacatggttaccggttctcctgggcagccttgggtgcaagcctctgaccatgtttttgatcgctgaaaataaaatttggggaaggaagtcgtggccactcaacgagggtatcatggccgtgggcatagtctcaatcctgctatctagtctgcttaaaaacgacgtgcccctcgccgggcctctgattgctggaggcatgttgatcgcatgttacgtaatttccggtagctctgccgatttaagcctggagaaggcggctgaagtgtcctgggaggaagaggccgaacattcaggggcaagtcacaatatcctcgtcgaggttcaggacgatggaactatgaaaataaaggacgaggaacgagatgacacactgaccattcttctgaaagccactttgctagctgtgagcggcgtgtatcccctgtctatcccagcaacactcttcgtctggcatttctggcaaaagaagaaacagcgctccggcgtgctgtgggataccccttcacccccagaggttgaacgggccgtacttgacgatgggatctacagaattatgcagaggggattactgggtcgtagtcaggtgggcgtcggggtgtttcaagagaacgttttccacacgatgtggcacgtgactcgcggagcggtcctcatgtatcagggcaagcggttggagccgagctgggcttccgtgaaaaaggacctgatatcttacggtgggggatggagatttcagggctcgtggaataccggcgaagaggtacaggtcatcgccgtggaacctgggaaaaaccccaagaatgttcaaacagcaccaggaaccttcaagacacccgagggtgaagtgggcgccattgctctcgactttaaacctgggactagcggatcaccaatcgtcaacagggagggcaagattgtgggtctgtacgggaatggagttgtgaccacgtccggcacatatgtcagtgccatcgcacaggctaaagcctctcaggagggcccccttcctgaaatagaggatgaagtgttccgaaagcggaacctgactatcatggacttgcatccggggagcggaaaaacccgcagatacctaccagcgattgtaagggaggccatcaagcggaagctgcgaacactcattttagcacccaccagagtggttgcttccgaaatggccgaggctctgaaaggtatgcctatccgctatcaaactaccgcagtcaagtcagagcacacaggcaaagaaatagtggatcttatgtgccatgccacgtttactatgaggctgctctctccagtgcgtgtccccaattacaacatgattatcatggacgaggcccacttcaccgatcctagcagtatcgctgcgcgggggtatatttccacaagagtaggaatgggcgaagcagccgctatctttatgaccgccactccgcccggtagcatggaggcattcccacagtctaatgccgtgatacaggacgaagagagggatattcctgagcgctcatggaactccgggtacgaatggatcacagactttcccggaaagaccgtttggttcgtgccaagtattaaagctggcaatgatatcgcgaactgtttgcgaaagaatggcaagagagtcatacagctgagccggaaaacgttcgacactgagtatcaaaagacaaaaaacaacgattgggactacgtggttaccaccgacatttcggaaatgggggccaattttagggcagatcgcgtgatcgaccctcgtagatgcctcaagcccgtcatcctgaaagatggaccagagcgggtgattcttgctggtccgatgcctgtaactgtggcctctgcagcccagaggcgcggccgaatcgggagaaaccataataaggagggagaccagtacatttatatgggccagcccctaaacaatgatgaagaccacgctcactggacagaggccaagatgctgttggataacataaataccccagaaggtatcattcccgcgttattcgagcctgaacgggagaaatccgcagccatcgacggggagtacaggctgcgcggcgaagctagaaagacatttgttgagctcatgaggcggggagatctgccagtctggcttagctataaagtggcctcagaaggcttccaatacagtgaccgtcgctggtgctttgatggggagcgaaacaatcaggtgctggaagagaacatggacgtcgagatctggactaaggaaggagagagaaaaaagctcaggccccggtggttggatgctcgcacgtattctgaccctctggcactaagagaattcaaagagtttgccgctggtaggcggtccgttagcggcgacctgattctcgaaatagggaagcttccgcagcatctgacccagcgagcccaaaatgcattagataacttggtgatgctgcacaattcagagcagggaggcagagcgtaccgccatgccatggaggaactcccagacacaatcgagactctgatgcttctggctctcattgccgtattgaccggtggggtgacactgttctttttaagtggcaagggactaggcaaaaccagcatcgggctgctctgtgtcatggcatcctctgtgcttctgtggatggctagcgttgaaccccactggattgccgcatccatcatattggagttctttctgatggtgctcctgatccctgagcccgataggcagcggactccacaggacaaccaacttgcctatgtcgtaattggactcctgttcatgatcttgacggtggctgcgaatgaaatgggtctgttagagaccacaaagaaagatctaggcattgggcacgttgccgtggaaaaccatcaccatgcagctatgctggacgtcgatctccaccctgcctcagcctggactctttacgcagtggctaccacaatcataacccccatgatgcgtcatactattgagaacacaacggccaatatctctctgaccgcgattgctaaccaggccgcaatcttgatgggactggacaagggctggccaataagtaaaatggatatcggtgtccctctcctggcccttgggtgctactcgcaggtgaatccgttaactctgacagctgcagttctcatgttggtggcccactatgcgattatcggccccggactgcaagctaaggccaccagagaagcacagaagaggaccgccgctggcattatgaaaaacccaacaatcgacgggatagtagccattgatctagaccctgtggtctacgatgcaaagtttgagaaacagctgggacagatcatgctccttatcctgtgtactagccaaattttgctgatgcgcacgacctgggctctctgcgagtccatcacactggccactggccccttaaccacactttgggaaggttctccagggaagttctggaataccactatagcggtttcaatggccaacattttccggggaagctatctggcaggcgctggtctcgccttttccctaatgaaaagtctgggcgggggacgaagaggcacgggggcacagggagagacattgggcgaaaagtggaagaggcagctgaatcagctctctaaaagcgagttcaacacctacaagcgctcaggtatcatggaagtggaccggtccgaggctaaagaggggcttaagagaggagaaactaccaaacacgccgtcagtcgtggcacagccaagctgaggtggtttgtggagcggaatttggtaaagcctgaaggtaaagtgattgacctgggctgtgggcgcggaggctggagctattactgcgcggggctcaagaaagttactgaggtgaagggatataccaaaggcggtcccgggcatgaagagccgatcccaatggctacatacggatggaacttagtcaagctgcactctggcaaagatgtgttctttatacctcccgagaagtgtgacacgcttctgtgcgatatcggcgaatcctcaccaaatcccaccattgaggaagggcgaactctaagagtcctcaagatggtggagccttggctgaggggaaaccaattctgtatcaaaattttgaatccgtacatgcccagcgttgtagagacactggaacagatgcagcggaagcatggtggcatgctcgtgcgcaacccactttcgagaaattctacccacgagatgtattgggtcagttgcgggactggaaacatcgtgtccgcagttaatatgacaagcaggatgctgttaaaccgatttaccatggcccaccggaaacctacgtacgaacgtgacgtggatctgggcgctggtaccagacatgtcgccgtggagcccgaagtagcaaacttggacattatcgggcagcgcatagagaatattaagcacgagcataaatcaacatggcactatgatgaagacaacccttacaagacttgggcctatcatggatcctacgaggtgaagccatctggcagcgctagttccatggttaatggcgtcgtgaaactcctgaccaagccctgggatgtgatccctatggtcacacaaatcgcgatgactgacaccacaccattcgggcagcagagggtttttaaagaaaaggtggatacccggactcccaaagccaagagaggaacggcacaaattatggaggtaacagctcgctggctatggggtttccttagcaggaacaagaaaccgcgaatatgtacccgggaagagtttactagaaaggtgaggtctaatgccgcaatcggcgccgtcttcgtggacgagaaccagtggaattcagctaaagaagccgttgaggacgatcgcttttgggacctggtgcaccgtgaacgggagctccacaagcaggggaaatgcgcgacctgcgtctataacatgatgggaaagagagaaaagaaactgggcgagttcggtaaggcaaaagggagtagggccatttggtacatgtggttgggagctcgcttcctggagtttgaagccctcggcttcatgaatgaggatcattggttttcccgagaaaacagcctttctggcgtggagggggagggactgcacaagttaggttacatcctgcgggacatttcgaaaatccctggcgggaatatgtatgcagatgacacagctggatgggatacgagaataaccgaagacgatttgcagaacgaggccaagatcactgacattatggaaccagagcatgctctcctggccaaatcaatcttcaagctaacataccaaaataaggtagttagggtgcagcgccccgcaaaaaacggcaccgtcatggatgtgattagcagacgggaccagaggggttccgggcaggtgggaacttatggccttaatacatttaccaacatggaagcgcaactgatccgtcagatggagagtgagggcatattcctccctaacgaactggagacaccaaatttggccgggcgagtcttagattggctggaaaagtacggagttgagcgcctcaaaagaatggctatttctggtgacgactgtgtggtaaagcccatcgatgaccggtttgccactgcacttaccgctctgaacgatatgggcaaagtgaggaaggacatcccgcagtgggaacctagcaaggggtggaatgattggcagcaagtccccttctgctcccaccactttcatcagctaattatgaaagacggacgcgagatagtggttccatgtagaaaccaggatgagctggtgggccgggccagggtctcacagggtgcagggtggagtctccgagaaacggcctgcttgggaaagtcttatgcgcaaatgtggcagctgatgtacttccaccgtagagaccttcgcctggctgccaatgcaatctgtagcgccgtgcctgtagattgggttcccacctcccggacaacttggtcaattcatgctcaccatcagtggatgaccacagaggacatgctcagcgtgtggaacagggtctggatcgaagagaatccatggatggaagataaaactagaatttcttcctgggaggacgtgccctatttaggcaagcgcgaggaccaatggtgcggcagtctgatcgggttgaccgcccgggcaacgtgggctacaaacatacaggttgccatcaatcaggtgaggcgactgattggaaacgaaaattacagcgattacatgacctcgatgaaaagatttaagaacgagtccgaacctgagggtgcgctctggtga

SEQ ID NO: 13873 - RNA, 9879 nt, synthetic construct
  misc_feature 1..9879: note = derived and/or modified CDS sequence (opt3) from DENV-1__GU131681__SS-prME
  source 1..9879: mol_type = other RNA
agcgtgaccatgctgctcatgcttatgcccaccgcactggctttccacttgactacgaggggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaaaaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaaggtgctcatgaccgggactctggctgttttcctactgctcattatgggacagctgacatggaacgatcttatccggttgtgcattatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgataggtctgtcattggttgccagtgtggaactgccaaactccttagaggaactcggggatggactggctatgggcatcatgattcttaagctgttgacagacttccaatctcaccagctctgggcgaccctgctaagcctgacttttatcaaaaccacactttccctccattacgcctggaagactatggcaatggtcctgtcaattgtcagcttgttccccctgtgtttaagtaccacgtctcagaagacaacctggctcccggtgctgcttggctccctggggtgcaaacctttgactatgtttctcatcgctgagaataagatatggggaagaaaaagctggccactgaacgaaggtatcatggccgttggcgtggtctcgattctactgtcatctcttctcaagaacgatgtgcccctggccgggcctttgatcgctggaggcatgttaattgcatgttatgtaatcagtggttccagcgccgacctgtctctcgagaaagcggctgaggtgagctgggaagaggaagccgagcactccggggcatcacataatatactggtcgaagttcaggatgacggaacaatgaagattaaagatgaggagagggacgatacccttactatcctgttgaaggccacactactggctgtgagtggcgtgtaccccctcagcatcccagcaaccctgttcgtctggtatttttggcaaaagaaaaagcagcgatctggcgtgctttgggacacgccttcacccccagaagttgagcgcgccgtattagatgacgggatttaccggataatgcagagaggactgctcggtaggagccaggtgggcgtcggggtgttccaagaaaacgttttccacactatgtggcacgtgacccgtggagcggtcttgatgtatcagggcaaacgcctggagccgagttgggctagcgtgaagaaagacctcatctcctacggtgggggatggcggctgcagggctcttggaatacaggcgaggaagtacaggtcattgccgtggagcctgggaagaaccccaagaatgttcaaaccgcaccaggaacatttaaaactcccgaaggtgaggtgggcgccatcgctcttgatttcaagcctgggacctcgggaagcccaattgtcaacagagaaggcaaaatcgtgggtctgtacgggaatggagttgtgacgacatcaggcacttatgtctccgccatagcacaggctaaggccagtcaggagggccccttgcctgagatcgaagacgaggtgtttaggaaacgaaacctaaccattatggatctgcatccggggtctggaaagacacggcgctacctcccagcgatcgtaagagaagccattaagaggaaattacggaccctgatccttgcacccactcgagtggttgctagcgagatggccgaagctctgaagggtatgcctataagatatcaaaccacagcagtcaaatccgagcacacgggcaaggagattgtggacctcatgtgccatgccactttcaccatgcgcttgctgtcaccagtgagggtccccaattacaacatgatcatcatggatgaagcccactttacagacccttctagcattgctgcgcgtgggtatatcagtacccgggtaggaatgggcgaggcagccgctatattcatgactgccacaccgcccggttccgtggaagcatttccacagagcaatgccgttattcaggatgaggaaagagacatccctgagaggtcttggaactcagggtacgagtggattaccgatttccccggaaaaacggtgtggtttgtcccatccatcaagagtggcaatgacatagctaactgtctccgcaagaatggcaaacgagtgattcagctgagcagaaagactttcgatacagaatatcagaaaaccaagaacaacgactgggactacgttgtgaccactgatatctcggagatgggggcgaattttcgggccgacagggtcatcgatcctcgccgttgccttaaacccgtgattctaaaggacggaccagaaagagtaatcctggcaggtccgatgcctgtgacagttgcttctgccgcacagcggaggggccgcattgggcgaaaccataataaggagggagatcagtacatatatatgggccagcccttgaacaatgacgaggatcacgcccactggaccgaagctaaaatgttactggacaacatcaatacaccagagggtattatccccgccctcttcgaacctgagagagaaaagtccgcggcaatcgatggggagtaccggctgaggggcgaggcccgcaaaactttcgtcgaacttatgagaaggggagacctgccagtgtggctcagctataaggtggcttcagagggctttcaatacagtgatcggcgttggtgcttcgacggggaacgcaacaatcaggtcttggaggaaaacatggatgttgagatttggacgaaagagggagaacgaaagaaactgagacccaggtggctagacgcccggacctattctgaccctctggctctccgcgagtttaaggagttcgcagccggtagaaggtccgtgagcggcgatcttatactggagatcgggaagttaccgcagcatttgacacagcgggctcaaaatgccctggacaacctcgtaatgctgcacaattcagaacagggaggccgagcatacagacatgcgatggaggagcttccagatactattgaaaccctgatgctcttggccctgatcgctgtgttaacaggtggggtcaccctatttttcctgagtggccgcggactcggcaaaactagcattgggcttctgtgtgtgatggcctcctctgttttgctgtggatggcaagcgtggagccccactggatcgctgcctccataatcctcgaatttttcctgatggtccttctcattcctgagcccgacaggcagcggacgccacaggataaccaactggcatatgtagtgatcggattgctgtttatgattttaaccgttgccgctaatgagatgggtctactggaaacaactaagaaagacctcggcatcgggcacgtggcggtcgagaaccatcaccatgccaccatgcttgatgtggacctgcaccctgcatcagcttggacattgtacgccgtcgccaccactataattacacccatgatgcgtcatacgatcgaaaacaccactgcaaatatttctctgacagctatcgccaaccaggcggctatactcatgggactggataagggctggccaatcagtaaaatggacattggtgtgcctcttttagccctggggtgctactcgcaggttaatccgctcaccttgaccgcagccgtgctgatgctagtagctcactatgcaatcattggccccggactgcaagccaaggcgacaagagaggctcagaagaggactgccgcaggcatcatgaaaaacccaacggtggatgggatagtcgccattgacctcgatcctgttgtgtacgacgctaagttcgaaaaacagcttggacagatcatgctgttgatcctgtgtaccagccaaattctcctgatgcgcacaacttgggccttatgcgagtccatcacccttgcaacaggccccctgaccactctctgggagggttctccagggaagttttggaatacgacaatagctgtctcaatggccaacattttccggggaagctatctagcgggcgccggtctggcattttccttgatgaaaagtctgggcgggggacgaagaggcaccggggctcagggagaaactctcggcgagaagtggaagaggcagcttaatcagctgtctaaaagcgagttcaacatctacaagcgctcaggtattatggaggtggaccggtccgaagccaaagaggggttgaagagaggagagaccacacgtcacgcagtaagtaggggcactgctaaactgcggtggttcgtggaacgcaatctcgttaagcctgagggtaaggtgatcgatttaggctgtgggcgaggaggctggagctattactgcgccgggctgaaaaaggtcaccgaagtgaaaggatatacaaagggcggtcccgggcatgaggaaccgataccaatggccacgtacggatggaaccttgtcaaactgcactctggcaaggacgtgtttttcacccctcccgagaaatgtgatactctactctgcgacatcggcgagtcctcaccaaatcccacaattgaagaggggagaaccctgagggttttgaagatggtagaaccttggctgcggggaaaccaattttgtatcaagattctcaatccgtacatgcccagcgtggtcgagactcttgagcagatgcagcgcaaacatggtggcatgctggtgagaaacccattatcgagaaattctacacacgaaatgtattgggttagttgcgggaccggaaacatcgtgtccgcggtcaatatgacgagccgaatgctgttgaaccggttcaccatggctcaccgtaagcctacatacgagagagatgtggacctcggcgcaggtactcgccatgtagccgtggaacccgaggttgctaacctggatattatcgggcagaggatagaaaatattaaacacgagcataagtcaacctggcactatgacgaggataacccttacaaaacatgggcctatcatggatcctacgaagtcaagccatctggcagcgcaagttccatggtgaatggcgtggtcaagctacttactaaaccctgggacgttatccctatggtgacccaaatcgccatgacagataccactccatttgggcagcagcgggtattcaaggagaaagtggacacgagaacacccaaggctaaacgcggaaccgcgcaaattatggaagtcactgccaggtggctgtggggttttctcagccgaaacaagaagccgcggatatgtaccagagaggagttcacaaggaaagtgcgctctaatgcagctatcggcgccgtttttgtggacgagaaccagtggaactcagcaaaggaggccgtcgaagatgagcgtttctgggacctggtgcagaaagaacgggagttgcacaagcaggggaaatgcgctacgtgcgtatataacatgatgggaaagagagaaaagaaactgggcgagtttggtaaggccaaagggagtagggcgatttggtacatgtggctcggagcacgcttccttgagtttgaagccctgggcttcatgaatgaggatcactggttctcccgagaaaacagcttatctggcgttgagggggagggactgcataagttgggttacatcctccgggacatttcgaaaatccctggcgggaatatgtatgctgatgacaccgccggatgggatactagaataacagaagacgatctgcaaaacgaggcaaagatcaccgacattatggaaccagagcacgctctacttgccacttcaatctttaaactgacataccagaataaggtggtcagggtgcagcgccccgctaagaacggcaccgtgatggatgtcattagcagacgggaccagaggggttccgggcaagttggaacatatggcctcaatactttcaccaacatgggcgcccagctgatccgtcagatggaaagtgaggggatattttctcctagcgagttggaaattccaaacttagcagagcgagtgctggattggctcgaaaaatacggagtagagcgccttaagagaatggcgatctccggtgacgactgtgtggtcaaacccatcgatgaccggttcgccacggctctgaccgccctaaatgatatgggcaaggtgaggaaagacgttccgcagtgggaaccttcaaaggggtggaacgattggcaacaggtgcccttttgcagtcatcacttccaccagctgattatgaaggacggacgcgagatagtcgtgccatgtagaaatcaggatgagctcgtaggccgggcaagggtttctcaaggtgctgggtggagcttgcgagaaacagcctgcctgggaaaatcctatgcacagatgtggcagcttatgtactttcatcgtagagacctgcgcctcgccgcgaacgctatctgttcagccgtgcctgtcgattgggtgcccactagccggaccacatggtctattcacgcacatcaccaatggatgactaccgaggacatgttatccgtttggaatagggtgtggatcgaagagaacccatggatggaagataagacgcatgtcagtagctggggcgacgtgccctatctgggcaaaagagaggaccagtggtgcgggtcgttgattggactgacagcccgcgctacctgggcctccaatatccaggtagcaataaaccaggtgcggaggctcatcggtaatgagaactaccttgattacatgacttctatgaagcgattcaaaaatgaaggcgaccctgagggggctctgtggtga

SEQ ID NO: 13874 - RNA, 9879 nt, synthetic construct
  misc_feature 1..9879: note = derived and/or modified CDS sequence (opt3) from DENV-1__GU131682__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgtgatcggcacctcgattacgcagaagggcatcatattcatcctcttaatgctggtcactccatcaatggccatgcgctgcgtggggattggaagcagagattttgtagagggtcttagtggcgctacatgggttgacgtggtcttggagcacgggtcctgtgtgaccactatggccaaggataaacccacactggacatcgaactactcaagaccgaggtgacgaaccctgcggtcctgaggaaactttgcattgaagcaaagatctctaataccacaactgatagccggtgtccaacccaaggagaggccacactggttgaagaacaagacgctaacttcgtgtgccgccgaacttttgtagatagaggctggggtaatgggtgtggattgttcggcaaaggctccctcataacctgcgccaagtttaagtgcgtgacaaaactggaggggaagattgtccagtacgaaaacttaaaatattcagtgatcgttaccgtgcacactggagaccagcatcaagtcggtaatgagagtacggaacacggcacaaccgcaactattacaccccaagctcctaccaccgagatccagctgactgactacggggccctcacacttgattgtagcccaaggacgggactggacttcaacgaaatggtgttgctaaccatgaaggagaaatcttggctggtacataagcagtggtttctcgatctgccgcttccctggacttccggcgcgtcaacaagccaagagacctggaatcggcaggacctgttggttacattcaaaactgcccacgcaaagaagcaggaagtggtcgtgctcggtagtcaagagggggctatgcacaccgccctgacgggcgctaccgaaatccagacatctggaactaccacaatttttgccggccatttaaaatgccgtctgaagatggataaactaactctcaaggggatgtcctatgtcatgtgtaccgggagcttcaaactggagaaggaagtggcagagacgcagcacggtacagttcttgtgcagataaagtacgagggcaccgacgccccttgcaaaatcccattctcgactcaagatgaaaagggggtaacacagaacggacgcttgattaccgctaatcccatcgtcactgacaaagagaagcctgtgaacatagaagcggagccaccctttggcgagtcttatattatcatcggtgcaggggaaaaagccctgaagctctcctggttcaagaaaggctcaagtattggaaagatgtttgaggctaccgccagaggcgcaaggcggatggccatcctgggggatacagcttgggacttcggaagcattggtggcgtttttacgtccgtggggaaacttgtccatcagatattcggaaccgcctacggcgtgctgttttctggtgtaagctggactatgaagatcgggattggcgtgttgctcacatggctgggattaaattcacgaagtacctccctgagcatgacatgtatcgcagttggcctagtcactctctacctgggggtgatggtgcaggcggattctggatgcgtcatcaactggaaaggccgcgaacttaagtgtggttcagggattttcgttaccaatgaggtgcacacgtggacagaacaatataagtttcaggctgacagtccgaaaagattgagcgccgcaataggaaaggcctgggaggagggcgtgtgcggtatcaggtccgctacccggctggaaaacattatgtggaaacagatctctaacgagctcaatcatattctgttagaaaacgacatgaagttcactgtagtcgtgggcgatgttgccgggatcctggcacagggcaaaaagatgatacgccctcaacccatggagcacaaatactcgtggaaaagctggggcaaggctaagatcattggggccgacgtgcagaataccacatttatcattgatggaccaaacactcctgaatgtcccgacgatcagagagcgtggaatatctgggaggtcgaggactatggcttcggtatatttaccacaaacatttggcttaagttgagggattcctacacacaggtgtgcgaccaccgtctcatgtcagccgctatcaaagatagtaaggcagttcatgccgacatggggtattggattgaatctgagaaaaatgaaacctggaagctggctcgggccagcttcatcgaggtgaagacttgtatatggccaaaatcccacacactatggtcaaacggagtactggaaagcgagatgatcattcccaagatctacggcggtcctatttctcaacataattatcgaccaggctacttcacccagactgcagggccgtggcacctcggaaaactggagcttgattttgacttgtgcgaaggcacaaccgtcgtggtggatgagcactgcgggaacagaggaccctccctgaggacgactaccgtcacaggcaagatcatacatgaatggtgttgccgcagttgtaccttacctccactccggttcagaggtgaggacgggtgctggtacggaatggagattaggcccgttaaagaaaaggaggaaaatctggtgaagtccatggtatctgcgggctccggtgaggtggactcatttagtcttggcctgttgtgtatcagcatcatgattgaagaggtcatgcgctcgcgatggtcccggaaaatgctcatgactgggacactggccgtgttctttctactgatcatgggacagctcacctggaacgatctgattcgtctttgcataatggttggcgctaatgcctctgacagaatggggatgggaacaacttatttggcactgatggctaccttcaagatgaggcctatgtttgccgtgggcttactcttccgccggctgacgagcagagaggtccttctgctaacaatcggtctctcactggtggcaagtgttgaattgccaaactccctggaggaattaggggatggactcgccatgggcattatgatcctgaaacttctgaccgactttcaatctcaccagttgtgggctactctcctgagcctaaccttcattaagacaactttttccctgcattacgcgtggaaaaccatggccatggtgctttcaatcgtcagcctcttccccctgtgtttgagtacgacatctcagaagaccacttggctgccggtattactcggctccctggggtgcaagcctcttacaatgtttctgatagcagagaataaaatctggggaaggcgaagctggccattgaacgaaggtattatggctgtgggcatcgtttcgattctcctgtcatctctactgaagaacgatgtgccccttgccgggcctctcatcgccggaggcatgctgatagcttgttatgtcattagtggttccagcgcagacttgtctttagagaaagccgcggaggtgagctgggaagaggaagctgagcactccggggcctcacataatatcctggtagaagtgcaggatgacggaaccatgaagatcaaagatgaggagcgcgacgatactctcacaattctgcttaaggcaaccctgttggccgtcagtggcgtttaccccctaagcataccagctacgctgttcgtgtggtatttctggcagaaaaagaagcagcggtctggcgtgctctgggacactccttcacccccagaagtcgagagagcagtgctggatgacgggatctacaggattatgcagcgtggacttttaggtcgcagccaggttggcgtaggggtgtttcaagaaaacgtcttccacaccatgtggcacgtgacacggggagccgttctgatgtatcagggcaaaagactcgagccgagttgggcgagcgtgaagaaagacttgatctcctacggtgggggatggaggctgcagggctcttggaataccggcgaggaagtccaggtgattgctgtagagcctgggaagaaccccaaaaatgtccaaacagccccaggaacttttaagacccccgaaggtgaggtgggcgcaatcgccctcgatttcaagcctgggacgtcgggaagcccaatagttaaccgagaaggcaaaatcgtgggtctgtacgggaatggagtcgtgacaacttcaggcacctatgtttccgctattgcccaggcaaaggctagtcaggagggcccccttcctgagatcgaagacgaggtgtttcggaaacgcaacctgacaattatggatttgcatccggggtctggaaagaccagaaggtacctaccagccatcgtccgggaagcgataaaacgaaagctgagaactctcattttagcccccacccgcgtggtagcaagcgagatggctgaagccctgaagggtatgcctatcaggtatcaaacaacggctgtgaaatccgagcacactggcaaggagatcgttgaccttatgtgccatgcaaccttcacaatgcgtctgctctcaccagtccgggtgcccaattacaacatgattatcatggatgaagcccactttaccgacccttctagcatagccgctagagggtatattagtactagggtgggaatgggcgaggcggcagccatcttcatgacagctaccccgcccggttccgtcgaagcctttccacagagcaatgcagtaattcaggatgaggaacgcgacatccctgagcgatcttggaactcagggtacgagtggataacggatttccccggaaaaactgtgtggtttgttccatccattaagagtggcaatgacatcgccaactgtttgaggaaaaatggcaagcgggtgatccagctgagcaggaagacattcgataccgaatatcagaaaaccaagaacaacgactgggactacgtcgtgactacagatatttcggagatgggggctaatttccgcgcggaccgtgttatcgatcctagacggtgcctcaaacccgtgattctgaaggacggaccagaaagggtcatacttgccggtccgatgcctgtgaccgtagcatctgctgcccagcgccgaggcagaatcgggcggaaccataataaagagggagatcagtacatttatatgggccagcccctaaacaatgacgaggatcacgcacactggacagaagccaagatgctgttggacaacatcaatactccagagggtatcattcccgctttatttgaacctgagagggaaaagtccgccgcgatagatggggagtaccgcctgagaggcgaggcaaggaaaacgttcgtggaactcatgcggcgtggagacctgccagtttggcttagctataaggtcgcctcagagggctttcaatacagtgatcgccgatggtgcttcgacggggaaagaaacaatcaggtgctggaggaaaacatggatgtggagatctggaccaaagagggagaaaggaagaaactccggccccgctggttggacgctagaacatattctgaccctctggccctaagggagtttaaggagttcgctgcaggtcggcgatccgtcagcggcgatctgattctcgagatcgggaaacttccgcagcatctgactcagagagcccaaaatgctttagacaacttggttatgctgcacaattcagaacagggaggccgcgcctacaggcatgcaatggaggagctcccagataccattgaaacactgatgcttctggcgctcatcgccgtgttgaccggtggggtaactctgtttttcttaagtggccggggactaggcaagacgagcatagggctgctctgtgtgatggcttcctctgtccttctgtggatggccagcgtggagccccactggatcgcagcttccattatcttggaatttttcctgatggttctcctgattcctgagcccgaccgtcagagaaccccacaggataaccaacttgcctatgtggtcatcggactcctgtttatgatattgacagtagcagccaatgagatgggtctgttagaaactaccaagaaagacctaggcattgggcacgtggctgttgagaaccatcaccatgcggccatgctggatgtggacctccaccctgcatcagcttggacactttacgccgtcgccaccactatcattacacccatgatgaggcatacgatcgaaaacaccactgcaaatatatctctgacagctatcgccaaccaggcggctattttgatgggactggataagggctggccaatcagtaaaatggacattggtgtgcctctcctggcccttgggtgctactcgcaggtcaatccgttaaccctgaccgcagccgtgctcatgttggttgctcactatgcaatcataggccccggactgcaagccaaggcgacacgcgaggctcagaaacggactgccgcaggcattatgaagaacccaacggtggatgggatcgtagccatcgacctagatcctgtggtctacgacgctaagttcgaaaaacagctgggacagattatgctccttatcctgtgtaccagccaaatattgctgatgcgaacaacttgggccctctgcgagtccattaccctggcaacaggccccttaaccactctttgggagggttctccagggaagttttggaatacgacaatcgctgtttcaatggccaacattttcagaggaagctatctggcgggcgccggtctcgcattctccctaatgaaaagtctgggcgggggaaggcgcggcaccggggctcagggagaaactttgggcgagaagtggaaacggcagctgaatcagctctctaagagcgaatttaacacctacaagagatcaggtatcatggaggtggaccgttccgaagccaaagaggggcttaagaggggagagacaactaaacacgcagtcagtcggggcaccgctaagctgcgctggttcgtggaacgaaatttggtaaaacctgagggtaaggtgatagatctgggctgtgggagaggaggctggagctattactgcgccgggctcaagaaagttacagaagtgaagggatatacgaaaggcggtcccgggcatgaggaaccgatcccaatggccacctacggatggaacttagtcaagctgcactctggcaaagacgtgtttttcattcctcccgagaagtgtgatactcttctgtgcgacatcggcgagtcctcaccaaatcccacaattgaagaggggaggaccctacgggtcctcaaaatggtggaaccttggctgcgcggaaaccaattttgtatcaagattttgaatccgtacatgcccagcgttgtagagactctggagcagatgcagagaaagcatggtggcatgctcgtgaggaacccactttcgcgaaattctacacacgaaatgtattgggtcagttgcgggaccggaaacatcgtgtccgcggttaatatgacgagccggatgctgttaaaccgtttcaccatggctcacagaaaacctacatacgagcgcgatgtggacctgggcgcaggtactaggcatgtcgccgtggaacccgaggtagctaacttggatataattgggcagcggatcgaaaatatcaagcacgagcataaatcaacctggcactatgacgaggataacccttacaagacatgggcctatcatggatcctacgaagtgaaaccatctggcagcgcaagttccatggttaatggcgtcgtgaagctcctgactaagccctgggacgtgattcctatggtcacccaaatagccatgacagataccactccatttgggcagcagagagttttcaaagagaaggtggacacgcgcacacccaaagctaagaggggaaccgcgcaaatcatggaagtaactgccaaatggctatggggttttcttagccgaaacaagaagccgcggatttgtaccagagaggagttcacaaggaaagtgcgctctaatgcagctatcggcgccgtctttgtggacgagaaccagtggaactcagcaaaggaggccgttgaagatgagcgtttctgggacctggtgcaccgggaaagagagctccacaaacaggggaagtgcgctacgtgcgtctataacatgatgggaaaaagggaaaagaagctgggcgagtttggtaaagccaaggggagtcgcgcgatttggtacatgtggttgggagcacgattcctggagttcgaagccctcggctttatgaatgaggatcattggttctcccgggaaaacagcctttctggcgtggagggggagggactgcacaaattaggttacatcctgagagacatatcgaagatccctggcgggaatatgtatgctgatgacaccgccggatgggatactaggattacagaagacgatttgcagaacgaggcacgcatcaccgacattatggaaccagagcatgctctcctggccaaatcaatctttaagctaacttaccaaaataaagtagttagagtgcagcggcccgctaagaacggcacagtcatggatgtgataagcaggcgtgaccagcgaggttccggacaggtgggaacctatggccttaatacattcactaacatggaagcccaactgattcgccagatggagagtgagggcatcttttctcctagcgaactcgagaccccaaacctggcagaaagagtcttggattggttagagaagtacggggttgaacggctgaaaaggatggcgatctccggagacgactgtgtggtaaagcccattgatgaccgcttcgccacggctctcaccgcccttaatgatatgggtaaagtgagaaaggacataccgcagtgggagccttcaaaaggctggaacgattggcagcaagtccccttttgcagtcaccacttccatcagctgatcatgaaggacgggcgggagattgtggttccatgtaggaatcaggatgagctagtgggacgagcacgtgtctctcagggcgctggttggagcctgagagagacagcctgcctcgggaagtcctatgcacaaatgtggcagttgatgtactttcaccgccgggacctgaggcttgccgcgaacgctatctgttcagccgtgcctgtagattggattcccactagcagaaccacatggtctatccatgcacaccatcagtggatgactaccgaagacatgctgtccgtttggaatcgcgtgtggatagaggaaaacccatggatggaggataaaacgcacatcagtagctggggagacgtcccctatctcggcaagcgggaggaccaatggtgcggctcgttaattgggctgacagccagggctacctgggccactaatatccaggtggcaattaaccaggttcgaagattgatcggaaatgaaaactacctggattacatgacatccatgaaacggttcaagaatgagtctgaccctgaaggtgctctctggtga

SEQ ID NO: 13875 - RNA, 9879 nt, synthetic construct
  misc_feature 1..9879: note = derived and/or modified CDS sequence (opt3) from DENV-1__GU131683__SS-prME
  source 1..9879: mol_type = other RNA
agcgtgaccatgctgctcatgcttatgcccaccgcactggctttccacttgactacgagaggaggggaacctcatatgatcgtctccaagcaggaaagaggaaaatctttactgtttaagaccccagccggtgttaacatgtgcacgctaattgccatggacctcggcgaactgtgtgaagatactatgacctacaaatgcccgcggatcacagagaccgaacccgacgatgtggactgttggtgcaatgcgactgatacatgggtaacctatgggacgtgttcacaaactggagagcaccgccgagacaagcgtagtgtggctcttgcccctcatgtcggcctgggtttggagaccagaacagaaacttggatgagctccgagggggcatggaaacagatccagagggtggaaacctgggccctccggcacccaggattcacagttattgctctgtttctggcacatgccatcggcacctctattacgcagaagggcatcatattcatcctcttaatgctggtgactccctcgatggctatgcgctgcgtcgggattggatcaagagattttgtggagggtcttagcggcgccacatgggtagacgttgtgttggagcacgggagttgtgtcaccactatggcgaaggataaacctacactggacatcgaactactcaagaccgaggtgacgaacccagcagtgctgaggaaactttgcattgaagccaagatctccaataccacaactgattctcggtgtcccacccaaggagaggctacactggtcgaagaacaagacgccaacttcgtttgccgccgaacttttgtggatagaggctggggtaatgggtgtggattgttcggcaaaggcagcctcataacctgcgcaaagtttaagtgcgtaacaaaactggaggggaagattgtgcagtacgaaaacttaaaatattccgtcatcgtgaccgttcacactggagaccagcatcaagtgggtaatgagtcaacggaacacggcacaaccgctactattacccctcaggccccaacaaccgagatccagctgactgactacggggcgctcacacttgattgtagtccgaggacgggactggacttcaacgaaatggtcttgctaaccatgaaggagaaaagctggctggcccataagcagtggtttctcgatctgccccttccttggacttctggcgcatccacatcacaagagacctggaatcggcaggacctgttggtgacattcaaaactgctcacgccaagaagcaggaagtagttgtgctcggtagccaagagggggctatgcacaccgccctgacgggcgcaaccgaaatccagacaagtggaactaccacaatttttgccggccatttaaaatgccgtctgaagatggataaactaactctcaaggggatgtcttatgtcatgtgtaccggatccttcaaactggagaaggaacttgctgagacgcagcacggtacagtgttggtccagataaagtacgagggcaccgacgcgccatgcaaaatccccttcagcactcaagatgaaaagggggtgacacagaacggacgcctgattaccgcaaatcctatcgttactgacaaagagaagccagtgaacatagaagccgagcccccgtttggcgagtcgtatattgtaatcggtgctggggaaaaagccctcaagctgtcttggttcaagaaaggctcctcaatcggaaagatgtttgaggcaaccgccagaggcgctaggcggatggccattcttggggatacagcatgggacttcggaagtatcggtggcgtctttacgagcgcggggaaactggtgcatcagattttcggaaccgcttacggcgttttgttttccggtgtgtcttggactatgaagatagggatcggcgtcctcctgacatggttaggactgaatagccgatcaaccagtctatccatgacatgtattgccgtgggcctcgtaactctgtaccttggggtgatggttcaggcagatagcggatgcgtcatcaactggaaaggccgcgaattgaagtgtggttctgggatcttcgtgaccaatgaggtgcacacgtggacagaacaatataagtttcaggccgactcacctaaaagactgagtgctgccattggaaaggcatgggaggagggcgtctgcggtataaggagcgctacccggctcgaaaacatcatgtggaaacagatttccaacgagctgaatcatatcttactggaaaacgacatgaagttcactgttgtggtgggcgatgtagccgggattcttgcgcagggcaagaaaatgatccgcccccaaccaatggagtacaaatattcttggaagtcgtggggcaaggccaaaataatcggggctgacgtccagaataccacatttattatcgatggacctaacactcccgaatgtccagacgatcagagagcatggaatatttgggaggtggaggactacggcttcggtatctttaccacaaacatatggttgaagctcagggatagctatacgcaggtttgcgaccaccgtctgatgtccgccgctattaaagattcaaaggccgtgcacgcagacatggggtactggatcgaaagtgagaaaaatgaaacctggaagctagcgcgggccttcttcattgaggtcaagacttgtatctggcccaaatctcatacactgtggagcaacggagtgctcgaatccgagatgataatccctaagatttatggcggtccaatctcacaacacaattaccgaccgggctactttacccagactgctgggccctggcatctgggaaaacttgagttggatttcgacctgtgcgaaggcacaaccgttgtggtagatgagcactgcgggaacagaggacctagcttaaggacgactaccgtcacaggcaagattatccacgaatggtgttgccgctcttgtaccctcccacccctgcggtttagaggtgaggacgggtgctggtatggaatggagataaggcctgtgaaagaaaaggaggaaaatcttgtgaagtccatggtcagtgccggcagcggtgaggttgactctttctccctgggcttgctctgtatttcaatcatgatcgaagaggtgatgcgcagtcgatggagccggaaaatgctgatgactgggacactagcagtatttttcctgctcattatgggacagctgacctggaacgatcttatccgtttgtgcattatggtgggcgctaatgcctcggacagaatggggatgggaacaacttacctggcattaatggccacctttaagatgaggccaatgttcgctgtcggcctcctgtttcgccggcttacgtccagagaggtgctgctactcacaataggtctgtctttggttgcgagcgtggaactgcccaactcattagaggaactcggggatggactggccatgggcatcatgattcttaaactgttgaccgacttccaaagtcatcagctctgggcaactctgctatccctgacctttatcaagacaactttctctcttcactatgcttggaaaaccatggccatggtcctcagcattgtgtccctgtttccgttgtgtctgtcaacgacaagccagaagaccacttggttacctgttctcctgggcagtcttgggtgcaagccactgacaatgttcttgatcgccgagaataaaatatggggaaggcgatcttggcccctcaacgaaggtatcatggctgtgggcattgtctccatcctgctaagctcgctgcttaagaacgatgtacctctcgcagggcccctgattgccggaggcatgttgatcgcgtgttacgtgatatcaggttctagtgctgacttatccctggagaaagccgcagaggttagctgggaagaggaagccgagcattctggggctagccacaatattctcgtggaagtccaggatgacggaaccatgaagatcaaagatgaggagcgcgacgatactctgacaatccttctgaaggcaaccttgctagccgtgtccggcgtatatccactgtcaattcctgcgacactcttcgtgtggtacttttggcagaagaagaagcagcggagtggcgtcctgtgggacactcccagcccaccggaagttgagagagctgtgcttgatgacgggatatataggatcatgcagcgtggattactgggtcgctctcaggtgggcgtcggggtgttccaagaaaacgtttttcataccatgtggcacgtaacacggggagccgtgctcatgtaccagggcaaaagattggagccttcctgggcatcagtcaagaaagacctgattagttacggtgggggatggaggctccagggcagctggaataccggcgaggaagtgcaggttatcgccgtggagcccgggaagaaccccaaaaatgtccaaacagctcccggaactttcaagacccctgaaggtgaggtgggcgccattgcactggattttaagccagggacgtccggatctcccatcgtaaaccgagaaggcaaaatagtcggtctttatgggaatggagtggttacaacttcgggcacctacgtgagcgctatcgcccaggcgaaggcctcacaggagggccctctgccggagattgaagacgaggtcttccggaaacgcaacttgacaatcatggatctacacccagggtccggaaagaccagaaggtatctgcccgcaattgtgcgggaagctatcaaacgaaagctcagaactttaatactggcccctacccgcgttgtggctagtgagatggcagaagcccttaagggtatgccaattaggtaccaaacaacggccgtcaaatctgagcatactggcaaggagatcgtggacctgatgtgccacgctacctttacaatgcgtctcttgagccccgtacgggtgcctaattataacatgatcattatggatgaagcgcatttcaccgacccgtcctcaatcgcagccagagggtacatatctactagggttggaatgggcgaggctgccgcaatttttatgacagccacaccaccaggtagcgtcgaggctttccctcagagtaatgcggtgatccaggatgaggaacgcgacattcccgagcgatcctggaacagcgggtatgagtggatcacggattttccaggaaaaactgtgtggttcgtcccttctataaagtcaggcaatgacattgccaactgtctgaggaaaaatggcaagcgggtaatccagctctccaggaagacattcgataccgaataccagaaaaccaagaacaacgactgggactacgtggttactacagatatcagtgagatgggggcaaattttcgcgctgaccgtgtgattgatcccagacggtgcctgaaaccagtcatccttaaggacggaccggaaagggtgattctagccggtcctatgcccgttaccgtggcaagcgccgctcagcgccgaggcagaatagggcggaaccacaataaagagggagatcagtatatctacatgggccagccactgaacaatgacgaggatcatgcccactggacagaagcgaagatgttgttagacaacattaatactcccgagggtatcatccctgcactgttcgaaccagagagggaaaagtcggccgctattgatggggagtatcgcctcagaggcgaggccaggaaaacgtttgtcgaactgatgcggcgtggagaccttcccgtgtggctgtcttacaaggtagcttccgagggcttccaatatagcgatcgccgatggtgctttgacggggaaagaaacaatcaggtgctcgaggaaaacatggatgttgagatatggaccaaagagggagaaaggaagaaattgcggcctcgctggctggacgcaagaacatactcagacccgctagccctgagggagttcaaggaatttgctgccggtcggcgaagtgtctctggcgatctcatccttgagattgggaaactgccacagcacttaactcagagagcacaaaatgcgttggacaacctggtgatgctccataattccgaacagggaggccgcgcctataggcacgctatggaggagctgcccgataccatcgaaacacttatgctgctcgccttgattgcagtgctgaccggtggggtcactttattctttctaagcggccggggactgggcaagacgtcaatcgggctcctttgtgttatggctagtagcgtgctgttgtggatggcctccgtagagcctcattggatagcagcctctatcattctggagttctttctcatggtgctgcttatccccgagccagaccgtcagagaacccctcaggataaccaactcgcttacgtcgtgattggactgttgttcatgatcctgacagttgcggccaatgagatgggtttactagaaactaccaagaaagacctgggcatagggcacgtggcagtcgagaaccaccatcacgctgccatgctcgatgtagaccttcatcccgccagcgcatggacactgtacgctgtggccaccactattatcacaccaatgatgaggcacacgattgaaaacaccactgcgaatatctccttgacagctatagccaaccaggcagccatcctgatgggactcgataagggctggcctatttcaaaaatggacatcggtgttccgctgcttgctttagggtgctattctcaggtgaatcccctgaccctcaccgcagccgtcttgatgctggtggcgcattacgctattatcggcccaggactacaagccaaggcaacacgcgaggcccagaaacggactgctgccggcataatgaagaaccctacggtcgatgggattgtggcaatcgacctggatcccgttgtgtatgacgctaagtttgaaaaacagctcggacagatcatgcttctgattttgtgtaccagtcaaatcctgctcatgcgaacaacttgggccctgtgcgagtcgataaccttagcgacaggcccacttaccactctgtgggagggtagccctgggaagttctggaatacgacaattgccgtatccatggcaaacatcttcagaggatcttacctcgctggcgccggtctagcattttcactgatgaagtccttgggcgggggaaggcgcggcaccggggctcagggagaaactctgggcgagaagtggaaacggcagctcaatcagcttagcaagagtgagttcaacacctataagagatctggtattatggaggtggaccgtagcgaagccaaagaggggctgaagaggggagagacaactaaacacgccgtctcacggggcaccgcgaagttgcgctggtttgttgaacgaaatctggtgaaacccgagggtaaggtcatcgatctcggctgtgggagaggaggctggtcctactattgcgctgggttaaagaaagtgacagaagtaaagggatacacgaaaggcggtccggggcacgaggaaccaatacctatggcaacctacggatggaacctggtgaaacttcatagtggcaaagacgttttctttatacccccagagaagtgtgatactctgctatgcgacattggcgagagctctcccaatcctacaatcgaagaggggaggaccctccgggtgctgaaaatggtcgaaccgtggttgcgcggaaaccaattctgtattaagatcctgaatccctatatgccatccgtggtcgagactctcgagcagatgcagagaaagcacggtggcatgcttgtgaggaaccctctgtcacgaaatagcacacatgaaatgtactgggtttcgtgcgggaccggaaacattgtatctgccgtgaatatgacgagtcggatgttactgaaccgttttaccatggctcacagaaaacccacatatgagcgcgatgtcgacttgggcgccggtactaggcacgtggcagttgaacctgaggtggccaacctcgatatcatagggcagcggattgaaaatatcaagcatgagcacaaatccacctggcattacgacgaggataacccatataagacatgggcttaccacggaagctatgaagtcaaaccctcaggctccgcgtctagcatggtgaatggcgtagtgaagctgctaactaagccttgggacgttatcccaatggtcacccaaattgccatgacagataccactcccttcgggcagcagagagtgtttaaagagaaggtggacacgcgcacaccgaaagcaaagaggggaaccgctcaaataatggaagtcactgccaaatggctttggggtttcctgagtcgaaacaagaagcctcggatctgtaccagagaggaatttacaaggaaagttcgctccaatgcagccattggcgctgtgttcgtagacgagaaccagtggaatagcgccaaggaggcggtggaagatgagcgtttttgggacctcgtccatcgggaaagagagctgcacaaacaggggaagtgcgcaacgtgcgtgtacaacatgatgggaaaaagggaaaagaagttgggcgagttcggtaaagccaaggggtctcgcgctatctggtacatgtggctgggagcccgattcctcgagtttgaagcacttggcttcatgaatgaggatcactggttttcacgggaaaacagtctgtccggcgttgagggggagggattacataaactgggttatattttgagagacatcagcaagataccaggcgggaatatgtacgctgatgacaccgccggatgggatactaggatcacagaagacgatctccagaacgaggctcgcattaccgacatcatggaacccgagcacgccctgctagcaaaatctattttcaaacttacttatcaaaataaagtggtcagagtgcagcggcctgcgaagaacggcacagtaatggatgttatctcgaggcgtgaccagcgaggttcagggcaagtgggaacctacggcctgaatacatttactaacatggaagcccaactcatacgccagatggagagcgagggcattttctccccaagtgaactggagacccccaacttggctgaaagagtcttagattggctggagaagtatggggtggaacggctcaaaaggatggccatctctggagacgactgtgtggtcaagccgatcgatgaccgctttgcaacggctcttaccgccctgaatgatatgggtaaagttagaaaggacattcctcagtgggagcccagcaaaggctggaacgattggcagcaagtgccattctgctcccatcactttcaccagctaataatgaaggacgggcgggagatcgtagtgccttgtaggaatcaggatgaactggtcggacgagcacgtgtgtcacagggcgccggttggagtctcagagagacagcgtgcttggggaagtcttacgctcaaatgtggcagctgatgtatttccatcgccgggaccttaggctggccgcaaacgccatttgtagcgctgttcccgtggattggatcccaacttccagaaccacatggtcaattcacgcccatcaccagtggatgactaccgaagacatgctcagcgtctggaatcgcgtgtggatcgaggaaaacccctggatggaggataaaacgcatatatcttcctggggagacgtaccttacttaggcaagcgggaggaccaatggtgcggcagtctgatcgggttgacagcaagggctacctgggccactaatattcaggttgcgatcaaccaggtgcgaagactgattggaaatgaaaactacctcgattatatgacaagcatgaaacggtttaagaatgagtcggacccagaaggtgctctttggtga

SEQ ID NO: 13876 - RNA, 9879 nt, synthetic construct
  misc_feature 1..9879: note = derived and/or modified CDS sequence (opt3) from DENV-1__GU131684__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctaaggtatccgctggctcaggtgaggtggacagttttagccttggcctgttgtgtatttcgatcatgatcgaagaggtcatgaggtcccgctggtctcgaaaaatgctcatgacagggaccctggccgtgttctttctactgattatgggacagctcacttggaacgatctgatccggctttgcattatggttggcgcaaatgctagcgaccgtatggggatgggaacaacctacttggccctgatggcaacattcaagatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaaacttctgacggactttcaaagccatcagttgtgggccacactcctgtccctaaccttcatcagaactaccttttcactgcactatgcatggaagacaatggctatggtgcttagcattgtcagtctcttccccctgtgtttgtctactacctcccagaagacgacatggctgccggtattactcggcagcctggggtgcaaacctcttaccatgtttctgatcgccgagaataagatatggggaaggaaatcgtggccattgaacgaaggtatcatggccgtgggcattgtttcaatcctcctgtctagtctactgaagaacgatgtgccccttgctgggcctctcattgcaggaggcatgctgatcgcctgttacgtcatatccggtagctctgcggacttgagcttagagaaagctgccgtggtatcctgggaggaagaggcagaacattcaggggccagtcacaatattctggtggaggtccaggatgacggaactatgaagatcaaagatgaagagcgagacgatacactcaccatcctgcttaaggctactctgttggcagttagcggcgtgtatcccctatctattccagccacactgttcgtgtggtacttctggcaaaagaaaaagcagcgctccggcgtcctctgggacaccccttcacccccagaggtggaacgggcggttctggatgacgggatatatagaatcatgcagaggggacttttaggtcgtagtcaggtaggcgtgggggtctttcaagagaacgtgttccatacgatgtggcacgttactcgcggagctgtgctgatgtaccagggcaaacggctcgaaccgagctgggcctccgtcaagaaagacttgatttcttacggtgggggatggagactgcagggctcgtggaataccggcgaggaggtgcaggtaatcgcagtcgaacctgggaagaaccccaagaatgtgcaaacagccccaggaacctttaaaacaagcgagggtgaagttggcgctattgccctcgatttcaagcccgggacttcaggatcccctatcgtgaacagggagggcaaaatagtcggtctgtatgggaatggagtggttaccacgagtggcacatacgtgtctgcaatcgctcaggccaaggcgagccaggaaggcccacttcccgagattgaggacgaagtctttcgaaaacggaacctgactatcatggatttgcaccctgggtccggaaagacccgcagatatctaccggccattgtgagggaggcaatcaagcggaaactgcgaacactcatattagctccaaccagagtagtggcctcagaaatggctgaggcactgaagggtatgcccattcgctaccaaactaccgccgttaaatctgaacatacaggcaaggagatcgtcgaccttatgtgccacgccacgttcactatgaggctgctcagccctgtgcgtgtgccaaattataacatgatcattatggatgaggctcattttaccgaccccagttccatcgcggcacgggggtacataagcacaagagtcggaatgggcgaagccgctgccattttcatgaccgcaactcctccgggttctgtagaggcctttccccagtcaaatgctgtgatccaggatgaagagagggacattccagaacgctcctggaacagtgggtatgagtggatcacagatttccctggaaaaaccgtttggtttgtgcccagcataaagtcgggcaatgacattgcgaactgtttgcgaaagaatggcaaaagagtcatccagctgtctcggaagacgttcgatactgagtaccaaaaaacaaagaacaacgactgggactacgtggttaccaccgatatctccgaaatgggggccaatttcagggcagaccgcgtgattgatccacgtagatgcctcaaacctgtcatcctgaaggacggacccgagcgggtgattcttgctggtccaatgccggtaactgtggccagcgcagcccagaggcgcggccgaatagggagaaaccacaataaggaaggagatcagtatatctacatgggccagcctctaaacaatgacgaggatcatgctcactggacagaggccaaaatgctgttggacaacattaatacccccgaaggtatcatcccagcgttatttgagcccgaacgggagaagtcagcagccattgatggggaatataggctgcgcggcgaggctagaaaaacattcgttgagctcatgaggcggggagacctgcctgtctggcttagttacaaggtggcctctgaaggctttcaatattccgatcgtcgctggtgcttcgacggggagcgaaacaatcaggtgctggaagagaacatggatgtcgaaatatggactaaagagggagagagaaagaaactcaggccacggtggttggacgctcgcacgtacagcgaccccctggcactaagagaatttaaggagttcgccgctggtaggcggtcagttagtggcgatctgatcctcgaaattgggaagcttcctcagcacctgacccagcgagcccaaaatgcattagacaacttggtgatgctgcataatagcgagcagggaggcagagcgtatcgccacgccatggaagagctcccggatacaatcgagactctgatgcttctggctctcattgccgtattgaccggtggggtgacactgtttttcttatccggcaggggactaggcaaaacctctatcgggctgctctgtgtcatggcaagctccgtgcttctgtggatggcttcagttgaaccacattggatagccgcatctatcattttggagtttttcctgatggtgctcctgatccccgaacctgaccggcagcgtactccccaggataaccaacttgcctacgtcgtaattggactcctgtttatgatcttgacggtggctgcgaatgagatgggtctgttagagaccacaaagaaagacctaggcatagggcacgttgccgtggaaaaccaccatcacgcagctatgctggatgtcgacctccatccagccagtgcctggactctttacgcagtggctaccacaattatcacccctatgatgagacacactattgagaacacaacggccaatatctcgctgaccgcgatagctaaccaggccgcaatcttgatgggactggataagggctggcccattagcaaaatggacatcggtgtcccactcctggcccttgggtgctattcccaggtgaatcctttaactctgacagctgcagttctcatgttggtggcccattacgcgattatcggcccgggactgcaagctaaggccaccagggaagcacagaagcgcaccgccgctggcataatgaaaaaccccacagtagatgggattgtggccatcgacctagatccagtcgtttatgacgcaaagttcgagaaacagctgggacagatcatgctccttattctgtgtacttctcaaatcttgctgatgcggacgacctgggctctctgcgaatcaataacactggccactggccctttaaccacactttgggagggtagccccgggaagttttggaataccactattgcggtgtccatggccaacatcttccgaggaagttacctggcaggcgctggtctcgccttctctctaatgaaaagcctgggcgggggaagaaggggcacgggggcacagggagagacattgggcgaaaagtggaagcgccagctgaatcagctctcaaaatccgagtttaacacctataagcggagtggtattatggaagtcgacagaagcgaggctaaagaagggcttaagcgtggagagactaccaaacacgccgtgtctaggggcacagccaagctgcggtggttcgtagagcgcaatttggtgaagccagaaggtaaagttatcgatctgggctgtgggcgaggaggctggtcctactattgcgcggggctcaagaaagtgactgaggtcaagggatacaccaaaggcggtcctgggcacgaagagcccataccgatggctacatacggatggaacttagtgaagctgcattcaggcaaagacgtctttttcatcccacctgaaaagtgtgatacgcttctgtgcgacattggcgagagctcgcccaatccaaccatcgaggaagggagaactctaagggtgctcaagatggttgagccctggctgcggggaaaccaattttgtattaaaatcttgaatccttatatgccgtctgtagtggaaacactggagcagatgcagcgcaagcacggtggcatgctcgtcagaaacccccttagtaggaattccacccatgagatgtactgggtgagctgcgggactggaaacattgtttcagcagtgaatatgacatcccgaatgctgttaaaccggttcaccatggcccaccgtaaaccaacgtatgaaagagatgtcgacctgggcgctggtacccgccacgtggccgtagagcctgaagtggcaaacttggatatcatagggcagaggattgagaatatcaagcatgaacacaaatctacatggcattacgacgaggataacccctataagacttgggcctaccacggaagctatgaggttaagcctagtggctccgctagctctatggtcaatggcgtggtgaaactcctgaccaagccatgggacgtcatccccatggttacacaaattgcgatgactgataccacaccttttgggcagcagcgggtgttcaaagaaaaggtagacaccagaactccaaaagccaagcgcggaacggcacaaataatggaggtgacagctaagtggctatggggttttctttcaaggaacaaaaagccccgaatctgtacccgggaagagttcactagaaaagtcaggagtaatgccgcaattggcgccgtgtttgttgacgaaaaccagtggaattccgctaaggaggccgtggaggatgaacgcttctgggacctggtccatcgtgagcgggaactccacaaacaggggaagtgcgcgacctgcgtgtacaacatgatgggaaagagagagaaaaagctgggcgaatttggtaaagcaaaggggagcagggccatctggtacatgtggttgggagctcgcttcctggagttcgaggccctcggctttatgaatgaagatcactggttctctcgagagaactcgctttcaggcgtagaaggggagggactgcataaattaggttatattctgcgggacatcagcaagataccgggcgggaatatgtacgcagatgacacagctggatgggatacgagaatcaccgaggacgatttgcagaacgaagccaaaattactgacatcatggagcctgaacacgctctcctggccaagtccatttttaagctaacatatcaaaataaagttgtgagggtccagcgcccagcaaagaacggcaccgtgatggatgtgatcagtagacgggaccagaggggttctgggcaggtcggaacttacggccttaatacattcaccaacatggaggcgcaactgatacgtcagatggaaagcgagggcattttttccccctcagagctcgaaacacctaacctggccgggcgagttttggattggttagagaaacatggagtggaacgcctgaagagaatggctatcagtggtgacgactgtgtagtgaaaccaatcgatgaccggttcgccactgcactcaccgctcttaatgatatgggcaaggtcaggaaggacattccccagtgggagccgtctaaagggtggaacgattggcagcaagtgcctttttgcagccaccacttccatcagctgataatgaaggacggacgcgaaatcgttgtgccctgtagaaatcaggatgagctagtcggccgggccagggtgtcccagggtgcagggtggtcactgcgagagacggcctgcctcggaaaaagctatgcgcaaatgtggcagttgatgtactttcaccgtagagacctgcgccttgctgccaacgcaatttgttctgccgtaccagttgattgggtgcctacctcccggacaacttggagtatccatgctcaccatcagtggatgaccacagaagacatgctgagcgtctggaatagggtgtggattgaggaaaacccctggatggaggataagactcacatctcgtcctggggcgacgttccatatctcggcaaaagagaagaccaatggtgcgggtctttaataggactgaccgcccgcgcaacgtgggctacaaatatccaggtggccattaaccaggtccggaggttgctgggtaatgagaactacctcgattacatgacctcaatgaagcgattcaagaatgagagcgaccccgaaggcgcgctttggtga

SEQ ID NO: 13877 - RNA, 9879 nt, synthetic construct
  misc_feature 1..9879: note = derived and/or modified CDS sequence (opt3) from DENV-1__GU131685__SS-prME
  source 1..9879: mol_type = other RNA
agcgtgaccatgctgctcatgcttatgcccacagccctggctttccacttgactacgagaggcggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggagaaactaactctcaaggggatgtcctatgtgatgtgtaccggatcgttcaaactggaaaaggaggtcgccgagacgcagcacggtacagtgcttgttcagataaagtacgaaggcaccgatgctccttgcaaaatcccattctcgactcaagacgagaagggggtgacacagaacggacgcttgattaccgcgaatcccatcgtaactgataaagaaaagcctgtcaacatagaggcagagccaccctttggcgaatcttatattgtgatcggtgccggggagaaagctctgaagctctcctggttcaagaaaggctcaagtatcggaaagatgtttgaagccaccgcaagaggcgccaggcggatggctattctgggggacacagcctgggatttcggaagcatcggtggcgtttttacgtccgtggggaaacttattcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgactctggatgcgtgatcaactggaaaggccgcgagcttaagtgtggttcagggattttcgtcaccaatgaagttcacacgtggacagagcaatataagtttcaggccgatagtccgaaaagattgagcgcagccataggaaaggcttgggaggaaggcgtgtgcggtatcaggtccgccacccggctggagaacattatgtggaaacagatctctaacgaactcaatcatattctgttagagaacggcatgaagttcactgtggtagtcggggacgtggcaggaatcctggctcagggcaaaaagatgatacgccctcaacccatggaatacaaatattcgtggaaaagctgggggaaggccaagatcattggagcggacgttcagaataccacatttatcattgatggcccaaacactcctgagtgtcccgacgatcagagagcctggaatatctgggaggtggaagactacggtttcgggatatttaccacaaacatttggcttaagttgagggattcctatacgcaggtctgcgaccaccgtctcatgtcagctgcaatcaaagatagtaaggccgtgcacgctgacatgggatactggattgagtctgagaaaaatgagacctggaagctggcccgggcatccttcatcgaagttaagacttgtatatggccaaaatcccatacactatggtcaaacggcgtgctggagagcgagatgatcattcccaagatctatggtggccctatttctcaacacaattaccgaccagggtacttcacccagactgcgggaccgtggcatctcggcaaactggaacttgattttgacttgtgcgaggggacaaccgtagtcgtggatgaacactgcggaaacagaggcccctccctgaggacgactaccgtgacaggtaagatcatacacgagtggtgttgccgcagttgtaccttacctccactccggttcagaggggaggacggatgctggtatggcatggaaattaggcccgtcaaagagaaggaagagaatctggttaagagcatggtgtctgccggttccggcgaagtagattcatttagtcttgggctgttgtgtatcagcatcatgattgaggaggtgatgcgctcgcgatggtcccggaaaatgctcatgactggaacactggctgtcttctttctactgatcatgggccagctcacctggaacgacctgattcgtctttgcataatggtgggggccaatgcatctgacagaatgggaatgggcacaacttacttggctctgatggccaccttcaagatgaggcctatgtttgcagttggtttactcttccgccggctgacgagcagagaagtgcttctgctaacaatcgggctctcactggtcgccagtgtggagttgccaaactccctggaagagttaggagatggcctcgctatgggcattatgatcctgaaacttctgaccgactttcaatctcatcagttgtgggcgactctcctgagcctaaccttcattaagacaactttttccctgcactatgcctggaaaaccatggcaatggttctttcaatcgtgagcctcttccccctgtgtttgagtacgacatctcagaagaccacttggctgccggtcttactcgggtccctgggatgcaagcctcttacaatgtttctgatagctgaaaataaaatctggggtaggcgaagctggccattgaacgagggcattatggccgtagggatcgtgtcgattctcctgtcatctctactgaagaacgatgttccccttgccggacctctcatcgctggcggtatgctgatagcatgttacgtgattagtgggtccagcgccgacttgtctttagagaaagcggctgaagtcagctgggaggaagaggccgaacattccggagcatcacacaatatcctggtggaggtacaggatgacggcaccatgaagatcaaagatgaggaacgcgacgatactctcacaattctgcttaaggccaccctgttggctgtgagtggcgtctatcccctaagcataccagcaacgctgttcgtttggtacttctggcagaaaaagaagcagcggtctggggtgctctgggacactccttcacccccagaggtggaaagagccgtcctggatgacggaatctataggattatgcagcgtggtcttttaggccgcagccaggtgggggttggagtatttcaagagaacgtgttccataccatgtggcacgtcacacggggcgcggtgctgatgtaccagggtaaaagactcgagccgagttgggctagcgttaagaaagatttgatctcctacgggggaggctggaggctgcagggctcttggaataccggggaagaggtgcaggtcattgccgtggaacctggaaagaaccccaaaaatgtacaaacagcaccaggtacttttaagacccccgagggcgaagtcggggccatcgctctcgacttcaagcctggaacgtcgggcagcccaatagtgaaccgagagggtaaaatcgttgggctgtatggaaatggcgtggtcacaacttcaggcacctacgtgtccgccattgcacaggctaaggccagtcaggaggggccccttcctgaaatcgaggacgaagtttttcggaaacgcaacctgacaattatggatttgcacccgggatctggtaagaccagaaggtatctaccagcgatcgtgcgggaggccataaaacgaaagctgagaactctcattttagcacccacccgcgtcgtggctagcgaaatggccgaggctctgaagggcatgcctatcaggtaccaaacaacggcagtaaaatccgagcatactgggaaggaaatcgtggaccttatgtgccacgccaccttcacaatgcgtctgctctcaccagttcgggtccccaattataacatgattatcatggatgaggcccattttaccgacccttctagcatagctgcgagaggatacattagtactagggtgggcatgggtgaagcagccgctatcttcatgacagccaccccgcccgggtccgtggaggcatttccacagagcaatgccgtcattcaggatgaagaacgcgacatccctgagcgatcttggaactcaggatatgaatggataacggatttccccggcaaaactgtatggtttgtgccatccattaagagtggcaatgacatcgctaactgtttgaggaaaaatgggaagcgggttatccagctgagcaggaagacattcgataccgagtaccagaaaaccaagaacaacgactgggattacgtggtcactacagacatttcggaaatgggagcgaatttccgcgccgaccgtgtgatcgatcctagacggtgcctcaaacccgttattctgaaggacggtccagagagggtgatacttgcaggcccgatgcctgtcaccgtggcttctgccgcacagcgccgagggagaatcggacggaaccacaataaagagggcgatcagtatatttacatgggtcagcccctaaacaatgacgaagatcatgcccactggacagaggctaagatgctgttggacaacatcaatactccagaagggatcattcccgccttatttgagcctgaaagggagaagtccgcggcaatagatggcgagtatcgcctgagaggagaagccaggaaaacgttcgtagagctcatgcggcgtggcgacctgccagtgtggcttagctacaaggttgcttcagaagggtttcaatatagtgatcgccgatggtgcttcgacggagagagaaacaatcaggtcctggaagagaacatggatgtggagatctggaccaaagaaggtgagaggaagaaactccggccccgctggttggacgccagaacatactctgatcctctggctctaagggaatttaaggagttcgcagccggccggcgatccgtgagcggggacctgattctcgaaatcggaaaacttccgcagcacctgactcagagagctcaaaatgccttagacaacttggtcatgctgcataattcagagcagggcggtcgcgcatataggcacgcgatggaggaactcccagataccattgagacactgatgcttctggccctcatcgctgttttgaccgggggcgtgactctgtttttcttaagtggacggggcctagggaagacgagcataggactgctctgtgtaatggcctcctctgtgcttctgtggatggcaagcgtcgaaccccattggatcgctgcctccattatcttggagtttttcctgatggtgctcctgattcctgagcccgaccgtcagagaaccccacaggataaccaacttgcatacgttgtgatcggtctcctgtttatgatattgacagtcgccgctaatgaaatgggcctgttagagactaccaagaaagacctagggattggacacgtagcggtggaaaaccaccatcacgccgcaatgctggatgttgacctccatcctgcttcagcctggacactttacgccgtggcaaccactatcattacacccatgatgaggcacacgatcgagaacaccactgctaatatatctctgacagccatcgcgaaccaggctgccattttgatgggcctggataagggttggccaatcagtaaaatggacattggggtccctctcctggcacttggctgctatagccaggtgaatccgttaaccctgaccgccgctgtcctcatgttggtggcacattacgccatcataggacccggcctgcaagcgaaggctacacgcgaagcccagaaacggactgcagccgggattatgaagaacccaacggttgatggaatcgtggctatcgacctagatcctgtagtgtatgacgccaagttcgagaaacagctgggccagattatgctccttatcctgtgtaccagccaaatattgctgatgcgaacaacttgggcactctgcgagtccattaccctggctacaggtcccttaaccactctttgggaagggtctccaggaaagttttggaatacgacaatcgccgtctcaatggcgaacattttcagaggcagctacctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctataagagatcagggatcatggaagttgatcgttccgaggcaaaagagggacttaagaggggcgaaacaactaaacacgctgtgagtcggggtaccgccaagctgcgctggttcgtcgagcgaaatttggtgaaacctgaaggcaaggtaatagacctggggtgtggaagaggcgggtggagctactattgcgccggactcaagaaagtgacagaggttaagggctacacgaaaggtgggcccggacacgaggaaccgatcccaatggcgacctacggctggaacttagtgaagctgcattctggcaaagacgtctttttcattcctcccgagaagtgtgatactcttctgtgcgacatcggggaatcctcaccaaatcccacaattgaggaaggaaggaccctacgggtgctcaaaatggtcgagccttggctgcgcggtaaccaattttgtatcaagattttgaatccgtatatgcccagcgtggttgagactctggaacagatgcagagaaagcacggcgggatgctcgtaaggaacccactttcgcgaaattctacacatgagatgtactgggtgagttgcggaaccggcaacatcgtctccgctgtgaatatgacgagccggatgctgttaaaccgtttcaccatggcacacagaaaacctacatatgaacgcgatgttgacctgggtgccgggactaggcacgtggctgtcgagcccgaagtggccaacttggatataattggacagcggatcgagaatatcaagcatgagcacaaatcaacctggcattacgacgaagataacccttataagacatgggcataccacggctcctatgaggtaaaaccatctggcagcgccagttccatggtgaatggggttgtcaagctcctgactaagccctgggacgtgattcctatggtgacccaaatagctatgacagataccactccatttggacagcagagagtcttcaaagaaaaggttgacacgcgcacacccaaagcgaagaggggtaccgcccaaatcatggaggtgactgcaaaatggctatggggctttcttagccgaaacaagaagccgcggatttgtaccagagaagagttcacaaggaaagtacgctctaatgctgccatcggggcagtgtttgtcgatgagaaccagtggaactcagccaaggaagctgtggaggacgaacgtttctgggacctggttcatcgggagagagaactccacaaacagggaaagtgcgccacgtgcgtgtacaacatgatgggcaaaagggagaagaagctgggtgagtttgggaaagcgaagggaagtcgcgcaatttggtacatgtggttgggcgcccgattcctggagttcgaggctctcggctttatgaatgaagatcactggttctcccgggagaacagcctttctggggtcgagggagaaggtctgcataaattaggctatatcctgagagacatatcgaagatccctgggggaaatatgtacgccgatgacaccgcaggctgggatactaggattacagaggacgatttgcagaacgaagctcgcatcaccgacattatggagccagaacacgccctcctggctagatcaatctttaaactaacttatcaaaataaggtggtacgggttcagaggcccgccaaaaacggtacagtgatggatgtcataagccgtcgagaccagcgcgggtccggacaggtgggcacctacggccttaatacattcactaacatggaggcacaactgattagacagatggagagtgaagggatcttttctcctagcgagctcgaaaccccaaacctggcggagcgggtgttggattggttagaaaagtatggagtcgagaggctgaagcgcatggccatctccggtgacgattgtgttgtgaaacccattgacgacagattcgctacggccctcaccgcacttaatgatatgggcaaggtacggaaagacataccgcagtgggagccttcaaaggggtggaacgattggcagcaagtgcccttttgcagtcatcacttccaccagctgatcatgaaagacggaagggaaattgtcgtgccatgtcgaaatcaggatgagctagttggccgtgctagagtgtctcagggtgccgggtggagcctgcgcgaaacagcatgcctcggaaagtcctacgcccaaatgtggcagttgatgtattttcatcggagggacctgagacttgcggctaacgccatctgttcagcagtccctgtggattggattcccactagccgcaccacatggtctatccacgcccatcaccagtggatgactaccgaggacatgctgtccgtatggaatcgggtttggatagaagagaacccatggatggaggataagacgcatatcagtagctggggcgacgtgccctacctcggcaaaagggaagatcaatggtgcgggtcgttaattggactgacagctcgagccacctgggcaactaatatccaggtcgctattaaccaggtgagacggttgatcggtaatgagaactacctggactatatgacatccatgaagaggttcaaaaatgaatctgaccctgagggcgccctctggtga

SEQ ID NO: 13878 - RNA, 9879 nt, synthetic construct
  misc_feature 1..9879: note = derived and/or modified CDS sequence (opt3) from DENV-1__GQ868614__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggacctttcaaactggagaaggaagtggctgagacccagcacggtacggtccttgtgcagataaagtacgagggcacagacgcgccatgcaaaatccccttcagcacccaagatgaaaagggggttattcagaacggacgcttgatcactgcaaatcctatagtgacagacaaagagaagccagtaaacattgaagccgagcccccgtttggcgagtcgtatatcgtcatcggtgtgggggaaaaagctctgaagctctcttggttcaagaaaggctcctcaattggaaagatgtttgaggccaccgcaagaggcgccaggcggatggctatcctgggggatactgcctgggacttcggaagtattggtggcgtttttaccagcgtggggaaacttgtccatcagatattcggagcagcgtacggcgtgctgttttccggtgtatcttggacaatgaagatcgggattggcgtgttgctcacgtggctgggattaaatagccgatcaaccagtctgtccatgacttgtatcgctgttggcctagtcacactctacctgggggtgatggtgcaggccgatagcggatgcgtcatcaactggaaaggccgcgaacttaagtgtggttctgggattttcgttaccaatgaggtgcacacatggactgaacaatataagtttcaggcagactcacctaaaagattgagtgccgctataggaaaggcctgggaggagggcgtgtgcggtatcaggagcgtaacccggctggaaaacattatgtggaaacagatctccaacgagctcaatcatattctgttagaaaacgacatgaagttcacggtcgtggttggcgatgtggtcgggatcctggcacagggaaaaaagatgatacgcccccaaccaatggagcacaaatactcttggaagtcgtggggcaaggctaaaatcattggggccgacgtgcagaatacaacctttatcattgatggacctaacactcccgaatgtccagacgatcagagagcgtggaatatctgggaggttgaggactatggcttcggtatatttaccacaaacatttggcttaagttgagggatagctacactcaggcctgcgaccaccgtctcatgtccgctgcaatcaaagattcaaaggccgtgcatgctgacatggggtattggattgaaagtgagaaaaatgaaacctggaagctggcccgggcatctttcatcgaggtaaagacatgtatatggcccaaaagccacacgctatggtccaacggagtcctggaatcagagatggtgatccctaagatttacggcggtccaatcagccaacataattatcgaccgggctacttcacccagactgcggggccctggcacctcggaaaactggagcttgattttgacttgtgcgaaggcacaaccgtggtcgttgatgagcactgcgggaacagaggaccttctctgaggactacaaccgtgacgggcaagattatccatgaatggtgttgccgctcctgtactttaccacccctccggttcaaaggtgaggacgggtgctggtacggaatggagataagacctgtaaaggaaaaggaggaaaatctggtgaaaagtatggtcagcgccggctctggtgaggtggactccttttcacttggcctgttgtgtattagtatcatgatcgaagaggttatgaggagccgctggtcgcgaaagatgctcatgaccgggacactggctgtgttcctactgctcattatgggacagctgacctggaacgatcttatccggttgtgcattatggtcggcgccaatgcatccgaccgtatggggatgggaactacatatctggctttaatggccacctttaaaatgagaccaatgttcgcagtgggcctcctgtttaggcgccttacatctcgggaggttctgctactcactataggtctgagcttggtggcctcagtcgaactgcccaacagtttagaggaactcggggatggactggctatgggcatcatgattcttaagctgttgaccgacttccaatcccaccagctctgggcgacgctgctatctctgacatttatcaaaaccactcttagcctccattacgcctggaagaccatggcaatggtactgtccattgtgtcattgttcccgctgtgtttaagcacaactagtcagaagaccacgtggctccctgttctgcttggctctctggggtgcaaaccattgacaatgtttctcatcgctgagaataagatatggggaagaaaatcctggcccctgaacgaaggtatcatggccgtgggcgtcgtgagcattctactgtcgtcacttctcaagaacgatgtacctctggccgggcccttgatcgctggaggcatgttaattgcatgttatgtgatctctggtagttccgccgacctgagcctcgagaaagcggctgaggtctcttgggaagaggaagccgagcacagcggggcatcccataatatactggttgaagtgcaggatgacggaaccatgaagattaaagatgaggagagggacgatactcttacaatcctgttgaaggccaccctactggctgtgtcaggcgtctacccactcagtatccctgcaactctgttcgtgtggtatttttggcaaaagaaaaagcagcgaagcggcgttctttgggacacaccctctccaccggaagtagagcgcgccgtgttagatgacgggatttaccggataatgcagagaggactgctcggtaggtcccaggtcggcgtgggggttttccaagaaaacgtgttccacaccatgtggcacgtcacgcgtggagcggtgttgatgtatcagggcaaacgcctggagccttcatgggctagtgtaaagaaagacctcatcagctacggtgggggatggcggctgcagggctcctggaatactggcgaggaagtccaggtgattgccgttgagcccgggaagaacccaaagaatgtgcaaaccgcacccggaacatttaaaacccctgaaggtgaggtcggcgccatcgctcttgatttcaagccagggacatctggatcgcccattgtgaacagagaaggcaaaatcgttggtctgtacgggaatggagtggtcactaccagcggcacgtatgtgtcagccatagcacaggctaaggcctcccaggagggccctttgccggagatcgaagacgaggtatttaggaaacgaaacctaacaattatggatctgcatccagggagtggaaagactcggcgctacctccccgcgatcgtgagagaagccattaagaggaaattacggaccctgatccttgcacctacacgagttgtcgcttctgagatggccgaagctctgaagggtatgccaataagatatcaaaccactgcagtgaaaagcgagcacaccggcaaggagattgtggacctcatgtgccatgccacattcacgatgcgcttgctgtcccccgtcagggtacctaattacaacatgatcatcatggatgaagcccactttactgacccgtcatctattgctgcgcgtgggtatatcagcacccgggtgggaatgggcgaggcagccgctatattcatgacagccacccccccaggtagtgttgaagcatttcctcagtccaatgccgtgattcaggatgaggaaagagacatccccgagaggagctggaactctgggtacgagtggattactgatttcccaggaaaaacagtctggtttgtgccttcaatcaagtccggcaatgacatagctaactgtctccgcaagaatggcaaacgagttattcagctgagtagaaagaccttcgatacggaatatcaaaaaactaagaacaacgactgggactacgtggtcacaaccgatatcagcgagatgggggcgaattttcgggccgacagggtgatcgatccccgccgttgccttaaaccagtaattctaaaggacggaccggaaagagtgatcctggcaggtcctatgcccgttaccgtcgcttcggccgcacagcggaggggccgcattgggcgaaaccataataaggagggagatcagtacatatatatgggccagccattgaacaatgacgaggatcacgcccactggactgaagctaaaatgttactggacaacatcaatacacccgagggtattatccctgccctcttcgaaccagagagagaaaagtctgcggcaatcgatggggagtaccggctgaggggcgaggcccgcaaaaccttcgtggaacttatgagaaggggagacctgcccgtgtggctctcctataaggtcgctagcgagggctttcaatactcagatcggcgttggtgcttcgacggggaacgcaacaatcaggttttggaggaaaacatggatgtggagatttggacaaaagagggagaacgaaagaaactgagacctaggtggctagacgcccggacttatagtgacccgctggctctccgcgagtttaaggaattcgcagccggtagaaggtctgtatccggcgatcttatactggagatcgggaagttaccacagcatttgacgcagcgggctcaaaatgccctggacaacctcgtgatgctgcacaatagcgaacagggaggccgagcatacagacatgcgatggaggagcttcccgataccattgaaacactgatgctcttggccctgatcgctgtcttaactggtggggtgaccctatttttcctgtcaggccgcggactcggcaaaacaagtattgggcttctgtgtgttatggccagctccgtgttgctgtggatggcatctgtcgagcctcactggatcgctgccagcataatcctcgaatttttcctgatggtacttctcattcccgagccagacaggcagcggacccctcaggataaccaactggcatatgtggttatcggattgctgtttatgattttaactgtggccgctaatgagatgggtctactggaaacgaccaagaaagacctcggcatcgggcacgtcgcggtggagaaccatcaccatgccacaatgcttgatgtcgacctgcaccccgcatccgcttggactttgtacgccgtggccaccacaataattaccccaatgatgcgtcatactatcgaaaacacaacggcaaatatttcactgaccgctatcgccaaccaggcggctatactcatgggactggataagggctggcctatctctaaaatggacattggtgttccgcttttagccctggggtgctacagtcaggtgaatcccctcactttgacagcagccgtactgatgctagtggctcactatgcaatcattggcccaggactgcaagccaaggcgaccagagaggctcagaagaggaccgccgcaggcatcatgaaaaaccctacagtcgatgggatagttgccattgacctcgatcccgtggtctacgacgctaagttcgaaaaacagcttggacagatcatgctgttgatcctgtgtacttcgcaaattctcctgatgcgcacgacctgggccttatgcgagagcatcacacttgcaactggcccactgaccacactctgggagggttcccctgggaagttttggaataccactatagctgtgtctatggccaacattttccggggatcatatctagcgggcgccggtctggcatttagcttgatgaaatccctgggcgggggacgaagaggcacgggggctcagggagaaacactcggcgagaagtggaagaggcagcttaatcagctgagtaaatctgaattcaacatctacaagcgcagcggtattatggaggtagaccggtcagaagccaaagaggggttgaagagaggagagaccactcgtcacgcagtgtccaggggcaccgctaaactgcggtggttcgttgaacgcaatctcgtgaagcccgagggtaaggtcatcgatttaggctgtgggcgaggaggctggagttattactgcgccgggctgaaaaaggtgacagaagtcaaaggatatactaagggcggtccggggcatgaggaaccaatacctatggccacctacggatggaaccttgtgaaactgcacagcggcaaggacgtttttttcacacccccagagaaatgtgatacgctactctgcgacatcggcgagtcttcccccaatcctaccattgaagaggggagaactctgagggtattgaagatggtggaaccgtggctgcggggaaaccaattttgtatcaagattctcaatccctacatgccatcagtcgtggagacacttgagcagatgcagcgcaaacatggtggcatgctggttagaaaccctttaagcaggaattcgacccacgaaatgtattgggtgtcttgcgggactggaaacatcgtcagtgcggtgaatatgacatcccgaatgctgttgaaccggttcaccatggctcaccgtaagcccacgtacgagagagatgtagacctcggcgcaggtacccgccatgtggccgttgaacctgaggtcgctaacctggatattatcgggcagaggatagaaaatattaaacacgagcataagagcacatggcactatgacgaggataacccatacaaaacttgggcctatcatggatcatacgaagtgaagccctccggctctgcaagcagtatggtgaatggcgtcgttaagctacttaccaaaccttgggacgtgatcccaatggtaacacaaatcgccatgactgataccacaccctttgggcagcagcgggtgttcaaggagaaagtcgacaccagaactccgaaggctaaacgcggaacggcgcaaattatggaagtgacagccaggtggctgtggggttttctctcccgaaacaagaagcctcggatatgtaccagagaggaattcactaggaaagttcgcagcaatgcagctatcggcgccgtgtttgtcgacgagaaccagtggaattctgcaaaggaggccgtggaagatgagcgtttctgggacctggtacagaaagaacgggagttgcacaagcaggggaaatgcgctacctgcgtttataacatgatgggaaagagagaaaagaaactgggcgagtttggtaaggccaaagggtcaagggcgatttggtacatgtggctcggagcacgcttccttgagtttgaagccctgggcttcatgaatgaggatcactggttcagtcgagaaaactccttaagcggcgtggagggggagggactgcataagttgggttacatcctccgggacatttctaaaatcccaggcgggaatatgtatgctgatgacacagccggatgggatacgagaataaccgaagacgatctgcaaaacgaggcaaagatcactgacattatggaacccgagcacgctctacttgccacatcgatctttaaactgacctaccagaataaggtcgtgagggtgcagcgccctgctaagaacggcactgtcatggatgttatttcaagacgggaccagaggggtagcgggcaagtgggaacatatggcctcaataccttcacaaacatggaagcccagctgatccgtcagatggagtccgagggcatatttttgccaagtgaattagagactcccaacctggcagaacgagtactcgattggcttgagaaacatggggtggaacgcctgaagagaatggcgatttctggagacgactgtgtcgtgaaaccgatcgatgaccggttcgccaccgctctaacggccctgaatgatatgggtaaggttaggaaagacatccctcagtgggagcccagcaagggctggaacgattggcaacaggtgccattttgctcccaccacttccatcagctcattatgaaggacgggcgcgagatagtcgtgccttgtagaaatcaggatgaattggtaggacgggcaagggtttcacaaggcgctggttggagtctgcgagagaccgcctgccttgggaaatcttacgcacagatgtggcagctgatgtattttcaccgtagagacctccgcttagccgcgaacgctatctgtagcgccgtgcccgtcgattgggtgccaacatcccggactacctggtcaattcatgcacaccatcaatggatgacaactgaagacatgctgagcgtttggaatagggtgtggatcgaggaaaacccctggatggaggataagacccacgtctcttcctggggagacgtgccttacttgggcaaaagagaggaccagtggtgcggcagtctgattgggctcacggcccgcgctacatgggccagcaatatccaggtagcaataaaccaggtgcggaggcttatcggaaatgaaaactatctggattacatgacctcgatgaagcgattcaaaaatgagggtgacccagaaggcgctctatggtga

SEQ ID NO: 13879 - RNA, 9879 nt, synthetic construct
  misc_feature 1..9879: note = derived and/or modified CDS sequence (opt3) from DENV-1__GU131688__SS-prME
  source 1..9879: mol_type = other RNA
tccgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccgatcctgccgtgctcaggaaactgtgcattgaagctaagatctctaacacgaccacagacagccggtgtccaactcaaggagaggccacccttgtcgaagaacaagatgcaaattttgtttgccgccgaacattcgtggacagaggctggggtaacgggtgtggactgtttggcaaaggctccttgatgacttgcgctaagttcaagtgcgtaaccaaactcgaggggaagatagtgcagtacgaaaatctgaaatattcagtcattgtgacagttcacaccggagaccagcatcaagtgggtaacgagagtactgaacacggcacgacagccaccatcactccccaggcgcctagcaccgagattcagttaacagattacggggccctgaccctcgactgttctccaaggactggacttgattttaatgaaatggtcctgttgacaatgaaggagaaatcctggctagtgcataagcagtggttcctggacctcccgctgccctggacgtcaggcgcaagcaccagtcaagagacttggaaccggaaagatcttctggtaacatttaagaccgctcacgccaagaaacaggaagttgtggtcttgggttctcaggagggggctatgcacacagccctcactggcgcaaccgaaatccaaacgtccggaaccacaactatcttcgccggccatctgaagtgccgtttaaaaatggacaagctgaccctaaaagggatgagctatgtgatgtgtacaggatcgttcaagctcgagaaggaagtcgctgagactcagcacggtaccgtgctggttcagattaaatacgagggcacggatgcgccttgcaagataccattttctacacaggacgaaaaaggggtgacccaaaatggacgccttatcactgcaaaccccattgtaacagataaggagaaacctgtcaatatcgaagccgagccacccttcggcgagtcctatatagtgattggtgctggggaaaaggccttgaagctgtcatggtttaaaaagggcagtagcatcggaaaaatgttcgaggcaaccgccagaggcgctaggcggatggccatcctcggggacactgcatgggattttggatccattggtggcgttttcacctctgtggggaagctggtccatcagatctttggaacagcgtacggcgtgcttttcagcggtgtatcatggacgatgaaaattgggataggcgtgctgttgacctggctcggactgaacagtcgatccactagcttatctatgacatgtatcgctgttggcctggtcaccctatacctcggggtgatggtgcaggccgactcaggatgcgtcattaattggaagggccgcgaactgaagtgtggtagtgggatctttgttacaaacgaggtgcacacttggaccgaacagtataaattccaagcagacagcccgaagagactttccgccgctatcggaaaagcctgggaggagggcgtgtgcggtattaggtctgcaacgcggttggaaaatataatgtggaagcagatctcgaacgagctgaaccatattctcctggaaaatgatatgaaatttacagtagtcgtgggcgacgttgctgggatcttagcccagggaaagaaaatgattcgccctcagcccatggagtacaagtatagctggaagtcctggggcaaagcgaagatcataggggccgatgtgcaaaacaccactttcatcattgacggaccaaatacccctgaatgtcccgatgaccagagagcttggaacatctgggaggtcgaggattacggctttggtattttcacaactaatatctggctgaaacttagggactcatatacccaggtgtgcgatcaccgtttgatgagtgcagccataaaggactctaaagctgttcacgccgatatggggtactggattgaaagcgagaagaacgaaacatggaagctcgcacgggcgtccttcatcgaggtgaaaacgtgtatttggccaaagtcacataccctgtggagcaatggagtactagaatctgagatgatcatacccaaaatctatggcggtcctatttcccagcacaactaccgaccaggctactttactcaaacagccgggccgtggcatctgggaaagctcgagctggacttcgatctttgcgaaggcaccactgtcgtggtggacgagcactgcgggaatagaggacccagtttgaggacaaccacggtcactggcaaaatcattcacgaatggtgttgccgcagctgtaccctgcctccattacggtttaagggtgaggacgggtgctggtatggaatggagatcagacccgttaaggaaaaagaggaaaacctcgtgaagtctatggtatccgctggctcaggtgaggtggatagtttcagcctgggccttctgtgtatatcgattatgatcgaagaggtcatgaggtcccgctggtctcgaaaaatgttgatgacagggaccctcgccgtgtttttcctgctaatcatgggacagctgacttggaatgacctcattcggctgtgcatcatggttggcgcaaacgctagcgatcgtatggggatgggaacaacctaccttgccttgatggcaacatttaagatgagacctatgttcgccgtgggcctgttatttaggcgcctcacttcacgggaggtcctgcttctgaccattggtctaagtctcgtggcttccgttgaactgccaaattctttggaggaactgggggacggattagcgatgggcataatgatcctcaaactgcttacggatttccagagccatcaactgtgggccacattgctctccctgacctttattaagactaccttctcactacactatgcatggaagacaatggctatggtgctgagcatcgtcagtctttttcccctctgtctgtctactacctcccagaaaacgacatggttgccggtactgttaggcagcctcgggtgcaagcctctgaccatgttccttattgccgagaacaaaatctggggaagaaagtcgtggccactgaatgaaggtataatggccgtgggcatcgtttcaattttgctctctgctctgctcaagaatgacgtgcccctggcagggcctcttatcgccggaggcatgctcattgcgtgttacgtcatcagtggttccagcgctgatctgtctttggagaaggccgcagaggtgagctgggaagaggaagccgagcattccggggcttcacacaacatattagtagaagtgcaggacgatggaactatgaaaattaaggacgaggagagggatgacacactgaccatcctcctgaaggcaactcttctggccgtcagtggcgtttatcccttgagcatcccagcgacactattcgtgtggtacttttggcagaaaaagaaacaacgatctggcgtgctgtgggataccccttcacccccagaagtcgagcgcgctgtgctcgacgacgggatttatcggataatgcagagaggactgcttggtaggagccaggttggcgtaggggtgttccaggaaaatgtctttcatacgatgtggcacgtgactcgtggagccgttttaatgtaccaaggcaagcgcctggagccgagttgggcaagcgtgaaaaaggatctcatctcctacggtgggggatggcggttgcagggctcttggaacaccggcgaggaagtccaggtgattgccgtagagcctgggaagaatcccaaaaacgtccagacagctccaggaaccttcaagacatcggaaggtgaggtgggcgccatcgcactggactttaaacccgggactagcggatcacctattgttaatagagaaggcaagatcgtgggtctctatgggaacggagtcgtgaccacgtccggcacatacgttagtgctatagcccaagcgaaagcctctcaggagggcccactgcccgagatcgaagatgaggtgttcaggaagcgaaatcttactattatggacctgcaccctgggagcggaaagacccggcgctatttgccggcaatcgtcagagaagctattaaaaggaagctacggacactgatcctcgccccaacccgagtggtagcttccgagatggcagaagccttaaaaggtatgcccataagataccagactaccgccgtgaagtcagagcatacaggcaaagagattgttgatctgatgtgccacgctacgtttactatgcgccttctgtctcctgtcagggtgccaaactataatatgatcatcatggacgaagcgcatttcaccgatcccagcagtattgcagcccgtgggtacatctccacacgggtgggaatgggcgaggctgccgcaatatttatgaccgccactcctccgggtagcgtcgaggctttcccccaatctaacgcggtaattcaggacgaggaaagagatatcccagagaggtcatggaactccgggtatgagtggattacagactttcctggaaagaccgtgtggttcgttcccagtatcaagagcggcaacgatatagccaattgtctccgcaaaaacggcaagcgagtgattcagttgtcgagaaaaacgttcgacactgaataccagaagaccaaaaataacgactgggattacgtcgtgaccaccgacatctctgagatgggggcaaactttcgggctgatagggttatcgacccacgccgttgcctgaagcctgtgattctcaaggatggacccgaaagagtcatcctggccggtccaatgccggtgactgtagcatccgccgctcaacggaggggccgcattgggcgaaatcacaacaaagagggagaccagtatatatacatgggccagcctcttaataacgatgaggaccatgcccactggacagaagcgaagatgctactggataatatcaacacccccgagggtattatcccagcattgttcgaacccgagagagagaaaagcgccgctatcgacggggagtatcggttaaggggcgaggcccgcaagacatttgtggaactgatgagaaggggagatctccctgtttggctgtcatacaaagtcgctagtgagggcttccagtattctgaccggcgttggtgctttgatggggaacgcaataaccaagtgcttgaggaaaatatggacgtggagatttggactaaggagggagaaaggaaaaagctgagaccaagatggctcgacgcacggacgtactccgatcccttggccctgcgcgagttcaaggaatttgctgccggtagaaggagcgtctcaggcgacctaatactggagatcgggaaactccctcagcaccttacccagcgggcacagaacgcgctggataatttagttatgttgcataacagtgaacaaggaggccgagcctatagacacgctatggaggagctgccggacacaattgaaactctcatgctgcttgccctgatcgcagtgctcaccggtggggtaacattgttctttctgagcggccgcggattaggcaagacctccattgggctactgtgtgtgatggcttctagcgtcctcctttggatggcctccgtggagccacattggatcgcagcctcaataatcctggagttctttttgatggttctgctcattcccgagcctgataggcagcggactccccaggacaatcagctggcttacgtggtcatcggacttctcttcatgattctgacggtagcggccaacgagatgggtttgctggaaaccaccaaaaaggatttaggcatcgggcacgtggcagttgagaatcaccatcacgctgccatgctagacgtggatctgcatccagcctctgcatggactctctacgctgtcgccaccacaataattacccctatgatgcgtcacactatcgaaaacacaacggcgaacattagtcttaccgctatcgccaatcaagcagccatactgatgggattggacaaaggctggcccatctcgaagatggatattggtgtgccactgctcgctctggggtgctatagccaggtcaaccctcttactttaacagcagccgtgctgatgctcgttgcgcattacgctatcattggcccgggattgcaggccaaggcaaccagagaggcccagaaaaggaccgctgccggcatcatgaagaatcccacagtggacgggatagtagcaattgatctggacccagtggtctatgacgctaaatttgaaaagcagctaggacagatcatgctgctcatcctttgtacttcccagattctgttgatgcgcacgacctgggccctgtgcgagtctatcacactcgcgactggccctctgaccacattatgggagggttcacccgggaaattctggaacaccactatagccgttagcatggcaaatattttccggggatcctaccttgctggcgccggtctggcatttagtctcatgaagtctctaggcgggggacgaagaggcacgggggctcaaggagaaacactgggcgagaagtggaaaaggcagttgaaccagctgagcaagtcagagttcaatacctataaacgctccggtatcatggaggtggatcggagtgaagccaaggaggggctcaaaagaggagagactaccaagcacgccgtcagccgtggcacagcgaaacttaggtggtttgtggaacggaacctggtaaaaccagagggtaaggtgattgacttgggctgtgggcgcggaggctggtcttactattgcgctgggctgaaaaaggttactgaagtgaaaggatacaccaagggcggtcctgggcacgaggaacccatcccgatggcaacatacggatggaatctcgtcaaattacattccggcaaggatgtgttctttataccacctgagaagtgtgacacgctgctttgcgatatcggcgagtcaagccccaacccaaccattgaagaggggcgaactctgagagtcctaaaaatggtggaaccctggctcaggggaaatcagttctgtatcaagattctgaacccttatatgccgtcggttgtagagacattggagcaaatgcagcggaaacacggtggcatgctggtgcgcaatcccctctctagaaacagtacccatgaaatgtactgggtctcctgcgggactggaaatatcgtgagcgccgttaacatgacatcaaggatgcttctgaatcgatttaccatggctcaccggaagccaacgtatgagcgtgacgtggatttaggcgccggtaccagacacgtcgcagtggaacctgaggtagccaacctggacattatcgggcagcgcatagaaaacattaaacatgagcacaagtccacatggcattacgatgaggacaatccctataagacttgggcttaccacggatcttatgaagtgaaacctagcggcagtgcgtccagcatggttaacggcgtcgtgaagttgctcaccaaaccatgggatgtgatccccatggtcacacagatcgccatgactgacaccacacctttcgggcaacagagggtttttaaggagaaagtggacacccggactccaaaggcaaagagaggaacggctcagattatggaagtaacagccaaatggctgtggggtttcctatctcgcaataagaaacccaggatatgtacccgagaggaatttactcggaaggtgagatcaaacgcagccatcggcgctgtcttcgtggatgagaatcaatggaacagtgccaaagaggcggttgaagacgagaggttttgggatcttgtgcatcgcgaacgtgagctgcacaagcaggggaagtgcgcaacctgcgtctacaatatgatgggaaaacgggaaaagaaactcggcgagttcggtaaggccaaagggtccagagctatttggtacatgtggctgggagccaggttcttggagtttgaagcactgggcttcatgaacgaggaccactggtttagccgcgaaaattctctctcgggcgtggagggggagggacttcataagctgggttatatcttacgagatatttcaaaaatcccgggcgggaacatgtacgctgacgatacagccggatgggacacgcggataaccgaagatgacctgcagaatgaggctaagatcactgatattatggaacctgagcacgccttgctcgcaaagagcatcttcaaactgacatatcagaacaaggtagttagagtgcaaaggccagcgaaaaatggcaccgtcatggacgtgatttcccgcagagatcagcggggtagtggacaggtgggaacttacggcctaaacacatttaccaatatggaagcccagcttatcaggcaaatggagtctgagggcatattcagcccctccgaactggagacacctaacctcgctgggcgtgtcctggactggttggaaaagcatggagttgagcgattaaaacgcatggccatttcaggtgacgattgtgtggtaaagccaatcgacgatagatttgcagctgccctgactgcactcaacgacatgggcaaggtgcggaaagatatcccccagtgggaaccgagtaaggggtggaatgactggcagcaggtccctttctgctctcaccactttcatcaacttattatgaaagatggaagggagatagtggttccctgtcgcaaccaggacgagctggtgggcagagcccgggtcagccagggtgcggggtggtccctaagggaaaccgcttgcctgggaaagtcatatgcccagatgtggcaactcatgtacttccaccgacgtgatttgagactggcagccaatgctatctgtagcgccgtgccagtagactgggttcctacgtctcgcaccacatggtccattcatgcacaccatcagtggatgactaccgaggatatgcttagtgtgtggaaccgggtctggatcgaagagaatccctggatggaagacaaaacacacattagctcgtggggcgacgtgccatatctgggcaagagggaggatcagtggtgcgggtccctcatcggattaactgctagagccacctgggcgacgaacatacaagttgctatcaatcaggtgcgccggctgattggtaacgagaattacttggactacatgacatctatgaagaggtttaaaaacgaatcagatcccgagggcgccctgtggtga

SEQ ID NO: 13880 - RNA, 9879 nt, synthetic construct
  misc_feature 1..9879: note = derived and/or modified CDS sequence (opt3) from DENV-1__GU131689__SS-prME
  source 1..9879: mol_type = other RNA
agcgtgaccatgttcctgatgctcatgcccacagcccttgcttttcacctgactacgagaggcggggagcctcatatgatcgtctccaagcaggaaaggggaaaatctttgttattcaagacctcagcaggtgttaacatgtgcacactgattgccatggacctaggcgagttttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctcgcaccccatgtcggcctgggtcttgagactagaaccgaaacatggatgtcctctgagggggcctggaaacagatccagagggtggaaacttgggctctgcggcaccctggattcaccgttattgcattgtttctcgcccatgctatcggcacatcgattacccagaagggcatcatattcatcctgctgatgctcgtgacgccatcaatggccatgcgctgcgtcgggattggaagcagagattttgtggagggtttaagtggcgcgacttgggtagacgttgtgctggagcacgggtcctgtgtcacaaccatggcaaaggataaacccactcttgacatcgaattgctgaagacagaggtgaccaaccctgccgtgctaaggaaactctgcattgaagctaagatctctaatacgaccacagatagccggtgtccaactcaaggagaggccaccctggtcgaagagcaggacgcaaacttcgtttgccgccgaacatttgtggatagaggctggggtaatgggtgtggacttttcggcaaaggctccctgataacttgcgctaagtttaagtgcgtaaccaaattggaggggaagattgtgcagtacgaaaacctcaaatattcagtcatcgtgacagttcacaccggagaccagcatcaagtgggtaatgagagtactgaacacggcacgacagccaccattactccccaggcgcctagcaccgagatccagctgacagactacggggccttaaccctggattgttctccaaggactggactcgacttcaacgaaatggtccttctgacaatgaaggagaaatcctggttggtgcataagcagtggtttctagatctgccgctcccctggacgtcaggcgcaagcaccagtcaagagacttggaatcggcaggacctgcttgtaacattcaaaaccgctcacgccaagaagcaggaagttgtggtcctgggttctcaagagggggctatgcacacagccttgactggcgcaaccgaaatccagacgtccggaaccacaactattttcgccggccatctcaaatgccgtctgaagatggataaattaaccctgaaggggatgagctatgtgatgtgtacaggatcgtttaaactagagaaggaagtcgctgagactcagcacggtaccgtgctcgttcagataaagtacgagggcacggacgcgccttgcaaaatcccattctctacacaagatgaaaagggggtgacccagaacggacgcctgattactgcaaatcccatcgtaacagacaaagagaagcctgtcaacatagaagccgagccaccctttggcgagtcctatattgtgatcggtgctggggaaaaagcccttaagttgtcatggttcaagaaaggcagtagcatcggaaagatgtttgaggcaaccgccagaggcgctaggcggatggccattctgggggatactgcatgggacttcggatccatcggtggcgtttttacctctgtggggaaactcgtccatcagattttcggaacagcgtacggcgtgctgtttagcggtgtatcatggacgatgaagatagggatcggcgtgcttctgacctggttgggactcaatagtcgatccactagcctgtctatgacatgtattgctgttggcttagtcaccctgtacctaggggtgatggtgcaggccgattcaggatgcgtcatcaactggaaaggccgcgaactcaagtgtggtagtgggatcttcgttacaaatgaggtgcacacttggaccgaacaatataagtttcaggcagacagcccgaaaagactgtccgccgctattggaaaggcctgggaggagggcgtgtgcggtataaggtctgcaacgcggcttgaaaacatcatgtggaaacagatttcgaacgagttgaatcatatcctgctcgaaaacgacatgaagctgacagtagtcgtgggcgatgttgctgggattttagcccagggaaaaaagatgatccgccctcaacccatggagtacaaatatagctggaagtcctggggcaaggcgaaaataatcggggccgacgtgcagaataccactttcattatcgatggaccaaacacccctgaatgtcccgacgatcagagagcttggaatatttgggaggtcgaggactacggctttggtatcttcacaactaacatatggctgaagcttagggattcatatacccaggtgtgcgaccaccgtttgatgagtgcagccattaaagattctaaggctgttcacgccgacatggggtactggatcgaaagcgagaaaaatgaaacatggaagctcgcacgggcgtccttcattgaggtgaagacgtgtgtatggccaaaatcacataccctgtggagcaacggagtcctagaatctgagatgatcatacccaagatctatggcggtcctatttcccaacacaattaccgaccaggctactttactcagacagccgggccgtggcatctgggaaaactcgagctggatttcgacctttgcgaaggcaccactgtggtggtcgatgagcactgcgggaacagaggacccagtttgaggacaaccacggttactggcaagatcattcacgaatggtgttgccgcagctgtaccctgcctccattacggtttaaaggtgaggacgggtgctggtatggaatggagatcagacccgtgaaggaaaaggaggaaaatctcgtaaaatctatggtgtccgctggctcaggtgaggtcgacagtttcagcctgggccttctgtgtatatcgattatgatcgaagaggtgatgaggtcccgctggtctcgaaagatgttgatgacagggaccctcgccgtttttttcctgctaatcatgggacagctgacttggaacgatctcattcggctgtgcatcatggtgggcgcaaatgctagcgaccgtatggggatgggaacaacctaccttgccttgatggcaacatttaaaatgagacctatgttcgccgtcggcctgttatttaggcgcctcacttcacgggaggtgctgcttctgaccattggtctaagtctcgttgcttccgtggaactgccaaactctttggaggaactgggggatggattagcgatgggcataatgatcctcaagctgcttacggacttccaaagccatcagctgtgggccacattgctctccctgacctttattagaactaccttctcactacactatgcatggaaaacaatggctatggtcctgagcatcgtaagtctttttcccctctgtctgtctactacctcccagaagacgacatggttgccggtgctgttaggcagcctcgggtgcaagcctctgaccatgttccttattgccgagaataaaatctggggaaggaagtcgtggccactgaacgaaggtataatggccgttggcatcgtgtcaattttgctctctagtctgctaaaaaacgatgtccccctggctgggcctcttatcgcaggaggcatgctcattgcctgttacgtgatctccggtagctctgcggacctgagcttggagaaggctgccgaggtatcctgggaagaggaagcagagcattcaggggccagtcacaatatattagtggaagtccaggatgacggaactatgaaaattaaggatgaggagcgagacgatacactgaccatcctcctgaaagctactcttctggcagttagcggcgtgtatcccttgtctatcccagccacactattcgtgtggtacttttggcaaaagaagaaacagcgctccggcgtcctgtgggacaccccttcacccccagaagtggagcgggcggttctcgatgacgggatttatagaataatgcagaggggactgcttggtcgtagtcaggtaggcgtgggggtcttccaagaaaacgtgtttcatacgatgtggcacgttactcgcggagctgtgttaatgtaccagggcaagcggctggagccgagctgggcctccgtcaaaaaggacctcatctcttacggtgggggatggagattgcagggctcgtggaataccggcgaggaagtgcaggtaattgcagtcgagcctgggaaaaaccccaagaatgtgcaaacagccccaggaaccttcaagacaagcgaaggtgaggttggcgctatcgccctggattttaaacccgggacttcaggatcccctattgtgaacagggaaggcaagatcgtcggtctctatgggaatggagtggttaccacgagtggcacatacgtgtctgcaatagctcaggccaaagcgagccaggagggcccactgcccgagatcgaagacgaggtcttccgaaagcggaaccttactattatggatctgcaccctgggtccggaaaaacccgcagatatttgccggccatcgtgagggaagcaatgaagcggcgactaagaacactgattctcgctccaacccgcgtagtggcctcagagatggctgaagcattaaagggtatgcccatcaggtaccaaactaccgccgttaaatctgagcatacaggcaaggagatagtcgacctgatgtgccacgccacgtttactatgcgtcttctgagccctgtgcgggtgccaaattataacatgattatcatggatgaagctcatttcaccgaccccagttccatcgcggcaagagggtacattagcacaagggtcggaatgggcgaggccgctgccatctttatgaccgcaactcctccgggttctgtagaagccttcccccagtcaaatgctgtgatacaggatgaggaacgcgacattccagagcgatcctggaacagtgggtatgagtggatcacagattttcctggaaaaaccgtttggttcgtgcccagcattaagtcgggcaatgacatcgcgaactgtctcagaaaaaatggcaagcgggtcatacagttgtctaggaagacgttcgatactgaataccaaaaaacaaagaacaacgactgggactacgtggttaccaccgatatttccgagatgggggccaattttcgcgcagaccgtgtgatcgatccaagacggtgcctgaaacctgtcatcctcaaggacggacccgaaagggtgattctggctggtccaatgccggtaactgtggccagcgcagcccagcgccgaggcagaatcgggcggaaccacaataaagagggagatcagtatatttacatgggccagcctcttaacaatgacgaggatcatgctcactggacagaagccaagatgctactggacaacataaatacccccgagggtatcattccagcgttgttcgaacccgagagggaaaagtcagcagccatcgatggggagtatcgcttaagaggcgaggctaggaaaacatttgttgaactgatgcggcgtggagacctccctgtctggctgagttacaaggtggcctctgagggcttccaatattccgatcgccgatggtgctttgacggggaaagaaacaatcaggtgcttgaggaaaacatggatgtcgagatctggactaaagagggagaaaggaagaaactgcggccacgctggctcgacgctagaacgtacagcgaccccttggcactgagggagttcaaggaatttgccgctggtcggcgatcagttagtggcgatctaattctggagatagggaaactccctcagcaccttacccagagagcccaaaatgcactggacaacttagtgatgttgcataatagcgaacagggaggccgcgcgtataggcacgccatggaggagctgccggatacaatcgaaactctcatgctgcttgctctgattgccgtactcaccggtggggtgacattgttctttctgtccggccggggattaggcaagacctctatcgggctactgtgtgtcatggcaagctccgtgctcctttggatggcttcagttgagccacattggattgccgcatctatcatactggaattctttttgatggtgctgctcatccccgagcctgaccgtcagagaactccccaggataaccaactggcctacgtcgtaattggacttctcttcatgatcctgacggtggctgcgaatgagatgggtttgctggaaaccacaaagaaagacttaggcattgggcacgttgccgtggagaaccaccatcacgcagctatgctagatgtcgacctgcatccagccagtgcctggactctctacgcagtggctaccacaatcataacccctatgatgaggcacactattgaaaacacaacggccaatatctcgcttaccgcgattgctaaccaggccgcaatcctgatgggattggataagggctggcccataagcaaaatggacatcggtgtcccactgctcgccctggggtgctattcccaggtgaatcctcttactttaacagctgcagttctgatgctcgtggcccattacgcgattatcggcccgggattgcaagctaaggccacccgcgaggcacagaaacggaccgccgctggcattatgaagaaccccacagtagatgggatcgtggccatagacctggatccagtcgtttatgacgcaaagtttgaaaaacagctaggacagattatgctgctcatcctttgtacttctcaaatcctgttgatgcgaacgacctgggctctgtgcgagtcaattacactcgccactggccctctgaccacattatgggagggtagccccgggaagttctggaataccactatcgcggtgtccatggccaacatattcagaggaagttaccttgcaggcgctggtctggccttttctctcatgaaaagcctaggcgggggaaggcgcggcacgggggcacagggagaaacactgggcgagaagtggaaacggcagttgaatcagctgtcaaagtccgaattcaacacctataagagaagtggtattatggaggtcgaccgtagcgaagctaaagaggggctcaagaggggagagactaccaaacacgccgtgtctcggggcacagccaagcttcgctggtttgtagaacgaaatctggtgaaaccagagggtaaggttatcgatttgggctgtgggagaggaggctggtcctactattgcgcggggctgaagaaagtgactgaagtcaagggatacaccaaaggcggtcctgggcacgaggaacccattccgatggctacatacggatggaacctcgtgaagttacattcaggcaaagacgtcttctttatcccacctgagaagtgtgatacgctgctttgcgacataggcgagagctcgcccaatccaaccatcgaagaggggaggactctgcgggtgctaaaaatggttgaaccctggctccgcggaaaccaattctgtattaagatcctgaatccttatatgccgtctgtagtggagacattggagcagatgcagagaaagcacggtggcatgctggtcaggaaccccctcagtcgaaattccacccatgaaatgtactgggtgagctgcgggactggaaacattgtttcagcagtgaatatgacatcccggatgcttctgaaccgttttaccatggcccacagaaaaccaacgtatgagcgcgatgtcgacttaggcgctggtaccaggcacgtggccgtagaacctgaggaagcaaacctggatatcattgggcagcggatcgagaatataaagcatgagcacaaatctacatggcattacgacgaagataacccctataagacttgggcctaccacggaagctatgaggtgaaacctagtggctccgctagctctatggttaatggcgtcgtgaagttgctcaccaagccatgggacgtgattcccatggtcacacaaatcgcgatgactgataccacacctttcgggcagcagagagtttttaaagaaaaggtggacacccgcactccaaaagccaagaggggaacggcacaaatcatggaggtaacagctaaatggctgtggggtttcctatcacgaaacaagaagccccggatttgtaccagagaagagtttactaggaaagtgcgcagtaatgccgcaataggcgccgtcttcgtggacgagaaccagtggaattccgctaaggaagccgttgaggatgaacgtttttgggaccttgtgcatcgggagagagaactgcacaaacaggggaagtgcgcgacctgcgtctacaacatgatgggaaaaagggagaagaagctcggcgagttcggtaaagcaaaggggagccgcgccatctggtacatgtggctgggagctcgattcttggaatttgaggccctgggcttcatgaatgaagatcactggttttctcgggagaactcgctctcaggcgtggagggggaaggacttcataaactgggttatattttaagagacatcagcaagattccgggcgggaatatgtacgcagatgacacagctggatgggatacgaggatcaccgaggacgatctgcagaacgaagccaaaataactgacatcatggagcctgaacacgctttgctcgccaagtccattttcaaactgacatatcaaaataaggtagttcgcgtgcagagaccagcaaagaacggcaccgtcatggatgtgatcagtcggagggaccagcgtggttctgggcaggtgggaacttacggcctaaatacatttaccaacatggaggcgcaacttattcgacagatggagagcgaaggcatcttctccccctcagagctggaaacacctaacctcgccgggcgcgtcctggattggttggagaaacatggagttgaaagattaaagcggatggctataagtggtgacgactgtgtggtaaaaccaattgatgacaggtttgccactgcactgaccgctctcaatgatatgggcaaggtgcgcaaagacatcccccagtgggagccgtctaaggggtggaacgattggcagcaagtccctttctgcagccaccactttcatcagcttatcatgaaggacggaagagagattgtggttccctgtcggaatcaggatgaactggtgggcagggcccgagtctcccagggtgcagggtggtcactacgtgagacggcctgcctgggaaaaagctatgcgcaaatgtggcagctcatgtacttccacagacgcgacttgcggctggctgccaacgcaatatgttctgccgtgccagtagattgggttcctacctccaggacaacttggagtatccatgctcaccatcagtggatgaccacagaagacatgcttagcgtgtggaatagagtctggattgaggaaaacccctggatggaggataagactcacgtgtcgtcctggggcgacgttccatatctgggcaaacgcgaggaccaatggtgcgggtctctcatcggattaaccgcccgggcaacgtgggctacaaatattcaggtggccatcaaccaggtcaggcgactgttgggtaatgaaaactacctggattacatgacctcaatgaagagatttaaaaatgagagcgaccccgaaggcgcgctctggtga

SEQ ID NO: 13881 - RNA, 9879 nt, synthetic construct
  misc_feature 1..9879: note = derived and/or modified CDS sequence (opt3) from DENV-1__GU131690__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacgctgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgtgacccggctcgaaaacatcatgtggaaacagatttctaacgagctgaatcatatcttactggaaaacgacatgaagttcactgtagtcgtgggcgatgttgccgggattcttgcacagggcaagaagatgatccgccctcaacccatggagcacaaatactcgtggaaaagctggggcaaggctaagataatcggggccgacgtgcagaataccacatttattatcgatggaccaaacactcctgaatgtcccgacgatcagagagcgtggaatatttgggaggtcgaggactatggcttcggtatctttaccacaaacatatggttgaagctcagggattcctacacacaggtgtgcgaccaccgtctgatgtcagccgctattaaagatagtaaggcagttcatgccgacatggggtattggatcgaatctgagaaaaatgaaacctggaagctagctcgggccagcttcattgaggtgaagacttgtatctggccaaaatcccacacactgtggtcaaacggagtactcgaaagcgagatgataatccccaagatttacggcggtcctatctctcaacataattatcgaccaggctacttcacccagactgcagggccgtggcacctgggaaaacttgagttggattttgacctgtgcgaaggcacaaccgtcgtggtggatgagcactgcgggaacagaggaccctccttaaggacgactaccgtcacaggcaagattatccatgaatggtgttgccgcagttgtaccctccctccactgcggttcagaggtgaggacgggtgctggtacggaatggagataaggcccgttaaagaaaaggaggaaaatcttgtgaagtccatggtatctgcgggctccggtgaggtggactcatttagtctgggcttgctctgtattagcatcatgatcgaagaggtcatgcgctcgcgatggtcccggaaaatgctgatgactgggacactagccgtgttctttctgctcattgttggacagctgacctggaacgatcttatccgtttgtgcattatggtgggcgctaatgcctctgacagaatggggatgggaacaacttatctggcattaatggctaccttcaagatgaggcctatgtttgccgtcggcctcctgttccgccggcttacgagcagagaggtgctgctactcacaataggtctgtcattggttgcaagtgtggaactgccaaactccttagaggaactcggggatggactggccatgggcatcatgattcttaaactgttgaccgactttcaatctcaccagctctgggctactctgctaagcctgaccttcatcaagacaactttttcccttcattacgcgtggaaaaccatggccatggtcctctcagtagtgagcctgttccccttgtgtctgagtacgacatctcagaagaccacttggttaccggttctcctgggctcccttgggtgcaagcctctgacaatgtttttgattgcagagaataaaatctggggaaggcgaagctggccactcaacgaaggtataatggctgtgggcatcgtctcgattctgctatcatctctgcttaagaacgatgtgcccctcgccgggcctctgatcgccggaggcatgttgattgcttgttatgtaatcagtggttccagcgcagacttatctctggagaaagccgcggaggtgagctgggaagaggaagctgagcactccggggcctcacataatatactcgtcgaagttcaggatgacggaaccatgaagattaaagatgaggagcgcgacgatactctgacaatccttctgaaggcaaccttgctagccgtgagtggcgtgtaccccctgagcatcccagctacactcttcgtctggtatttctggcagaagaagaagcagcggtctggcgtgctgtgggacactccttcacccccagaagttgagagagcagtacttgatgacgggatttacaggataatgcagcgtggattactgggtcgcagccaggtgggcgtcggggtgtttcaagaaaacgttttccacaccatgtggcacgtgacacggggagccgtcctcatgtatcagggcaaaagattggagccgagttgggcgagcgtgaagaaagacctgatctcctacggtgggggatggaggctccagggctcttggaataccggcgaggaagtacaggtcattgctgtggagcctgggaagaaccccaaaaatgttcaaacagccccaggaacttttaagacccccgaaggtgaggtgggcgcaatcgccctggatttcaagcctgggacgtcgggaagcccaattgtcaaccgagaaggcaaaatcgtgggtctttacgggaatggagttgtgacaacttcaggcacctatgtctccgctatagcccaggcaaaggctagtcaggagggccccctgcctgagatcgaagacgaggtgtttcggaaacgcaacttgacaattatggatctacatccggggtctggaaagaccagaaggtacctgccagccatcgtacgggaagcgattaaacgaaagctcagaactttaatcctggcccccacccgcgtggttgcaagcgagatggctgaagcccttaagggtatgcctataaggtatcaaacaacggctgtcaaatccgagcacactggcaaggagattgtggacctgatgtgccatgcaaccttcacaatgcgtctcttgtcaccagtgcgggtccccaattacaacatgatcatcatggatgaagcccactttaccgacccttctagcattgccgctagagggtatatcagtactagggtaggaatgggcgaggcggcagccatattcatgacagctaccccgcccggttccgtggaagcctttccacagagcaatgcagttattcaggatgaggaacgcgacatccctgagcgatcttggaactcagggtacgagtggattacggatttccccggaaaaactgtgtggtttgtcccatccatcaagagtggcaatgacatagccaactgtctgaggaaaaatggcaagcgggtgattcagctcagcaggaagacattcgataccgaatatcagaaaaccaagaacaacgactgggactacgttgtgactacagatatctcggagatgggggctaatttccgcgcggaccgtgtcatcgatcctagacggtgcctgaaacccgtgattcttaaggacggaccagaaagggtaatcctagccggtccgatgcctgtgaccgttgcatctgctgcccagcgccgaggcagaattgggcggaaccataataaagagggagatcagtacatatatatgggccagcccctgaacaatgacgaggatcacgcacactggacagaagccaagatgttgttagacaacatcaatactccagagggtattatccccgctctgtttgaacctgagagggaaaagtccgccgcgatcgatggggagtaccgcctcagaggcgaggcaaggaaaacgttcgtcgaactgatgcggcgtggagaccttccagtgtggctgagctataaggtggcctcagagggctttcaatacagtgatcgccgatggtgcttcgacggggaaagaaacaatcaggtcctcgaggaaaacatggatgttgagatttggaccaaagagggagaaaggaagaaattgcggccccgctggctggacgctagaacatattctgaccctctagccctgagggagtttaaggagttcgctgcaggtcggcgatccgtgagcggcgatctcatacttgagatcgggaaactgccgcagcatttaactcagagagcccaaaatgctttggacaacctggtaatgctccacaattcagaacagggaggccgcgcctacaggcatgcaatggaggagctgccagataccattgaaacacttatgctgctcgcgttgatcgccgtgctgaccggtggggtcactttatttttcctaagtggccggggactgggcaagacgagcattgggctcctttgtgtgatggcttcctctgttctgttgtggatggccagcgtggagccccactggatcgcagcttccataatcctggaatttttcctcatggtcctgcttattcctgagcccgaccgtcagagaaccccacaggataaccaactcgcctatgtagtgatcggactgttgtttatgattctgacagttgcagccaatgagatgggtttactagaaactaccaagaaagacctgggcatcgggcacgtggctgtcgagaaccatcaccatgcggccatgctcgatgtggaccttcaccctgcatcagcttggacactgtacgccgtcgccaccactataattacacccatgatgaggcatacgatcgaaaacaccactgcaaatatttctttgacagctatcgccaaccaggcggctatactgatgggactcgataagggctggccaatcagtaaaatggacattggtgtgcctctgcttgccttagggtgctactcgcaggttaatccgctgaccctcaccgcagccgtgttgatgctggtagctcactatgcaatcattggccccggactacaagccaaggcgacacgcgaggctcagaaacggactgccgcaggcatcatgaagaacccaacggtggatgggatagtcgccattgacctggatcctgttgtgtacgacgctaagttcgaaaaacagctcggacagatcatgcttctgatcttgtgtaccagccaaattctgctcatgcgaacaacttgggccctgtgcgagtccatcaccttagcaacaggcccccttaccactctgtgggagggttctccagggaagttttggaatacgacaatagctgtctcaatggccaacattttcagaggaagctatctcgcgggcgccggtctagcattctccctgatgaaaagtttgggcgggggaaggcgcggcaccggggctcagggagaaactctgggcgagaagtggaaacggcagctcaatcagctttctaagagcgaatttaacacctacaagagatcaggtatcatggaggtggaccgttccgaagccaaagaggggctgaagaggggagagacaactaaacacgcagtaagtcggggcaccgctaagttgcgctggttcgtggaacgaaatctggttaaacctgagggtaaggtgattgatctcggctgtgggagaggaggctggagctattactgcgccgggttaaagaaagtcacagaagtgaagggatatacgaaaggcggtcccgggcatgaggaaccgatcccaatggccacctacggatggaacctggtcaaacttcactctggcaaagacgtgtttttcatacctcccgagaagtgtgatactctgctatgcgacatcggcgagtcctcaccaaatcccacaattgaagaggggaggaccctccgggttctgaaaatggtagaaccttggttgcgcggaaaccaattttgtatcaagattctgaatccgtacatgcccagcgtggtcgagactctcgagcagatgcagagaaagcatggtggcatgcttgtgaggaacccactgtcgcgaaattctacacacgaaatgtattgggttagttgcgggaccggaaacatcgtgtccgcggtcaatatgacgagccggatgttactgaaccgtttcaccatggctcacagaaaacctacatacgagcgcgatgtggacttgggcgcaggtactaggcatgtagccgtggaacccgaggttgctaacctcgatattatcgggcagcggatagaaaatattaagcacgagcataaatcaacctggcactatgacgaggataacccttacaagacatgggcctatcatggatcctacgaagtcaaaccatctggcagcgcaagttccatggtgaatggcgtggtcaagctgctaactaagccctgggacgttatccctatggtgacccaaatcgccatgacagataccactccatttgggcagcagagagtattcaaagagaaggtggacacgcgcacacccaaagctaagaggggaaccgcgcaaattatggaagtcactgccaaatggctttggggttttctgagccgaaacaagaagccgcggatatgtaccagagaggagttcacaaggaaagtgcgctctaatgcagctatcggcgccgtttttgtggacgagaaccagtggaactcagcaaaggaggccgtcgaagatgagcgtttctgggacctcgtgcaccgggaaagagagctgcacaaacaggggaagtgcgctacgtgcgtatataacatgatgggaaaaagggaaaagaagttgggcgagtttggtaaagccaaggggagtcgcgcgatttggtacatgtggctgggagcacgattcctcgagttcgaagcccttggctttatgaatgaggatcattggttctcccgggaaaacagcctgtctggcgttgagggggagggattacacaaactgggttacatcttgagagacatttcgaagatccctggcgggaatatgtatgctgatgacaccgccggatgggatactaggataacagaagacgatctccagaacgaggcacgcatcaccgacattatggaaccagagcatgctctgctagccaaatcaatctttaaacttacttaccaaaataaagtggtcagagtgcagcggcccgctaagaacggcacagtgatggatgtcattagcaggcgtgaccagcgaggttccgggcaggttggaacctatggcctgaatacattcactaacatggaagcccaactcatccgccagatggagagtgagggcatattttctcctagcgaactggagaccccaaacttggcagaaagagtgttagattggctggagaagtacggggtagaacggctcaaaaggatggcgatttccggagacgactgtgtggtcaagcccatcgatgaccgcttcgccacggctcttaccgccctgaatgatatgggtaaagtgagaaaggacatcccgcagtgggagccttcaaaaggctggaacgattggcagcaagttcccttttgcagtcaccacttccatcagctaattatgaaggacgggcgggagatagtggtcccatgtaggaatcaggatgaactggtgggacgagcacgtgtatctcagggcgctggttggagcctcagagagacagcctgcttggggaagtcctatgcacaaatgtggcagctgatgtactttcaccgccgggaccttaggctggccgcgaacgctatctgttcagccgttcctgtggattggattcccactagcagaaccacatggtctatccatgcacaccatcagtggatgactaccgaagacatgctctccgtctggaatcgcgtgtggattgaggaaaacccatggatggaggataaaacgcacatcagtagctggggagacgttccctatttaggcaagcgggaggaccaatggtgcggctcgctgatagggttgacagccagggctacctgggccactaatatccaggtggcaattaaccaggtccgaagactgatcggaaatgaaaactacctcgattacatgacatccatgaaacggttcaagaatgagtctgaccctgaaggtgctctttggtga

SEQ ID NO: 13882 - RNA, 9879 nt, synthetic construct
  misc_feature 1..9879: note = derived and/or modified CDS sequence (opt3) from DENV-1__GU131695__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggagaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacggcatgaagttcactgtagtcgtgggggacgttgcaggcattctggctcagggcaaaaagatgatccgccctcaacccatggagtacaaatattcgtggaaaagctgggggaaggccaagataatcggagcggatgtgcagaataccacatttattatcgacggcccaaacactcctgaatgtcccgatgaccagagagcctggaatatttgggaggtcgaggattacggtttcgggatctttaccacaaacatatggcttaagttgagggactcctatacacaggtgtgcgatcaccgtctcatgtcagctgcaattaaagacagtaaggccgttcacgctgatatgggatactggatcgaatctgagaaaaatgaaacctggaagctggcccgggccagcttcattgaggtgaagacttgtatctggccaaaatcccatacactatggtcaaacggcgtactggaaagcgagatgataatccccaagatttatggtggccctatctctcaacacaattaccgaccagggtacttcacccagactgcgggaccgtggcatctcggcaaactggagcttgactttgatttgtgcgaagggacaaccgtcgtggtggacgagcactgcggaaacagaggcccctccctgaggacgactaccgtcacaggtaagattatccacgaatggtgttgccgcacctgtactttacctccactccggttcagaggggaggatggatgctggtatggcatggagataaggcccgttaaagaaaaggaggaaaatctggtgaagagtatggtaagcgccggttctggcgaggtggactccttttcacttgggctgttgtgtattagtatcatgatcgaagaggtcatgcgcagccgatggtcgcggaaaatgctcatgacaggaaccctggctgtgttctttctactgattatgggccagctcacatggaacgacctgatccgtctttgcattatggttggggccaatgcatccgatagaatgggaatgggcactacctacttggctctgatggccacgttcaagatgaggcctatgtttgcagtgggtttactcttccgccggctgacatctagagaggtccttctgctaaccatagggctcagcctggtggcctcagttgaattgccaaacagtctggaggaattaggagacggcctcgctatgggcatcatgattctgaaacttctgactgattttcaatcccatcagttgtgggcgaccctcctgtctctaacattcatcaagactacctttagcctgcactatgcctggaaaacgatggcaatggtgctttccattgtctcactcttccccctgtgtttgagcacaaccagtcagaagactacatggctgccggtattactcgggtctctgggatgcaagcctcttaccatgtttctgatcgctgagaataaaatatggggtaggcgatcctggccattgaacgaaggcatcatggccgtggggattgttagcatcctcctgtcgtcactactgaagaacgacgtgccccttgccggacctctcattgctggcggtatgctgatcgcatgttacgtcatatctgggagttccgccgatttgagcttagagaaagcggctgaggtgtcttgggaagaggaagccgagcatagcggagcatcccacaatattctggtagaagtgcaggacgatggcactatgaagatcaaagacgaggagcgcgatgacacactcaccatcctgcttaaggccacgctgttggctgtctcaggcgtttatcccctaagtattccagcaactctgttcgtgtggtacttctggcagaaaaagaagcagcggagcggggtgctctgggataccccttctcccccagaagtcgagagagccgtgctggacgatggaatatataggatcatgcagcgtggtcttttaggccgctcccaggttggggtaggagtgtttcaagaaaacgtcttccatacaatgtggcacgtgacccggggcgcggttctgatgtaccagggtaaaagactcgagccgtcatgggctagtgtgaagaaagacttgattagctacgggggaggctggaggctgcagggctcctggaatacaggggaggaagtccaggtgatcgccgtagagcctggaaagaaccccaaaaatgtccaaactgcaccaggtacctttaagacgcccgaaggcgaggtgggggccattgctctcgacttcaagcctggaacatctggctcgccaatcgttaaccgagaaggtaaaatagtggggctgtatggaaatggcgtcgtgactaccagcggcacatacgtttcagccatcgcacaggctaaggcctcccaggaggggccccttcctgagattgaagatgaggtgtttcggaaacgcaacctgaccatcatggacttgcacccgggaagtggtaagactagaaggtatctaccagcgattgtccgggaagccatcaaacgaaagctgagaaccctcatattagcacccacacgcgtggtagcttctgagatggccgaagctctgaagggcatgcctattaggtaccaaacgactgcagtgaaaagcgagcataccgggaaggagatcgttgatcttatgtgccacgccacattcaccatgcgtctgctctccccagtccgggtgcccaattataacatgatcattatggacgaagcccattttactgatccttcatctatcgctgcgagaggatacataagcacaagggtgggcatgggtgaggcagccgctattttcatgaccgccacgccgcccgggagtgtcgaagcatttccacagtccaatgccgtaatccaggacgaggaacgcgatattcctgagcgaagctggaactctggatatgagtggatcactgacttccccggcaaaacagtgtggtttgttccatcaataaagtccggcaatgatattgctaactgtttgaggaaaaatgggaagcgggtgatccagctgagtaggaagaccttcgacaccgaataccagaaaactaagaacaacgattgggactacgtcgtgacaaccgacatcagcgagatgggagcgaatttccgcgccgatcgtgttattgaccctagacggtgcctcaaacccgtgatcctgaaggatggtccagaaagggtcattcttgcaggcccgatgcctgtgacagtagcttcggccgcacagcgccgagggagaataggacggaaccacaataaagagggcgaccagtatatctacatgggtcagcccctaaacaatgatgaggaccatgcccactggactgaagctaagatgctgttggataacattaatacgccagaggggatcatccccgccttatttgaacctgagagggaaaagtctgcggcaattgacggcgagtatcgcctgagaggagaggccaggaaaaccttcgtggaactcatgcggcgtggcgatctgccagtttggctttcctacaaggtcgctagcgaggggtttcaatattcagaccgccgatggtgcttcgatggagaaagaaacaatcaggtgctggaggaaaacatggacgtggagatatggacaaaagagggtgaaaggaagaaactccggccccgctggttggatgccagaacttacagtgaccctctggctctaagggagtttaaggagttcgcagccggccggcgatctgtctccggggacctgatcctcgagattggaaaacttccgcagcacctgacccagagagctcaaaatgccttagataacttggttatgctgcataatagcgaacagggcggtcgcgcatataggcacgcgatggaggagctcccagacacaatcgaaaccctgatgcttctggccctcattgctgtgttgactgggggcgtaacgctgtttttcttatcaggacggggcctagggaagaccagtatcggactgctctgtgtgatggccagctccgtccttctgtggatggcatctgtggagccccattggatagctgccagcatcattttggaatttttcctgatggttctcctgatccctgagcccgatcgtcagagaacaccacaggacaaccaacttgcatacgtggtcattggtctcctgtttatgatcttgactgtagccgctaatgagatgggcctgttagaaaccacaaagaaagatctagggataggacacgtggcggttgagaaccaccatcacgccgcaatgctggacgtggatctccatcctgcttccgcctggaccctttacgccgtcgcaactacaattatcacgcccatgatgaggcacaccattgaaaacactacagctaatatctcactgaccgccatagcgaaccaggctgccatcttgatgggcctggacaagggttggccaatttctaaaatggatatcggggtgcctctcctggcacttggctgctatagtcaggtcaatccgttaaccctgacagccgctgtgctcatgttggttgcacattacgccattatcggacccggcctgcaagcgaaggctactcgcgaggcccagaaacggacggcagccgggataatgaagaacccaaccgtggacggaattgtagctatcgatctagaccctgtggtctatgatgccaagttcgaaaaacagctgggccagatcatgctccttattctgtgtacatcgcaaatcttgctgatgcgaactacctgggcactctgcgagagcataacactggctaccggtcccttaactacgctttgggaggggtccccaggaaagttttggaatacaaccattgccgtttctatggcgaacatcttcagaggctcatacctggccggtgcaggcctcgctttcagcctaatgaaatccctagggggaggcaggcgcgggactggagcccagggcgaaaccttgggtgagaagtggaaacggcagctgaatcagctcagtaagtctgaatttaacacatataagagaagcgggattatggaggtggaccgttcagaagcaaaagagggacttaagaggggcgagactaccaaacacgctgtctcccggggtacagccaagctgcgctggttcgtggaacgaaatttggtaaaacctgagggcaaggtgatcgacctggggtgtggaagaggcgggtggagttactattgcgccggactcaagaaagttacggaagtgaagggctacaccaaaggtgggcccggacacgaggaaccgataccaatggcgacttacggctggaacttagtcaagctgcatagcggcaaagatgtgtttttcatccctcccgagaagtgtgacacacttctgtgcgatattggggagtcttccccaaatcccaccatcgaagagggaaggactctacgggtcctcaaaatggtggaaccttggctgcgcggtaaccaattttgtattaagatcttgaatccgtatatgccctcagttgtagagacactggagcagatgcagagaaagcacggcgggatgctcgtgaggaacccacttagccgaaattcgacccatgaaatgtactgggtctcttgcggaacgggcaacattgtgagtgctgttaatatgacctcccggatgctgttaaaccgtttcacaatggcacacagaaaacctacttatgagcgcgacgtggatctgggtgccgggaccaggcacgtcgctgtggaacccgaggtagccaacttggacatcataggacagcggattgaaaatatcaagcatgagcacaaaagcacatggcattacgatgaggacaacccttataagacttgggcataccacggctcatatgaagtgaaaccatccggctctgccagcagtatggttaatggggtcgtgaagctcctgaccaagccctgggatgtgatccctatggtcacacaaattgctatgaccgacactacgccatttggacagcagagagttttcaaagagaaggtggatacacgcacccccaaagcgaagaggggtactgcccaaataatggaagtaaccgcaaaatggctatggggctttctttcccgaaacaagaagccgcggatctgtacaagagaggagttcacgaggaaagtgcgcagcaatgctgccattggggcagtctttgtggacgagaaccagtggaactctgccaaggaggctgttgaagacgagcgtttctgggatctggtgcatcgggaaagagagctccacaaacagggaaagtgcgcaacctgcgtctacaacatgatgggcaaaagggaaaagaagctgggtgagtttgggaaagcgaagggatcacgcgcaatctggtacatgtggttgggcgcccgattcctggagttcgaagctctcggctttatgaatgaggaccactggttcagtcgggaaaactcccttagcggggtggagggagagggtctgcataaattaggctatattctgagagatatctctaagatacctgggggaaatatgtacgccgacgatactgcaggctgggacacaaggatcaccgaagatgacttgcagaacgaggctcgcattactgatatcatggaaccagagcacgccctcctggctagatcgatttttaaactaacatatcaaaataaggtagttcgggtgcagaggcccgccaaaaacggtaccgtcatggacgtgatctcacgtcgagatcagcgcgggagcggacaggtgggcacatacggccttaatactttcaccaacatggaagcacaactgataagacagatggagtccgaggggatttttagtccttctgaactcgagacgccaaacctggcggaacgggtcttggactggttagagaagtatggagttgaaaggctgaagcgcatggccatcagcggtgatgactgtgtggtaaaacccatcgacgatagattcgctaccgccctcacagcacttaatgacatgggcaaggtgcggaaagatattccgcagtgggagccttccaaggggtggaacgactggcagcaagtccccttttgctcacatcacttccaccagctgataatgaaagatggaagggagatcgtggttccatgtcgaaatcaggacgagctggtgggccgtgctagagtcagtcagggtgccgggtggtctctgcgcgagactgcatgcctcggaaagagctacgcccaaatgtggcagttgatgtattttcatcggagggatctgagacttgcggctaacgccatttgttccgcagtgcctgtagactggatccccacctcacgcacaacttggagcattcacgcccatcaccagtggatgaccacggaagatatgctgtctgtttggaatcgggtgtggatcgaggaaaacccatggatggaggacaagacacatatatccagttggggcgatgtcccctacctcggcaaaagggaggaccaatggtgcgggagcttaatcggactgaccgctcgagccacttgggcaacaaatattcaggtggctatcaaccaggttagacggttgattggtaatgaaaactacctggactatatgacctcgatgaagaggttcaaaaatgagtccgatcctgaaggcgccctctggtga

SEQ ID NO: 13883 - RNA, 9879 nt, synthetic construct
  misc_feature 1..9879: note = derived and/or modified CDS sequence (opt3) from DENV-1__GU131697__SS-prME
  source 1..9879: mol_type = other RNA
agcgtgaccatgctgctcatgcttatgcccactgcactggctttccacttgactacgcggggaggggagcctcatatgatcgtctccaagcaggaaaggggaaagtctttactgtttaagacctcagccggtgttaacatgtgcacattgattgcaatggacctcggcgagctgtgtgaagatactatgacctacaagtgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagggattttgtggagggtcttagtggcgcgacttgggtagacgttgtgttggagcacgggtcctgtgtcacaaccatggcaaaggataagcccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagtaccaagtgggtaatgagagtactgaacatggcacgacagccaccattactccccaggcgcctaccacagagatccagctgaccgactatggggccctcactcttgattgtagcccaaggacaggactggacttcaacgaaatggtcttgctaacgatgaaggagaaatcttggctggtgcacaagcagtggtttctcgatctgccgcttccctggacctccggcgcatcaactagccaagagacatggaataaacaggacctgttggtaaccttcaagacagctcatgccaagaaacaggaagttgtggtcctcggtagtcaagagggggctatgcacactgccctgaccggcgcaacggaaatccagacctctggaacaactaccatttttgccggccacttaaagtgccggctgaaaatggataagctaacactcaaagggatgtcctacgtgatgtgtactggcagcttcaagctggagaaggaagtcgctgagacccagcatggtacggtgcttgttcagataaaatatgagggcacagacgcgccttgcaagatcccattctcgacccaagatgaaaaaggggtgactcagaacggacgtttgattacagcaaatcccatcgtaaccgacaaggagaaacctgtcaacatagaagccgagccaccctttggcgagtcttacattgtgatcggtgctggggaaaaggccctgaagctctcctggttcaaaaagggctcaagtatcggaaaaatgtttgaggcaactgcccgcggcgctagaaggatggccattctgggggataccgcatgggacttcggaagcatcggtggcgtttttacatccgtggggaaacttattcaccagatattcggaacggcgtacggcgtcctgttttctggtgtgagctggaccatgaaaatcgggattggcgtattgctcacttggctgggattaaattcacggagtacatccctgagcatgacctgtatcgctgtgggcctagttacactctatctgggggtcatggtgcaggccgattctggatgcgtgatcaactggaagggccgagaacttaagtgtggttcagggattttcgtcactaatgaggttcatacctggacggaacaatacaaatttcaggcagacagtccgaagcgcttgagcgccgctataggaaaagcctgggaggagggcgtgtgcggtatcagatccgcaacaaggctggaaaacattatgtggaagcagatctctaacgagctcaatcacattctgttagaaaacgacatgaaactgaccgtggtagtcggcgatgtggctgggatccttggacagggcaagaaaatgatacggcctcaacccatggagtataagtactcgtggaaaagctgggggaaggccaagatcattggagcggacgcccagaatactaccttcatcattgatggcccaaacacacctgaatgtcccgacgatcagcgcgcttggaatatctgggaggttgaggactatggttttgggatattcactaccaacatttggttgaaactcagagattcctacacacaggtgtgcgaccataggctgatgtcagcagccatcaaggatagtaaagctgtccacgccgacatgggatattggattgaatctgagaagaatgaaacgtggaagctagcacgtgcgagctttatcgaggtgaaaacctgtatatggccaaagtcccacactctgtggtcaaacggcgttctcgaaagcgagatgatcattcccaaaatctacggtggccctatttctcaacataattaccggccagggtatttcacacagaccgccggaccgtggcacctgggcaaacttgagttggatttcgacctgtgcgaagggactacagtggtagtcgatgagcattgcggaaaccgaggcccctccttaagaaccacgactgtgaccggtaaaatcatacacgaatggtgttgcaggagttgtacactccctccactgcgctttagaggggaagacggatgctggtacggcatggagattagacccgtgaaggaaaaggaggaaaatcttgtcaaaagcatggtttctgctggttccggcgaggtggactcattcagtctggggttgctctgtatcagcatcatgattgaagaggtaatgaggtcgcgctggtcccgaaagatgctgatgaccggaactctagccgtgtttttcctgctcatcatgggccagctgacatggaacgatcttattcggttgtgcataatggtcggggcaaatgcttttgaccgtatgggaatgggcaccacatatctggccttaatggcaactttcaaaatgagacctatgtttgccgtgggtctcctgttcaggcgccttacctctcgggaggttctgctactcacgatcgggctgagcttggtggcttcagtcgaactgccaaacagtttagaggaactcggagatggcctggcgatgggcattatgatccttaagctgttgacagactttcaatcccaccagctctgggccaccctgctatctctgactttcattaaaaccacatttagccttcattacgcatggaagactatggctatggtgctctccatcgtttcactgttccccttgtgtctgagcaccacgagtcagaagacaacctggttaccggtgctcctggggtctcttggatgcaaacctctgactatgtttttgatagccgagaataagatctggggtagaaaatcctggccactcaacgaaggcattatggccgtcgggatcgtaagcattctgctatcgtcactgcttaagaacgatgtgcccctcgctggacctctgatcgcaggcggtatgttgatagcctgttatgttatttctgggagttccgcggacttaagcctggagaaagctgccgaggtgtcttgggaagaggaagcagagcacagcggagcctcccataatatcctcgtcgaagtgcaggatgacggcacaatgaagatcaaagatgaggagagggacgataccctgactattcttctgaaggctacattgctagcagtatcaggcgtgtaccccctgagtataccagccaccctcttcgtctggtatttctggcaaaagaaaaagcagcgaagcggggttctgtgggacacgccttctcccccagaagtggagcgcgcggtgcttgatgacggaatctaccggattatgcagagaggtttactgggcaggtcccaggtcggggtgggagtttttcaagaaaacgtattccacactatgtggcatgtgacccgtggcgctgtcctcatgtaccagggtaaacgcttggagccgtcatgggccagtgtgaagaaagacctgatcagctatgggggaggctggcggctcagaggctcctggaatacaggggaggaagttcaggtgattgcagtcgagcctggaaagaaccccaagaatgtgcagaccgccccaggtacatttaaaactcccgaaggcgaggtaggggctatcgccctggatttcaagcctggaacctctggctcgccaatagtcaacagggaaggtaaaatcgtggggctttacggaaatggcgttgtgacgacaagcggcacttatgtctcagcaattgctcaagccaaggcgtcccaggaggggcccctgcctgagatcgaagacgaggtgtttcgaaaacggaacttgaccattatggatctacacccgggaagtggtaagacacgcagatacctgccagccatcgttagggaagcaataaagcggaaactccgaaccttaattctggctcccactagagtggtcgcctctgagatggctgaagcacttaagggcatgcctatccgctatcagaccacagccgtgaaaagcgagcacacggggaaggagatcgtagacctgatgtgccatgccactttcaccatgaggctcttgtccccagtgcgtgttcccaattacaacatgattatcatggatgaagctcactttacagacccttcatctatagcggcacggggatatattagcaccagagtcggcatgggtgaggccgctgccatcttcatgactgcaacaccgcccgggagtgtggaagcctttccacaatccaatgctgtgattcaggatgaggaaagggacatccctgagcgcagctggaactctggacatgagtggataaccgatttccccggcaaaacggtctggtttgtaccatcaattaagtccggcaatgacatcgcgaactgtctgcgaaagaatgggaaaagagtgatccagctcagtcggaagactttcgatacagaataccagaaaaccaagaacaacgactgggactacgttgtgaccactgatattagcgagatgggagccaatttcagggcagaccgcgtcatcgatcctcgtagatgcctgaaacccgtgattcttaaggacggtccagaacgggttatactagctggcccgatgcctgtgacagtcgcctcggcagcccaaaggcgcgggcgaatcggaagaaaccacaataaggagggcgatcagtatatttacatgggtcagcccctgaacaatgacgaggatcatgctcactggaccgaagccaaaatgttgttagacaacatcaatacaccagaggggatcattcccgcgctgtttgaacctgagcgggaaaagtctgcagccgtggatggcgagtataggctccgcggagaggctagaaaaactttcgtagaactgatgaggcggggcgaccttccagtgtggctgtcctacaaggttgccagcgaggggtttcagtattcagatcgtcgctggtgcttcgacggagaacgaaacaatcaagtcctcgaggaaaacatggatgtggagatatggacgaaagagggtgaaagaaagaaattgaggccccggtggctggacgctcgcacctacagtgaccctctagcactgagagagtttaaggagttcgccgctggcaggcggtctgtgtccggggatctcatccttgagattggaaagctgccgcagcacttaacacagcgagcccagaatgcattggacaacctggtcatgctccataatagcgaacaaggcggtagagcgtatcgccacgccatggaggagctgccagatactatcgaaacccttatgctgctcgctttgattgccgttctgacagggggcgtgaccttatttttcctatcaggaaggggcctggggaaaacaagtatcggactcctttgtgtaatggcaagctccgtgctgttgtggatggcttctgtcgagccccattggatagccgcaagcatcattctggaatttttcctcatggtgctgcttatccctgagcccgaccggcagcgtacgccacaggataaccagctcgcctacgttgtgattggtctgttgtttatgatcctgaccgtcgctgcgaatgagatgggcttactagaaacaactaagaaagacctggggataggacacgtagccgtggagaaccaccatcacgcagctatgctcgatgttgaccttcatcctgcctccgcctggaccctgtacgcagtggctacaaccattatcactcccatgatgagacacacaattgaaaacacgaccgccaatatctcattgactgcgatagctaaccaagccgcaatcctgatgggcctcgataagggttggccaatttctaaaatggacatcggggtccctctgcttgccttaggctgctatagtcaggtgaatccgctgacactcaccgctgcagtcttgatgctggtggcccattacgcgattatcggacccggcctacaggctaaggccaccagggaggcacaaaagcgcacagccgctgggataatgaaaaacccaactgttgatggaattgtggccatcgacctggatcctgtagtgtatgacgcaaagttcgaaaaacagctcggccagatcatgcttctgattttgtgtacgtcgcagatcctgctcatgcggaccacatgggctctgtgcgagagcataactttagccaccggtccccttacaaccctgtgggaggggtccccaggaaagttttggaatactacgattgcggtctctatggccaacatcttccgaggctcatacctcgcaggagctggcctagccttcagcctgatgaaatccctagggggtggcagaagggggacaggagcacaaggcgaaaccctgggtgagaagtggaagcgccagctcaatcagcttagtaaatctgaatttaacacttataagcggagcgggattatggaggttgacagatcagaagctaaagagggactgaagcgtggcgagaccacaaaacacgccgtgtccaggggtactgccaagttgcggtggttcgtcgaacgcaatctggtgaagcctgagggcaaagtaatcgatctcgggtgtggacgaggcgggtggagttactattgcgcgggattaaagaaagtgaccgaagttaagggctacacaaaaggtgggcccggacacgaggaaccgataccaatggctacgtacggctggaacctggtgaaacttcatagcggcaaagacgtctttttcatccctcccgagaagtgtgataccctgctatgcgacattggggagtcttccccaaatcccactatcgaagagggaagaacactcagggtgctgaagatggtcgaaccttggttgcggggtaaccagttttgtattaaaatcctgaatccgtatatgccctcagtggttgagaccctcgagcaaatgcagcgcaagcacggcgggatgcttgtaagaaacccactgagcagaaattcgactcatgaaatgtactgggtgtcttgcggaacaggcaacattgtcagtgcagtgaatatgacctcccgaatgttactgaaccggttcacgatggcccaccgtaaacctacctatgagagagatgttgacttgggtacagggactcgccacgtggctgtcgaacccgaggtggccaacctcgatatcataggacagaggattgaaaatatcaagcatgagcacaaaagcacctggcattacgacgaggataacccttataagacatgggcataccacggctcatatgaagtaaagccatccggctctgccagcagtatggtgaatggggttgtcaaactgctaactaagccctgggacgtgatccctatggtgacccagattgctatgacagataccactccatttggacaacagcgggtcttcaaagagaaggttgacacgagaacacccaaagcgaagcgcggtaccgcccagataatggaagtgactgcaaggtggctttggggctttctgtcccgaaacaagaaaccgcggatctgtaccagagaggagttcacaaggaaggtacgcagcaatgctgccattggggcagtgtttgtcgacgagaaccaatggaactctgccaaagaggctgtggaagatgagcgtttctgggacctcgttcatcgggaaagagagctgcacaagcagggaaaatgcgccacgtgcgtgtacaacatgatgggcaagagggaaaagaaattgggtgagtttgggaaggcgaaaggatcacgcgcaatctggtacatgtggctgggcgcccgattcctcgagttcgaagctcttggctttatgaatgaggatcactggttcagtcgggaaaactccctgagcggggtcgagggagagggtttacataagctgggctatattttgagagacatctctaaaatacctgggggaaatatgtacgccgatgacaccgcaggctgggatactaggatcacagaagacgatctccagaacgaggctaagattaccgacatcatggaaccagagcacgccctgctagctaaagccatttttaaacttacttatcagaataaggtggtacgcgttcaaagacccgccaagaatggtacagtgatggatgtcatctcgcggagggaccagcgtgggtcaggacaggtgggcacctacggcctgaatacattcactaacatggaagcgcagctcatacgacaaatggagagcgaggggatattttcccctagtgaactggagaccccaaacttggccgaacgcgctttagattggctggagaagtatggagtggaaagactcaaacggatggccatctctggtgacgactgtgtcgttaagcccatcgatgacaggttcgcaacggctcttaccgccctgaatgatatgggcaaagtgcgcaaggacattccgcagtgggagcctagcaaggggtggaacgattggcagcaggtacccttttgctcccatcacttccaccaactaataatgaaagacggaagagagatcgtggtcccatgtcggaatcaggatgaactggtgggcagggcacgagtttcacagggtgccgggtggagtctccgtgagacagcgtgcttgggaaagtcttacgctcagatgtggcaactgatgtattttcatagacgcgaccttcggctggccgcaaacgccatttgtagcgctgtgcctgtcgattgggtgcccacttccaggaccacatggtcaatccacgcccatcaccagtggatgactaccgaagacatgctcagcgtatggaatagagtttggattgaggaaaacccatggatggaggataaaacgcatatctcttcctgggaggacgtgccctacttaggcaagcgcgaagaccagtggtgcggcagtctgatagggttgacagcacgggctacctgggccactaatatccaagtcgcgattaaccaggtgaggcgactgatcggaaatgagaactacctcgattatatgacaagcatgaaaagattcaagaatgaatcggaccctgagggtgctctttggtga

SEQ ID NO: 13884 - RNA, 9879 nt, synthetic construct
  misc_feature 1..9879: note = derived and/or modified CDS sequence (opt3) from DENV-1__GU131700__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcaccccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcactagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccacaagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcacacacacaggtgtgcgaccaccgtttgatgagtgcagccataaaggattctaaagctgttcatgccgacatggggtattggattgaaagcgagaagaatgaaacgtggaagctcgcacgggcgtccttcatcgaggtgaaaacctgtatttggccaaagtcacacactctgtggagcaacggagtactagaatctgagatgatcatacccaaaatctacggcggtcctatttcccagcataattatcgaccaggctactttacacaaaccgccgggccgtggcacctgggaaagctcgagctggatttcgacctttgcgaaggcactacagtcgtggtggatgagcactgcgggaacagaggacccagtttgaggaccacgactgtcaccggcaaaatcattcatgaatggtgttgccgcagctgtacactgcctccattacggtttaagggtgaggacgggtgctggtacggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacatatcttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccaccaactgtgggccaccttgctctccctgacttttattaagaccacattctcactacattacgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctaaaaaacgatgtgcccctggctgggcctcttatcgcaggaggcatgctcattgcctgttatgtcatctccggtagctctgcggacctgagcttggagaaggctgccgaggtgtcctgggaagaggaagcagagcactcaggggccagtcataatatattagtagaagtgcaggatgacggaacaatgaaaattaaggatgaggagagggacgataccctgactatcctcctgaaggctacacttctgaccgtcagcggcgtttaccccttgtctatcccagcaacgctattcgtgtggtatttttggcagaaaaagaaacaacgatccggcgtgctgtgggacactccttcacccccaaaggtcgaacgcgccgtgctcgatgacgggatttaccggataatgcagagaggactgcttggtaggagtcaggttggcgtaggggtgttccaggagaacgtctttcacaccatgtggcacgtgacacgtggagcggttttaatgtatcaaggcaaacgcctggaaccgagctgggcttccgtgaagaaggacctcatctcttacggtgggggatggcggttgcagggctcgtggaataccggcgaggaggtccaggtgattgccgtagaacctgggaaaaaccccaagaatgtccagacagcaccaggaactttcaaaaccagcgagggtgaagtgggcgccatcgctctggattttaagcccgggacgtcaggatcccctattgttaacagagagggcaaaatcgtgggtctctacgggaatggagtcgtgacaactagtggcacctatgtttctgccatagcacaagctaaggccagccaggaaggcccactgcccgagatcgaggacgaagtgttcaggaagcgaaaccttacaattatggatctgcatcctgggtccggaaaaacccggcgctacttgccggcgatcgtcagagaggccattaagaggaaactacggactctgatcctcgcaccaacccgagtggtagcttcagaaatggccgaggctttaaagggtatgcccataagatatcagacaacggcagtgaaatctgaacacactggcaaggagattgttgacctgatgtgccatgccacctttacaatgcgccttctgagccctgtcagggtgccaaattacaacatgatcatcatggatgaggcccacttcaccgaccccagttccattgctgcgcgtgggtatatcagcactcgggtgggaatgggcgaagcagccgctatatttatgacagccacccctccgggttctgtcgaggcattcccccaatcaaatgccgtaattcaggatgaagagagagacatcccagaaaggtcctggaacagtgggtacgagtggattacggattttcctggaaagactgtgtggttcgttcccagcatcaaatcgggcaatgacatagctaactgtctccgcaagaatggcaaacgagtgattcagttgtctagaaagacattcgataccgagtatcagaaaaccaagaacaacgactgggactacgtcgtgactacagatatctccgaaatgggggcgaattttcgggccgacagggttatcgatccacgccgttgcctgaagcctgtgattctcaaagacggacccgagagagtcatcctggcaggtccaatgccggtgaccgtagctagcgccgcacaacggaggggccgcattgggcgaaaccataataaggaaggagatcagtacatatatatgggccagcctcttaacaatgacgaggatcacgcccactggacagaggctaaaatgctactggacaacatcaatactcccgaaggtattatcccagccttgttcgagcccgaaagagagaagtcagcggcaatcgatggggaataccggttaaggggcgaggcccgcaaaacgtttgtggagctgatgagaaggggagacctccctgtttggctgagttataaggtcgcttctgaaggcttccagtactccgatcggcgttggtgctttgacggggagcgcaacaatcaagtgcttgaagagaacatggatgtggaaatttggaccaaagagggagagcgaaagaagctgagaccaaggtggctcgacgcccggacatatagcgaccccttggctctgcgcgaattcaaagagtttgcagccggtagaaggtcagtcagtggcgatctaatactggaaatcgggaagctccctcagcatcttactcagcgggctcagaatgccctggacaacttagttatgttgcacaatagcgagcaaggaggccgagcatacagacatgcgatggaagagctgccggataccattgagacaatgatgctcctggcccttatcgctgtgctgaccggtggggtaactctcttctttttgtccggccgcggactgggcaaaacgtctattgggttactatgtgtgatggccagctccgtcctgctctggatggcatcagtggaaccacactggatcgctgcctctataatccttgagttctttctgatggttttgctgattcccgaacctgacaggcagcggaccccccaggataaccagctcgcatatgtggtcatcggactgcttttcatgattctcacagtagccgctaatgagatgggtctgttggagactaccaagaaagacctgggcatcgggcacgtggcggttgaaaaccatcaccatgccgcaatgttagatgtggacctacacccagctagtgcctggacactgtacgccgtcgcaaccactataattacacctatgatgcgtcatacgatcgagaacaccactgctaatatttcgctcacagccatcgcgaaccaagctgccatacttatgggactggataagggctggcccatcagcaagatggacattggtgtgccattgctggcactcgggtgctactcccaggtcaatcctctgacccttaccgccgctgtgttaatgctggttgcacactatgccatcattggcccgggactccaggcgaaagctacaagagaagcccaaaagaggactgcagccggcatcatgaaaaaccccacggtggatgggatagtagctattgacttggatccagtggtctacgacgccaagtttgagaaacagctgggacagatcatgctactgatcctctgtacctctcagattcttctgatgcgcacaacttgggcattgtgcgaatcaatcaccctggctacaggccctctcaccactctgtgggagggtagccccgggaagttctggaatacgacaatagccgtttccatggcgaacattttccggggaagttatttagccggcgcaggtcttgctttttctctgatgaagagcctcggcgggggacgaagaggcaccggggcccaaggagagactctaggcgaaaaatggaagaggcagctgaatcagttgtcaaaatccgagttcaacacctacaagcgcagtggtatcatggaagtggaccggagcgaggcaaaagaagggctgaagagaggagagacaactaagcacgctgtctctcgtggcaccgccaaactcaggtggtttgtggagcggaatcttgtaaagccagaaggtaaagtgattgatctgggctgtgggcgcggaggctggtcctattactgcgccgggttgaagaaagttacagaggtgaagggatatacgaaaggcggtcctgggcatgaagagcccatcccgatggcgacctacggatggaacctggtcaagctccactcaggcaaggacgtgttctttataccacctgaaaaatgtgatactttactgtgcgacatcggcgagagctcgcccaatccaacaattgaggaagggcgaacccttagagtcctgaagatggtggagccctggctaaggggaaaccagttctgtatcaaaattctcaatccttacatgccgtctgttgtagaaactctggagcaaatgcagcggaagcatggtggcatgttggtgcgcaaccccctgagtagaaattccacacacgagatgtattgggtcagctgcgggaccggaaacatcgtgtcagctgttaatatgacgtccaggatgctccttaaccgatttaccatggcacaccggaaaccaacatacgaacgtgatgtggacctgggcgccggtactagacatgtcgctgtggagcctgaagtagccaacttagatattatcgggcagcgcatagagaatattaagcacgaacataagtctacctggcactatgacgaggataacccctacaaaacatgggcatatcatggaagctacgaggtgaagcctagtggctccgccagctctatggttaatggcgtcgtgaaactgttgactaagccatgggacgtgatccccatggtcacccagatcgctatgacagataccactcctttcgggcaacagagggtttttaaagaaaaggtggacacgcggacaccaaaggcgaaaagaggaaccgcccagattatggaggtaactgcaaagtggctctggggtttcctgtcacgcaacaaaaagcccaggatatgtacccgagaagagtttacacggaaagtgagaagtaatgctgccatcggcgcagtcttcgtggacgaaaaccaatggaattccgccaaggaggctgttgaggatgaaaggttttgggacctagtgcaccgcgagcgtgaacttcacaagcaggggaaatgcgccacgtgcgtctataacatgatgggaaagcgggagaaaaagctgggcgaattcggtaaagcgaaggggagcagagcaatttggtacatgtggctcggagccaggttcctggagtttgaggctttgggcttcatgaatgaagatcattggttttctcgcgagaactcgctgtcaggcgtggaaggggagggactccacaaacttggttacatcctgcgagacattagcaagatcccgggcgggaatatgtatgccgatgacaccgcaggatgggatactcggataacagaggacgatttacagaacgaagctaagatcaccgacattatggagcctgaacatgccctgttggctaaatccatcttcaagctcacttaccagaataaagtagttagagtgcaaaggccagccaagaacggcacagtcatggatgtgattagtcgcagagaccagcggggttctgggcaggtgggaacctatggcctgaatacatttactaacatggaggcacagctaatcaggcaaatggaaagcgagggcatattctccccctcagagcttgaaacccctaacctggcgcgtcgagtcctcgattggctggagaaacacggggttgaacgcttgaagagaatggccattagtggagacgactgtgtggtaaagccaatcgatgaccggtttgctacggccttaaccgcactgaatgatatgggtaaagtgaggaaggacatcccccagtgggagccgtctaaaggctggaacgattggcagcaggtccctttctgcagccaccattttcaccaactcattatgaaggacgggcgcgaaatagtggttccctgtagaaatcaggatgagcttgtgggacgggctagggtctcccagggcgccggttggtcactgcgagagacagcatgcctagggaaaagctacgcccagatgtggcaactgatgtatttccatcgtagagacctccgcttggcggctaacgccatctgttctgcagtgccagtagattgggttcctacttcccggaccacatggagtattcacgcccatcaccagtggatgactaccgaagacatgctgagcgtgtggaatagggtctggatcgaggaaaacccctggatggaggataagacgcacatttcgtcctggggagacgtgccataccttggcaagagagaagaccagtggtgcggctctctgatcgggctcacagctcgcgccacctgggcaactaatatacaagttgctatcaaccaggtgcggaggttaattggaaatgagaactatctggattacatgacatcaatgaaacgatttaagaatgagagcgaccccgaaggtgccttgtggtga

SEQ ID NO: 13885 - RNA, 9879 nt, synthetic construct
  misc_feature 1..9879: note = derived and/or modified CDS sequence (opt3) from DENV-1__GU131701__SS-prME
  source 1..9879: mol_type = other RNA
agcgtgaccatgctgctcatgcttatgcccacagccctggctttccacttgactacgagaggaggggaacctcatatgatcgtctccaagcaagaaagaggaaaatctttactgtttaagacctcagccggtgttaatatgtgcacactaattgccatggacctcggagaactgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccacatgtcggcctgggtttggagaccagaacagaaacttggatgtcctctgagggggcatggaaacagatccagagggtggaaacctgggccctccggcaccctggattcacagttaccgctctgtttctggcacatgtgattggcacgtcgatcactcagaagggcattatcttcatactcttaatgctggtcacaccatcaatggccatgcgctgcgtggggatcggaagcagagattttgtagagggtcttagtggcgctacctgggttgacgtggtcttggagcacgggtcctgtgtgactacaatggccaaggataaacccaccctggacattgaactactcaagacggaggtgaccaaccctgcggtcctgaggaaactttgcatcgaagcaaagatttctaatacaactaccgatagccggtgtccaacacaaggagaggccactctggttgaagaacaggacgctaacttcgtgtgccgccgaacctttgtagatagaggctggggtaatgggtgtggattgttcggcaaaggctccctcatcacatgcgccaagtttaagtgcgtgaccaaactggaggggaagatagtccagtacgaaaacttaaaatattcagtgattgttactgtgcacacgggagaccagcatcaagtcggtaatgagagtacagaacacggcaccactgcaaccatcacaccccaggctcctaccactgagattcagctgacagactacggggccctcacgcttgattgtagcccaaggaccggactggacttcaacgaaatggtgttgctaactatgaaggagaaatcttggctggtacataagcagtggtttctcgatctgccgcttccctggacatccggcgcgtcaaccagccaagagacatggaatcggcaggacctgttggttactttcaaaaccgcccacgcaaagaagcaggaagtggtcgtgctcggtagtcaagagggggctatgcacacggccctgaccggcgctacagaaatccagacttctggaaccacaactatctttgccggccatttaaaatgccgtctgaagatggataaactaaccctcaaggggatgtcctatgtcatgtgtacgggcagcttcaaactggagaaggaagtggcagagacacagcacggtaccgttcttgtgcagattaagtacgagggcactgacgccccttgcaaaataccattctcgacacaagatgaaaagggggtaacccagaacggacgcttgatcactgctaatcccaccgtcacagacaaagagaagcctgtgaacattgaagcggagccaccctttggcgagtcttatatcataattggtgcaggggaaaaagccctgaagctctcctggttcaagaaaggctcaagtatcggaaagatgtttgaggctacggccagaggcgcaaggcggatggccatcctgggggataccgcttgggacttcggaagcattggtggcgtttttacttccgtggggaaacttgtccatcagatcttcggaacagcctacggcgtgctgttttctggtgtaagctggaccatgaagattgggataggcgtgttgctcacatggctgggattaaattcacgaagtacttccctgagcatgacctgtatcgcagttggcctagtcacgctctacctgggggtgatggtgcaggcggattctggatgcgtcattaactggaaaggccgcgaacttaagtgtggttcagggatcttcgttacaaatgaggtgcacacctggactgaacaatataagtttcaggctgacagtccgaaaagattgagcgccgcaatcggaaaggcctgggaggagggcgtgtgcggtattaggtccgctacccggctggaaaacataatgtggaaacagatctctaacgagctcaatcatattctgttagaaaacgacatgaagttcacagtagtcgtgggcgatgttgccgggatcctggcacagggcaaaaagatgattcgccctcaacccatggagtacaaatattcgtggaaaagctggggcaaggctaaaatcataggggccgacgtgcagaatactacctttatcattgatggaccaaacacacctgaatgtcccgacgatcagagagcgtggaatatctgggaggtcgaggactacggcttcggtatttttacgaccaacatctggcttaagttgagggattcctatactcaggtgtgcgaccaccgtctcatgtcagccgctataaaagatagtaaggcagttcacgccgacatggggtactggattgaatctgagaaaaatgaaacatggaagctggctcgggccagcttcatcgaggtgaagacctgtatttggccaaaatcccatactctatggtcaaacggagtactggaaagcgagatgatcatacccaagatctatggcggtcctatttctcaacacaatcatcgaccaggctacttcacacagaccgcagggccgtggcacctcggaaaactggagcttgattttgacttgtgcgaaggcacgactgtcgtggtggatgagcactgcgggaacagaggaccctccctgaggaccacaaccgtcactggcaagatcattcatgaatggtgttgccgcagttgtacattacctccactccggttcagaggtgaggacgggtgctggtacggaatggagatcaggcccgttaaagaaaaggaggaaaatctggtaaagagcatggtatctgcgggctccggtgaggtggactcatttagtcttggcctgttgtgtataagcattatgatcgaagaggtcatgcgctcgcgatggtcccggaaaatgctcatgaccgggacactggccgtgttctttctactgatcatgggacagctcacttggaacgatctgattcgtctttgcatcatggttggcgctaatgcctctgacagaatggggatgggaaccacgtatttggcactgatggctacattcaagatgaggcctatgtttgccgtgggcttactcttccgccggctgaccagcagagaggtccttctgctaactattggtctctcactggtggcaagtgttgaattgccaaactccctggaggaattaggggatggactcgccatgggcataatgatcctgaaacttctgaccgactttcaaccccaccagttgtgggctacactcctgtctctaactttcattaagaccacgtttagcctgcattacgcgtggaaaacaatggccatggtgctttccatcgtctcactcttcccgctgtgtttgagcaccacaagtcagaagacaacctggctgcctgtattactcggctctctggggtgcaagccacttactatgtttctgattgcagagaataaaatctggggaaggcgatcctggcccttgaacgaaggtataatggctgtgggcatcgttagcattctcctgtcgtcactactgaagaacgatgtgcctcttgccgggcccctcatcgccggaggcatgctgattgcttgttatgtcatctctggtagttccgcagacttgagcttagagaaagccgcggaggtgtcttgggaagaggaagctgagcacagcggggcctcccataatatactggtagaagtgcaggatgacggaacaatgaagattaaagatgaggagcgcgacgataccctcacgatcctgcttaaggcaactctgttggccgtctcaggcgtttacccactaagtatccctgctaccctgttcgtgtggtatttctggcagaaaaagaagcagcggagcggcgtgctctgggacacaccctctccaccggaagtcgagagagcagtgctggatgacgggatttacaggataatgcagcgtggacttttaggtcgctcccaggttggcgtaggggtgtttcaagaaaacgtcttccacaccatgtggcacgtgacacggggagccgttctgatgtatcagggcaaaagactcgagccttcatgggcgagtgtgaagaaagacttgatcagctacggtgggggatggaggctgcagggctcctggaatactggcgaggaagtccaggtgattgctgtagagcccgggaagaaccccaaaaatgtccaaaccgcccccggaacgtttaagacacctgaaggtgaggtgggcgcaatcgccctcgatttcaagccagggacttctggatcgcccattgttaaccgagaaggcaaaatcgtgggtctgtacgggaatggagtcgtgaccacaagcggcacctatgtttcagctatagcccaggcaaaggcttcccaggagggccctcttccggagatcgaagacgaggtgtttcggaaacgcaacctgactattatggatttgcatccagggagtggaaagaccagaaggtacctacccgccatcgtccgggaagcgattaaacgaaagctgagaacactcatcttagcccctacgcgcgtggtagcatctgagatggctgaagccctgaagggtatgccaataaggtatcaaactaccgctgtgaaaagcgagcacacaggcaaggagattgttgaccttatgtgccatgcaaccttcactatgcgtctgctctcccccgtccgggtgcctaattacaacatgatcatcatggatgaagcccactttacagacccgtcatctattgccgctagagggtatatcagcaccagggtgggaatgggcgaggcggcagccatattcatgacggctactcccccaggtagtgtcgaagcctttcctcagtccaatgcagtaattcaggatgaggaacgcgacatccccgagcgaagctggaactctgggtacgagtggattacagatttcccaggaaaaaccgtgtggtttgttccttcaatcaagtccggcaatgacatagccaactgtttgaggaaaaatggcaagcgggtgattcagctgagtaggaagaccttcgatactgaatatcaaaagactaagaacaacgactgggactacgtcgtgaccacagatatcagcgagatgggggctaatttccgcgcggaccgtgttatcgatcccagacggtgcctcaaaccagtgattctgaaggacggaccggaaagggtcatccttgccggtcctatgcccgtgactgtagcatcggctgcccagcgccgaggcagaattgggcggaaccataataaagagggagatcagtacatatatatgggccagccactaaacaatgacgaggatcacgcacactggacggaagccaagatgctgttggacaacatcaatacccccgagggtattatccctgctttatttgaaccagagagggaaaagtctgccgcgatcgatggggagtaccgcctgagaggcgaggcaaggaaaacattcgtggaactcatgcggcgtggagacctgcccgtttggctttcctataaggtcgccagcgagggctttcaatactcagatcgccgatggtgcttcgacggggaaagaaacaatcaggtgctggaggaaaacatggatgtggagatttggactaaagagggagaaaggaagaaactccggcctcgctggttggacgctagaacctatagtgacccgctggccctaagggagtttaaggagttcgctgcaggtcggcgatctgtctccggcgatctgatactcgagatcgggaaacttccacagcatctgacacagagagcccaaaatgctttagacaacttggttatgctgcacaatagcgaacagggaggccgcgcctacaggcatgcaatggaggagctccccgataccattgaaactctgatgcttctggcgctcatcgccgtgttgacgggtggggtaaccctgtttttcttatcaggccggggactaggcaagacaagtattgggctgctctgtgtgatggctagctccgtccttctgtggatggcctctgtggagcctcactggatcgcagctagcataatcttggaatttttcctgatggttctcctgattcccgagccagaccgtcagagaactcctcaggataaccaacttgcctatgtggtcatcggactcctgtttatgattttgaccgtagcagccaatgagatgggtctgttagaaacaaccaagaaagacctaggcatcgggcacgtggctgttgagaaccatcaccatgcggccatgctggatgtggacctccaccccgcatccgcttggactctttacgccgtcgccacaacgataattaccccaatgatgaggcatactatcgaaaacacaaccgcaaatatttcactgaccgctatcgccaaccaggcggctatattgatgggactggataagggctggcctatctctaaaatggacattggtgtgccgctcctggcccttgggtgctacagtcaggtcaatcccttaacactgactgcagccgtgctcatgttggttgctcactatgcaatcattggcccaggactgcaagccaaggcgacgcgcgaggctcagaaacggaccgccgcaggcatcatgaagaaccctacagtggatgggatagtagccattgacctagatcccgtggtctacgacgctaagttcgaaaaacagctgggacagatcatgctccttatcctgtgtacttcgcaaattttgctgatgcgaaccacatgggccctctgcgagagcatcaccctggcaactggcccattaacgacactttgggagggttcccctgggaagttttggaataccactatagctgtttctatggccaacattttcagaggatcatatctggcgggcgccggtctcgcattcagcctaatgaaatccctgggcgggggaaggcgcggcaccggggctcagggagaaacattgggcgagaagtggaaacggcagctgaatcagctcagtaagtctgaatttaacacttacaagagaagcggtatcatggaggtggaccgttcagaagccaaagaggggcttaagaggggagagaccacaaaacacgcagtctcccggggcacggctaagctgcgctggttcgtggaacgaaatttggtaaaacccgagggtaaggtgattgatctgggctgtgggagaggaggctggagttattactgcgccgggctcaagaaagttaccgaagtgaagggatatactaaaggcggtccggggcatgaggaaccaatccctatggccacatacggatggaacttagtcaagctgcacagcggcaaagacgcgtttttcatacccccagagaagtgtgatacccttctgtgcgacatcggcgagtcttcccccaatcctactattgaagaggggaggacactacgggtgctcaaaatggtcgaaccgtggctgcgcggaaaccaattttgtatcaagattttgaatccctacatgccatcagtggttgagaccctggagcagatgcagagaaagcatggtggcatgctcgtaaggaaccctcttagccgaaattcgacgcacgaaatgtattgggtgtcttgcgggaccggaaacatcgtcagtgctattaatatgacatcccggatgctgttaaaccgtttcactatggcacacagaaaacccacctacgagcgcgatgtggacctgggcgccggtacaaggcatgttgctgtggaacctgaggtcgccaacttggatatcatagggcagcggattgaaaatatcaagcacgagcataaaagcacttggcactatgacgaggataacccatacaagacctgggcatatcatggatcatacgaagtgaaaccctccggctctgccagcagtatggtaaatggcgtggttaagctcctgacaaagccttgggacgtcatcccaatggtgacccaaattgctatgactgatacgacaccctttgggcagcagagagtgttcaaagagaaggtcgacacccgcactccgaaagcgaagaggggaaccgcccaaataatggaagttacagcaaaatggctatggggttttctttcccgaaacaagaagcctcggatctgtacgagagaggagttcaccaggaaagtgcgcagcaatgctgccattggcgcagtatttgtggacgagaaccagtggaactctgccaaggaggctgtcgaagatgagcgtttctgggacctggtgcaccgggaaagagagctccacaaacaggggaagtgcgccacttgcgtttataacatgatgggaaaaagggaaaagaagctgggcgagtttggtaaagcgaaggggtcacgcgcaatctggtacatgtggttgggagcccgattcctggagttcgaagctctcggctttatgaatgaggatcattggttcagtcgggaaaactcccttagcggcgtggagggggagggactgcacagattaggttacattctgagggacatctctaaaataccaggcgggaatatgtatgccgatgacacagcaggatgggatacccgcatcactgaagacgatttgcagaacgaggctagaattacagacatcatggaacccgagcatgccctcctggctaagtcgatttttaaactaacctaccaaaataaggtcgtgcgggtacagaggcctggcaaaaacggtacagttatggatgtgatctcacgtcgagaccagcgcgggagcggacaggtcggcacttatggccttaataccttcacgaacatggaagcccaactgataagacagatggagtccgaggggatttttagtccatctgaactcgagacccccaacctggcagaacgggtgttggattggttagagaagtacggagtggaaaggctgaagcgcatggcgatcagcggtgacgactgtgtcgttaaaccgatcgatgacagattcgccacagctctcactgcccttaatgatatgggcaaggtgcggaaagacattcctcagtgggagccctccaaggggtggaacgattggcagcaagtaccattttgctcacaccacttccatcagctgataatgaaagacggaagggagatcgtggtcccttgtcgaaatcaggatgagctagtgggccgtgcaagagttagtcagggtgctgggtggtctctgcgcgagaccgcctgcctcggaaagagctatgcacaaatgtggcagttgatgtactttcaccggagggacctgagacttgccgcgaacgctatttgttccgccgtgcccgtcgattggatcccaacatcacgcactacctggagcattcatgcacaccatcagtggatgacgacagaagacatgctgtctgtgtggaatcgggtatggatcgaggaaaacccctggatggaggataagacccacatatccagttggggcgacgttccttatctcggcaaaagggaggaccaatggtgcgggagcttaatcggactgactgcccgagctacatgggccaccaatattcaggtggcaatcaaccaggtcagacggttgattggtaatgaaaactacctggattacatgacttcgatgaagaggttcaaaaatgagtccgacccagaaggcgctctctggtga

SEQ ID NO: 13886 - RNA, 9879 nt, synthetic construct
  misc_feature 1..9879: note = derived and/or modified CDS sequence (opt3) from DENV-1__GU131703__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaagacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaagcccctaccaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggatcgttcaaactggagaaggaagtggccgagacgcagcacggtacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgccagtgtggaactgccaaactccttagaggaactcggggatggactggctatgggcattatgatccttaaactgttgaccgacttccaatctcatcagctctgggcgactctgctaagcctgacctttattaagacaactttctcccttcactatgcctggaaaaccatggcaatggttctctcaatcgtgagcctgtttcccttgtgtctgagtacgacatctcagaagaccacttggttaccggtcctcctgggctcccttgggtgcaagcctctgacaatgttcttgatagctgagaataaaatctggggaaggcgaagctggccactcaacgaaggtattatggccgtaggcatcgtgtcgattctgctatcatctctgcttaagaacgatgttcccctcgccgggcctctgatcgctggaggcatgttgatagcatgttacgtgattagtggttccagcgccgacttatctctggagaaagcggctgaggtcagctgggaagaggaagccgagcattccggggcatcacacaatatcctcgtggaagtacaggatgacggaaccatgaagatcaaagatgaggagcgcgacgatactctgacaattcttctgaaggccaccttgctagctgtgagtggcgtctatcccctgagcataccagcaacgctctttgtttggtacttctggcagaagaagaagcagcggtctggcgtgctgtgggacactccttcacccccagaagtggagagagccgtccttgatgacgggatctataggattatgcagcgtggattactgggtcgcagccaggtgggcgttggggtattccaagaaaacgtgtttcataccatgtggcacgtcacacggggagcggtgctcatgtaccagggcaaaagattggagccgagttgggctagcgttaagaaagacctgatctcctacggtgggggatggaggctccagggctcttggaataccggcgaggaagtgcaggtcattgccgtggagcctgggaagaaccccaaaaatgtacaaacaactccaggaaccttcaagacgcccgaaggtgaggtcggcgcaatcgccctggattttaagcctgggacatcgggaagcccaatagtgaaccgagaaggcaaaatcgttggtctttatgggaatggagtggtcactacctcaggcacatacgtgtccgctattgcccaggcaaaggctagtcaggagggccccctgcctgagatcgaagacgaggttttccggaaacgcaacttgaccattatggatctacacccggggtctggaaagactagaaggtatctgccagccatcgtgcgggaagcgataaaacgaaagctcagaaccttaattctggcccccacacgcgtcgtggcaagcgagatggctgaagcccttaagggtatgcctatcaggtaccaaacgactgctgtaaaatccgagcataccggcaaggagatcgtggacctgatgtgccacgcaacatttaccatgcgtctcttgtcaccagttcgggtccccaattataacatgattatcatggatgaagcccatttcactgacccttctagcatagccgctagagggtacattagtacaagggtgggaatgggcgaggcggcagccatctttatgaccgctacgccgcccggttccgtggaagccttcccacagagcaatgcagtcattcaggatgaggaacgcgacatccctgagcgatcttggaactcagggtatgagtggataactgattttcccggaaaaacagtatggttcgtgccatccattaagagtggcaatgacatcgccaactgtctgaggaaaaatggcaagcgggttatccagctcagcaggaagacctttgataccgaataccagaaaactaagaacaacgactgggactacgtggtcacaaccgatatttcggagatgggggctaatttccgcgcggaccgtgtgatcgatcctagacggtgcctgaaacccgttattcttaaggacggaccagaaagggtgatactagccggtccgatgcctgtcacagtggcatctgctgcccagcgccgaggcagaatcgggcggaaccacaataaagagggagatcagtatatttacatgggccagcccctgaacaatgacgaggatcatgcacactggactgaagccaagatgttgttagacaacatcaatacgccagagggtatcattcccgctctgttcgaacctgagagggaaaagtccgccgcgatagatggggagtatcgcctcagaggcgaggcaaggaaaacctttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacaaaagagggagaaaggaagaaattgcggccccgctggctggacgctagaacttactctgaccctctagccctgagggagttcaaggaatttgctgcaggtcggcgatccgtgagcggcgatctcattcttgagatcgggaaactgccgcagcacttaacccagagagcccaaaatgctttggacaacctggtcatgctccataattcagaacagggaggccgcgcctataggcacgcaatggaggagctgccagatacaattgaaacccttatgctgctcgcgttgatcgccgttctgactggtggggtgacgttattctttctaagtggccggggactgggcaagaccagcatagggctcctttgtgtaatggcttcctctgtgctgttgtggatggccagcgtcgagccccattggatcgcagcttccattatcctggagttctttctcatggtgctgcttattcctgagcccgaccgtcagagaacaccacaggataaccaactcgcctacgttgtgatcggactgttgttcatgatactgactgtcgcagccaatgagatgggtttactagaaaccacaaagaaagacctgggcattgggcacgtagctgtgggaaaccaccatcacgcggccatgctcgatgttgaccttcatcctgcatcagcttggaccctgtacgccgtggccactacaatcattacgcccatgatgaggcacaccatcgagaacactacagcaaatatatctttgaccgctatcgccaaccaggcggctattctgatgggcctcgataagggttggccaatcagtaaaatggacattggggtccctctgcttgccttaggctgctatagccaggtgaatccgctgaccctcacagcagccgtcttgatgctggtggctcattacgcaatcataggacccggcctacaagccaaggcgactcgcgaagctcagaaacggacggccgcagggattatgaagaacccaaccgttgatggaatcgtggccatcgacctggatcctgtagtgtatgacgctaagtttgagaaacagctcggccagattatgcttctgatcttgtgtacaagccaaatactgctcatgcgaactacctgggccctgtgcgaatccattacattagcaaccggtccccttactacgctgtgggaggggtctccaggaaagttctggaatacaaccatcgctgtctcaatggccaacatttttagaggcagctacctcgcgggtgccggcctagcattctccctgatgaaaagtctagggggaggcaggcgcgggactggagctcagggcgagaccctgggtgaaaagtggaaacggcagctcaatcagctttctaagagcgagttcaacacatataagagatcagggatcatggaagttgaccgttccgaggccaaagaaggactgaagaggggcgagactaccaaacacgcagtgagtcggggtacagctaagttgcgctggtttgtcgagcgaaatctggtgaaacctgaaggcaaggtaatagatctcgggtgtggaagaggcgggtggagctactattgcgccggattaaagaaagtgacggaggttaagggctacaccaaaggtgggcccggacacgaagaaccgatcccaatggccacttacggctggaacctggtgaaacttcattctggcaaagacgtcttctttattcctcccgaaaagtgtgatacactgctatgcgacatcggggagtcctcaccaaatcccaccattgaggaaggaaggactctccgggtgctgaaaatggtcgagccttggttgcgcggtaaccaattctgtatcaagattctgaatccgtatatgcccagcgtggttgaaacactcgagcagatgcagagaaagcacggcgggatgcttgtaaggaacccactgtcgcgaaattctacccatgagatgtactgggtgagttgcggaacgggcaacatcgtctccgcggtgaatatgaccagccggatgttactgaaccgttttacaatggctcacagaaaacctacttatgaacgcgatgttgacttgggtgcagggaccaggcacgtggccgtcgagcccgaagtggctaacctcgatataattggacagcggatcgagaatatcaagcatgaacacaaatcaacatggcattacgacgaggataacccttataagacttgggcctaccacggctcctatgaggtaaaaccatctggcagcgcaagttccatggtgaatggggttgtcaagctgctaaccaagccctgggacgtgattcctatggtgacacaaatagccatgaccgatactacgccattcggacagcagagagtctttaaagaaaaggttgacacacgcacccccaaagctaagaggggtactgcgcaaatcatggaggtgaccgccaaatggctttggggcttcctgagccgaaacaagaagccgcggatttgtacaagagaagagtttacgaggaaagtacgctctaatgcagctatcggggccgtgttcgtcgacgaaaaccagtggaactcagcaaaggaggccgtggaggatgaacgtttttgggacctcgttcatcgggagagagaactgcacaaacagggaaagtgcgctacctgcgtgtacaacatgatgggcaaaagggagaagaagttgggtgagttcgggaaagccaagggaagtcgcgcgatttggtacatgtggctgggcgcacgatttctcgagttcgaggcccttggcttcatgaatgaagatcactggttttcccgggagaacagcctgtctggggtcgaaggagagggtttacataaactgggctatatcttgagagacatatcgaagatccctgggggaaatatgtacgctgatgacactgccggctgggatacaaggattaccgaggacgatctccagaacgaagcacgcatcactgacattatggagccagaacacgctctgctagccaaatcaatcttcaaacttacatatcaaaataaagtggtaagagttcagcggcccgctaagaacggtaccgtgatggatgtcataagcaggcgtgaccagcgagggtccggacaggtgggcacatacggcctgaatacttttaccaacatggaggcccaactcattcgccagatggaaagtgaggggatcttctctcctagcgagctggaaacgccaaacttggcagagagagtgttagattggctggaaaagtatggagtcgagcggctcaaaaggatggcgatctccggtgacgactgtgttgtgaagcccattgatgaccgctttgccaccgctcttacagccctgaatgatatgggcaaagtaagaaaggacataccgcagtgggaaccttcaaaagggtggaacgattggcagcaagtgcccttctgcagtcatcactttcaccagctaatcatgaaggacggacgggagattgtcgtgccatgtaggaatcaggatgagctggttggccgagcacgtgtgtctcagggtgctgggtggagcctcagagaaactgcctgcttgggaaagtcctacgcacaaatgtggcagctgatgtatttccatcgccgggaccttaggctggccgcgaacgctatctgttcagccgtccctgtggattggattcccaccagcagaacaacttggtctatccacgcacatcaccagtggatgaccacggaggacatgctctccgtatggaatcgcgtttggatagaagagaacccatggatggaagataaaacacatatcagtagctggggcgacgtgccctacttaggcaagcgggaggaccaatggtgcgggtcgctgattggattgaccgccagggctacttgggccacaaatatccaggtcgcaattaaccaggtgcgaagactgatcggtaatgagaactacctcgattatatgacctccatgaaacggtttaagaatgaatctgaccctgagggcgctctttggtga

SEQ ID NO: 13887 - RNA, 9879 nt, synthetic construct
  misc_feature 1..9879: note = derived and/or modified CDS sequence (opt3) from DENV-1__GU131706__SS-prME
  source 1..9879: mol_type = other RNA
agcgtgaccatgctgctcatgcttatgcccaccgccctggctttccacttgactacgcggggcggggaacctcatatgatcgtctccaagcaggaaaggggaaagtctttactgtttaagacctcagccggtgttaatatgtgcacgctaattgccatggacctcggcgaactgtgtgaagatactatgacctacaaatgcccacggattacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcagaaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagtacaagtattcgtggaaaagctggggcaaggccaagataatcggggcggacgtgcagaataccacatttattatcgatggaccaaacactcctgaatgtcccgacgatcagagggcctggaatatttgggaggtcgaggactacggcttcggtatctttaccacaaacatatggcttaaattgcgtgattcctatacacaggtgtgcgaccaccggctcatgtcagctgcaattaaggatagtaaagccgttcacgctgacatggggtactggatcgaatctgagaagaatgaaacctggaaactggcccgagcatccttcattgaggtgaagacttgtatctggccaaagtcccatacactatggtcaaacggagtactggaaagcgagatgataatccccaaaatttatggcggtcctatctctcaacacaattacagaccaggctacttcacccagactgcggggccgtggcatctcggaaagctggagcttgattttgacttgtgcgaaggcacaaccgtcgtggtggatgagcactgcgggaacaggggaccctccctgcgcacgactaccgtcacaggcaaaattatccacgaatggtgttgccggagttgtaccttacctccactcagattcaggggtgaggacgggtgctggtatggaatggagatacgccccgttaaggaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattatgggacagctcacctggaacgatctgatcagactttgcattatggttggcgccaatgcatctgacaggatggggatgggaatgacatacttggctctgatggccactttcaaaatgcgccctatgtttgcagtgggcttactcttccggagactgaccagcagggaggtccttctgctaacgataggtctctcactggtggccagtgttgaattgccaaactccctggaggaattaggggatggactcgctatgggcatcatgattctgaaacttctgacagactttcaatctcatcagttgtgggcgaccctcctgagcctaactttcatcaaaaccacattttccctgcactatgcctggaagactatggcaatggtgctttcaattgtcagcctcttccccctgtgtttgagtaccacgtctcagaaaacaacctggctgccggtattactcggctccctggggtgcaagcctcttactatgtttctgatcgctgagaataagatatggggacgacgcagctggccattgaacgaaggtatcatggccgtgggcattgtttcgatcctcctgtcatctctactgaaaaacgatgtgccccttgccgggcctctcattgctggaggcatgctgatcgcatgttacgtcataagtggttccagcgccgacttgtctttagagaaggcggctgaggtgagctgggaagaggaagccgagcattccggggcatcacacaatattctggtagaagtgcaggatgacggaacaatgaaaatcaaggatgaggagcgggacgataccctcactatcctgcttaaagccacactgttggctgtcagtggcgtttatcccctaagcattccagcaaccctgttcgtgtggtacttctggcaaaagaaaaagcagagatctggcgtgctctgggacacgccttcacccccagaagtcgagagggccgtgctggatgacgggatatatcgtatcatgcagcgcggacttttaggtcggagccaggttggcgtaggggtgtttcaagaaaacgtcttccatactatgtggcacgtgaccagaggagcggttctgatgtaccagggcaagaggctcgagccgagttgggctagcgtgaaaaaggacttgatttcctacggtgggggatggcgactgcagggctcttggaatacaggcgaggaagtccaggtgatcgccgtagagcctgggaaaaaccccaagaatgtccaaaccgcaccaggaacatttaaaactcccgaaggtgaggtgggcgccattgctctcgatttcaagcctgggacctcgggaagcccaatcgttaaccgggaaggcaagatagtgggtctgtatgggaatggagtcgtgacgacatcaggcacttacgtttccgccatcgcacaggctaaagccagtcaggagggcccccttcctgagattgaagacgaggtgtttcgcaagagaaacctgaccatcatggatttgcacccggggtctggaaaaacaaggcggtatctaccagcgattgtccgagaagccatcaagagaaaactgcgcaccctcatattagcacccactagggtggtagctagcgagatggccgaagctctgaagggtatgcctattcgttaccaaaccacagcagtgaagtccgagcatacgggcaaagagatcgttgaccttatgtgccacgccactttcaccatgcggctgctctcaccagtcagagtgcccaattataacatgatcattatggatgaagcccattttacagacccttctagcatcgctgcgagggggtacataagtacccgcgtgggaatgggcgaggcagccgctattttcatgactgccacaccgcccggttccgtcgaagcatttccacagagcaatgccgtaatccaggatgaggaacgagacattcctgagagatcttggaactcagggtatgagtggatcaccgatttccccggaaagacggtgtggtttgttccatccataaaaagtggcaatgacattgctaactgtttgcggaagaatggcaaaagggtgatccagctgagccgcaagactttcgatacagaataccaaaagaccaaaaacaacgactgggactacgtcgtgaccactgatatctcggagatgggggcgaatttccgtgccgacagagttattgatcctcggaggtgcctcaagcccgtgatcctgaaagacggaccagaacgcgtcattcttgcaggtccgatgcctgtgacagtagcttctgccgcacagcgaagaggccggatagggaggaaccacaataaggagggagatcagtatatctacatgggccagcccctaaacaatgacgaggatcatgcccactggaccgaagctaaaatgctgttggacaacattaatacaccagagggtatcatccccgccttatttgaacctgagcgcgaaaagtccgcggcaattgatggggagtatagactgaggggcgaggcccggaagactttcgtggaactcatgcgtcgcggagacctgccagtttggcttagctacaaagtcgcttcagagggctttcaatatagtgatcgaagatggtgcttcgacggggaaaggaacaatcaggtgctggaggaaaacatggatgtggagatatggacgaaggagggagaacggaaaaagctccgccccagatggttggacgccaggacctactctgaccctctggctctacgggagtttaaagagttcgcagccggtcgaagatccgtcagcggcgatctgatcctcgagattgggaaacttccgcagcacctgacacagcgcgctcaaaatgccttagacaacttggttatgctgcataattcagaacagggaggcagggcatatcggcacgcgatggaggagctcccagatactatcgaaaccctgatgcttctggccctcattgctgtgttgacaggtggggtaaccctgtttttcttaagtggccgtggactaggcaaaactagcatcgggctgctctgtgtgatggcctcctctgtccttctgtggatggcaagcgtggagccccattggatagctgcctccatcattttggaatttttcctgatggttctcctgatccctgagcccgacagacagaggacgccacaggataaccaacttgcatacgtggtcattggactcctgtttatgatcttgaccgtagccgctaatgagatgggtctgttagaaacaactaagaaggacctaggcatagggcacgtggcggttgagaaccaccatcacgccgcaatgctggatgtggacctccatcctgcttcagcctggaccctttacgccgtcgcaacaaccattatcactcccatgatgcgccacacaattgaaaacacgaccgctaatatctctctgactgccatagcgaaccaggctgccatcttgatgggactggataaaggctggccaattagtaagatggacatcggtgtgcctctcctggcacttgggtgctattcgcaggtcaatccgttaacactgaccgccgctgtgctcatgttggttgcacattacgccattatcggccccggactgcaagcgaaagctacccgggaggcccagaagcgaacagcagccggcataatgaaaaacccaactgtggatgggattgtagctatcgacctagatcctgtggtctatgacgccaagttcgaaaagcagctgggacagatcatgctccttattctgtgtacgagccaaatcttgctgatgagaaccacatgggcactctgcgagtccataactctggctaccggccccttaacaaccctttgggagggttctccagggaaattttggaatactacgattgccgtttcaatggcgaacatcttcaggggaagctacctggccggcgcaggtctcgctttctccctaatgaagagtctgggcgggggacgccggggcacaggggcccagggagaaaccttgggcgagaaatggaagagacagctgaatcagctctctaaaagcgaatttaacacttataagcgttcaggtattatggaggtggacaggtccgaagcaaaggaggggcttaaacggggagagaccacaaagcacgctgtcagtcgcggcactgccaaactgcgatggttcgtggaaagaaatttggtaaagcctgagggtaaagtgatcgatctgggctgtgggaggggaggctggagctactattgcgccgggctcaagaaggttaccgaagtgaaaggatacacaaagggcggtcccgggcacgaggaaccgataccaatggcgacgtacggatggaacttagtcaaactgcattctggcaaggacgtgtttttcatccctcccgagaaatgtgatacccttctgtgcgacattggcgagtcctcaccaaatcccactatcgaagaggggcggacactacgcgtcctcaagatggtggaaccttggctgagaggaaaccaattttgtattaaaatcttgaatccgtatatgcccagcgttgtagagaccctggagcagatgcagaggaagcacggtggcatgctcgtgcgaaacccactttcgagaaattctactcatgaaatgtactgggtcagttgcgggacaggaaacattgtgtccgctgttaatatgaccagccgtatgctgttaaacagattcacgatggcacaccgcaagcctacctatgagagggatgtggacctgggcgccggtacacggcacgtcgctgtggaacccgaggtagccaacttggatatcatagggcagagaattgaaaatatcaaacatgagcacaagtcaacttggcattacgacgaggataacccttataaaacctgggcataccacggatcctatgaagtgaagccatctggcagcgccagttccatggttaatggcgtcgtgaaactcctgacaaagccctgggacgtgatccctatggtcactcaaattgctatgaccgatacaaccccatttgggcagcagcgcgttttcaaggagaaagtggacactaggacgcccaaggcgaaacgaggaacagcccaaataatggaagtaaccgcaaagtggctatggggttttcttagccggaacaaaaagccgagaatctgtactagggaggagttcacccgcaaggtgcgttctaatgctgccattggcgcagtctttgtggacgagaaccagtggaactcagccaaagaggctgttgaagatgagcggttctgggacctggtgcatagagaaagggagctccacaagcaggggaaatgcgccacatgcgtctacaacatgatgggaaagcgcgagaagaagctgggcgagtttggtaaggcgaaagggagtcgagcaatctggtacatgtggttgggagcccggttcctggagttcgaagctctcggctttatgaatgaggatcactggttctccagagaaaacagcctttctggcgtggagggggagggactgcataagttaggttatattctgagggacatctcgaaaatacctggcgggaatatgtacgccgatgacacggcaggatgggatacccgcatcactgaagacgatttgcagaacgaggctagaattacagacatcatggaaccagagcacgccctcctggctaagtcaatttttaaactaacctatcaaaataaggtagttcgggtgcagaggcccgccaaaaacggcactgtcatggatgtgatcagccgtcgagaccagcgcggttccggacaggtgggaacatacggccttaataccttcacaaacatggaagcacaactgataagacagatggagagtgagggcatattttctcctagcgaactcgagactccaaacctggcggaacgggtcttggattggttagagaagtatggggttgaaaggctgaagcgcatggccatctccggagacgactgtgtggtaaaacccatcgatgacagattcgctaccgccctcacggcacttaatgatatgggtaaggtgcggaaagacattccgcagtgggagccttcaaagggctggaacgattggcagcaagtccccttttgcagtcatcacttccaccagctgataatgaaagacgggagggagatcgtggttccatgtcgaaatcaggatgagctagtgggacgtgctagagtctctcagggcgccggttggagcctgcgcgagaccgcatgcctcgggaagtcctacgcccaaatgtggcagttgatgtattttcatcggagggacctgagacttgcggctaacgccatttgttcagcagtgcctgtagattggatccccacaagccgcactacctggtctattcacgcccatcaccagtggatgacaactgaagacatgctgtccgtttggaatcgggtgtggatcgaggaaaacccatggatggaggataagacccatataagtagctggggagacgtcccctacctcggcaaaagggaggaccaatggtgcggctcgttaatcgggctgacggctcgagccacatgggcaaccaatattcaggtggctatcaaccaggttagacggttgattggaaatgaaaactacctggattatatgacttccatgaagaggttcaaaaatgagtctgaccctgaaggtgccctctggtga

SEQ ID NO: 13888 - RNA, 9879 nt, synthetic construct
  misc_feature 1..9879: note = derived and/or modified CDS sequence (opt3) from DENV-1__GU131708__SS-prME
  source 1..9879: mol_type = other RNA
agcgtgaccatgctgctcatgcttatgcccacagccctggctttccacttgactacgcggggcggggagcctcatatggtcgtttccaagcaggaaagaggaaaatctttactgtttaagacctcagcgggtgtgaacatgtgcacactaatcgccatggacctcggcgagctgtgtgaagatactatgacctacaaatgcccacggattacagaggcggaaccggacgatgtagactgttggtgcaatgctaccgatacttgggtgacatatgggacctgtagtcaaacgggagagcaccgccgagacaagcgtagcgtcgcccttgcaccccatgtgggcctgggtttggagactagaaccgaaacatggatgtcctctgagggggcctggaaacagatacagagggttgaaacttgggctctccggcaccctggattcaccgtgatcgcactgtttctggcccatgctattggcacatcgatcacccagaagggcattatcttcatactcttaatgctggtcacgccatcaatggccatgcgctgcgtggggatcggaagcagagattttgtagagggtcttagtggcgcgacttgggttgacgtggtcttggagcacgggtcctgtgtgacaaccatggcaaaggataaacccactctggacattgaactactcaagacagaggtgaccaaccctgccatcctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactagctcgttcaaactggagaaggaagtcgctgagacccagcacggaacggtgcttgttcagataaagtacgagggtacagacgcgccttgcaaaatcccattctctacccaagatgaaaagggcgtgactcagaacgggcgcttgattacagcaaatcccatcgtaaccgacaaagagaagcctgtcaacatagaagccgagccaccctttggagagtcctatattgtgatcggcgctggtgaaaaagccctgaagctctcatggttcaagaaagggagtagcatcggcaagatgtttgaggcaactgccagaggagctaggcggatggccattctgggcgataccgcatgggacttcgggtccatcggaggtgtttttacatctgtgggcaaacttgtccatcagattttcgggacggcgtacggagtgctgtttagcggcgtatcatggaccatgaagataggtttgggggtgctcctgacttggttaggcctgaatagtcgatccacaagcctatctatgacctgtatcgctgttggactcgtcacactgtaccttggcgtgatggtgcaggccgattcagggtgcgtcattaactggaaaggacgcgaattgaagtgtggcagtggtatcttcgttactaatgaggtgcacacctggacggaacaatataagtttcaggcagacagcccgaaaagactgtccgccgctatcgggaaggcctgggaggagggagtgtgcggcattaggtctgcaacacggctcgaaaacgtaatgtggaaacagatatcgaacgagctgaatcatatcttactggaaaacgacatgaagttcaccgtcgtggttggtgatgtggctggcattcttgcccaggggaaaaagatgatccgccctcaacccatggagtacaaatatagctggaagtcctggggaaaggcgaaaattatgggcgccgacgtccagaatactacctttatcatagatgggccaaacacacctgaatgtcccgacgatcagagagcttggaatatctgggaggtggaggactacggattcggcatttttactaccaacatctggttgaagctcagggattcatatacacaggtttgcgaccaccgtctgatgagtgcagccattaaagattctaaggctgtgcacgccgacatgggttactggatcgaaagcgagaaaaatgaaacgtggaagctagcacgggcgtccttcatagaggtaaagacctgtatttggccaaaatcacatactctgtggagcaacggggtcctcgaatctgagatgatcattcccaagatctatggaggccctatatcccaacacaattaccgaccaggttacttcacacagaccgccggcccgtggcatctggggaaacttgagttggattttgacctgtgcgaaggaactacagtggtggtcgatgagcactgcggcaacagagggcccagtttaaggaccacgactgttaccggaaagatcattcacgaatggtgttgccgcagctgtacactccctccactgcggttcagaggcgaggacggttgctggtatgggatggagatcaggcccgtgaaagaaaaggaggaaaatcttgtaaagtctatggtgtccgctggatcaggcgaggtcgacagttttagcctgggtttgctctgtatttcgatcatgatagaagaggtgatgcgctcccgatggtctcggaaaatgctgatgaccggcactctagccgttttcctgctcctgattatggggcagcttacatggaacgatttgatccgtctgtgcatcatggtgggagcaaatgctagcgacagaatgggcatggggaccacatacttagccctcatggcaacttttaagatgaggcctatgttcgccgtcggactgctttttcgccggctgacctcaagagaggtgctactcctgacgattggcttgagtctggttgcttccgtggaattaccaaactctctcgaggaactgggtgatgggcttgcgatgggaatcatgattctgaaattgctcacagacttccaaagccatcagctgtgggccaccctactgtcccttacttttataaagaccacattctcactccactatgcatggaaaactatggctatggtcctgagcatcgtaagtttgtttcccctgtgtttatctaccacgtcccagaagacaacctggctcccggtgctgcttggcagcctgggctgcaagcctttgactatgttcctcattgccgagaataaaatctgggggaggcgatcgtggccactgaacgaaggaattatggccgttggtatcgtgtcaatactactgtctagtcttctcaagaacgatgtccccctggctggccctttgatcgcagggggaatgttaattgcctgttacgtgatctccggcagctctgcggacctgagcctcgagaaagctgccgaggtatcctgggaagaggaagcagagcattcaggtgccagtcacaatattctggtggaagtccaggatgacgggacaatgaagatcaaagatgaggagcgcgacgatacccttactatactgttgaaggctacactactggcagttagcggagtgtatcccctctctattccagccaccctgtttgtgtggtacttctggcagaaaaagaagcagcggtccggcgtcctttgggacacgccttcacccccagaagtggagagagcggttttagatgacggcatctataggatcatgcagcgtgggctgctcggacgcagtcaggtaggtgtgggcgtcttccaagaaaacgtgtttcatactatgtggcacgttaccagaggggctgtgttgatgtaccagggaaaaagactggagccgagctgggcctccgtcaagaaagacctcatttcttacggcggtgggtggaggctgcagggatcgtggaatacaggcgaggaagtgcaggtaatagcagtcgagcctggcaagaaccccaaaaatgtgcaaaccgccccagggacattcaagactcccgaaggagaggttggtgctatcgcccttgattttaagcctggcaccagcgggtcaccaattgtgaaccgagaaggaaaaatcgtcggcctgtatggtaatggggtggttacgacatccggaacttacgtgagtgcaattgctcaggccaaggcgtctcaggagggccccttgcctgagatcgaagacgaggtcttccggaaacgcaacctaaccataatggatctgcacccgggcagcgggaagacaagaaggtatctcccagccatcgtgcgggaagcaattaaacgaaagttaagaaccctgatccttgctcccactcgcgtagtggcctccgagatggctgaagcactgaagggaatgcctattaggtaccaaaccacagccgttaaatcagagcatacgggtaaggagatcgtcgacctcatgtgccacgccacttttaccatgcgtttgctgtctccagtgcgggtgcccaattataacatgataattatggatgaagctcatttcacagaccctagcagtatcgcggcaagaggctacatctccaccagggtcgggatgggagaggccgctgccatttttatgactgcaacaccgcccggcagcgtagaagccttcccacagtctaatgctgtgatccaggatgaggaacgcgacatacctgagcgatcatggaactccggttatgagtggattaccgattttcccgggaaaacggtttggttcgtgccaagtatcaagagcggaaatgacattgcgaactgtctcaggaaaaatggcaagcgggtcatccagctgtcgaggaagacttttgatacagaataccagaaaaccaagaacaacgactgggactacgtggttaccactgatatatctgagatgggcgccaatttccgcgcagaccgtgtgattgatcctagacggtgccttaaacccgtcatcctaaaggacgggccagaaagggtgatcctggctggaccgatgcctgtaacagtggcctccgcagcccagcgccgaggtagaattggccggaaccacaataaagagggggatcagtatatctacatgggacagcccttgaacaatgacgaggatcatgctcactggaccgaagccaagatgttactggacaacattaatacaccagagggcataatccccgcactcttcgaacctgagagggaaaagagcgcagccattgatggtgagtatcgcctgagaggggaggctaggaaaacttttgttgaacttatgcggcgtggcgacctgccagtctggctctcatacaaggtggccagtgagggattccaatattctgatcgccgatggtgctttgacggcgaaagaaacaatcaggtgttggaggaaaacatggatgtcgagatctggacgaaagagggggaaaggaagaaactgcggccccgctggctagacgctagaacctactccgaccctctggcactcagggagttcaaggaatttgccgctggacggcgaagcgtttcaggtgatcttatcctggagattggcaaattaccgcagcacttgacacagagagcccaaaatgcactggacaacctcgtgatgctgcataatagtgaacaaggcgggcgcgcgtataggcacgccatggaggagcttccagatactatagaaaccctgatgctcttggctctgatcgccgtattaacagggggtgtgaccctattctttctgagcgggcggggcctcggaaagacttccattggccttctgtgtgtcatggcatctagcgtgttgctgtggatggcttccgttgagccccattggatcgccgcatcaattatcctcgagttctttctgatggtgcttctcatacctgagcccgaccgtcagagaacgccacaggataaccaactggcctacgtcgtaatcgggttgctgttcatgattttaaccgtggctgcgaatgagatgggactactggaaacaactaagaaagacctcggtatcggccacgccgcagttgggaaccaccatcacgctgccatgcttgatgtggacctgcatcctgcctctgcatggaccttgtacgctgtcgccacaaccattatcactcccatgatgaggcacacaatagagaacacgaccgcgaatattagtctgactgctatcgccaaccaggcagccattctcatgggactggataagggctggccaatctcgaaaatggacataggtgtgcctcttttagctctggggtgctatagccaggtcaatccgctcacattgaccgcagccgtgctgatgctagttgcgcattacgctatcattggccccggactgcaagccaaggcaacccgcgaagcccagaaacggacagctgccggcatcatgaagaacccaactgtggatgggattgtagcaatcgacctcgatcctgtggtctatgacgctaagtttgagaaacagcttggacagataatgctgttgattctgtgtacgtcccaaatcctcctgatgcgaaccacatgggccttatgcgaatctatcactcttgcgaccggccccctgacaaccctctgggagggttcaccagggaagttctggaatactacgattgccgttagcatggcaaacatctttagaggatcctacctagctggcgccggtctggcattcagtttgatgaaatctctgggcgggggaaggcgcggcacaggggctcagggagagaccctcggcgaaaagtggaaacggcagcttaatcagctgagcaagtcagagttcaacacttataagagatccggtataatggaagtggaccgtagtgaggccaaagaagggttgaagaggggagagaccacaaaacacgccgtcagccggggcactgcgaagctgcgctggtttgtggagcgaaatctcgtaaaacctgaaggtaaggtgattgatttaggctgtgggagaggaggctggtcttactattgcgctgggctgaagaaagttaccgaggtgaagggatacacaaaaggcggtcccgggcacgaagaaccgatcccaatggcaacgtacggatggaaccttgtcaagctgcattccggcaaagacgtgttctttattcctcccgaaaagtgtgataccctactctgcgacatcggcgagtcaagcccaaatcccactatagaggaagggaggacactgcgggtcttgaaaatggtggagccttggctgcgcggaaaccaattctgtatcaagattctcaatccgtatatgccctcggttgtagaaacccttgagcagatgcagagaaagcacggtggcatgctggtgaggaacccattatctcgaaatagtactcatgagatgtactgggtctcctgcgggacaggaaacatcgtgagcgccgttaatatgacctcacggatgctgttgaaccgttttacgatggctcacagaaaacctacctatgaacgcgatgtggacctcggcgccggtacaaggcacgtcgcagtggagcccgaagtagccaacctggatattatcgggcagcggattgagaatatcaagcatgaacacaaatccacttggcattacgacgaggataacccttataagacctgggcttaccacggatcttatgaggtgaaaccaagcggcagtgcgtccagcatggttaatggcgtcgtgaagctacttacaaagccctgggacgtgatacctatggtcactcaaattgccatgaccgatacaaccccattcgggcagcagagagtttttaaagaaaaggtggacactcgcacgcccaaagcaaagaggggaacagctcaaatcatggaggtaaccgccaaatggctgtggggtttcctctctcgaaacaagaagccgcggatctgtactagagaagagtttaccaggaaagtgcgctcaaatgcagccattggcgctgtcttcgtggacgaaaaccagtggaatagtgccaaggaggcggttgaggatgaacgtttttgggacctggtgcatcgggagagagaattgcacaaacaggggaagtgcgcaacatgcgtctacaacatgatgggaaaaagggagaagaagctgggcgagttcggtaaagccaaggggtcccgcgctatatggtacatgtggctcggagcccgatttcttgagttcgaggcactgggcttcatgaatgaagatcactggtttagccgggagaactctttatcgggcgtggaaggggagggactgcataaattgggttatatcctcagagacatttcaaagatccctggcgggaatatgtacgctgatgacacggccggatgggataccaggattactgaggacgatctgcagaacgaagctcgcatcacagacataatggagccagaacacgccctacttgcaaaaagcatcttcaagctgacctatcaaaataaagtagttagagtgcagcggcccgcgaagaacggcactgtcatggatgtgatttccaggcgtgaccagcgaggtagtggacaggtgggaacatacggcctcaatacctttacaaacatggaggcccaactgatccgccagatggaatctgagggcattttcagcccttccgagttggaaactccaaacttagctgagagagtcctggattggctcgaaaagtatggggttgagcggcttaaaaggatggccatctcaggagacgactgtgtggtaaagcccatagatgaccgctttgcaaccgctctgacggccctaaatgatatgggtaaagtgagaaaggacattccgcagtgggaacctagtaaaggctggaacgattggcagcaagtccccttctgctctcatcactttcaccagctgatcatgaaggacgggcgggagatcgtggttccatgtaggaatcaggatgagctcgtgggacgagcacgtgtcagccagggcgccggttggtccttgagagaaaccgcgtgcctggggaagtcatacgctcaaatgtggcagcttatgtatttccatcgccgggacctgaggctcgccgcaaacgccatttgtagcgctgtgcctgtagattggatacccacatctagaactacctggtccatccacgcccatcaccagtggatgacaactgaggacatgttaagtgtttggaatcgcgtgtggattgaagagaacccatggatggaagataaaacccatatcagctcgtggggagacgtcccctacctgggcaagcgggaggaccaatggtgcggctccttgattgggctgacggcaagggctacatgggccaccaatatccaggtggcgataaaccaggttcgaagactcatcggaaatgagaactaccttgattatatgacttctatgaaacggtttaagaatgaatcagaccctgagggtgctctgtggtga

SEQ ID NO: 13889 - RNA, 9879 nt, synthetic construct
  misc_feature 1..9879: note = derived and/or modified CDS sequence (opt3) from DENV-1__GU131710__SS-prME
  source 1..9879: mol_type = other RNA
tccgtgaccatgctgctcatgcttatgcccaccgccctggctttccacttgactacgagaggaggggaacctcatatgatcgcatccaagcaggaaaggggaaaatctttactgtttaagacctcagccggtgtcaatatgtgcacgctaattgcgatggacctcggagaactgtgtgaagatactatgacctacaaatgcccacggataacagaaaccgaaccggacgatgttgactgttggtgcaatgctactgatacatgggtgacctatgggacgtgtagtcaaactggagagcaccgccgagacaagcgtagcgtagcccttgcaccccatgtgggcctgggtttggagaccagaacagaaacttggatgtcctctgagggggcctggaaacagatccagagggtcgaaacctgggctctccggcaccctggattcacagtgattgcactgtttctggcccatgctatcggcacctcgattacgcagaagggcatcatattcatcctcttaatgctggttactccatcaatggccatgcgctgcgtggggattggaagcagagattttgtcgagggtcttagtggcgcgacatgggtggacgtagttttggagcacgggtcctgtgtgaccactatggcaaaggataaacccacactggacatcgaactactcaagaccgaggtcacgaaccctgccgtgctgaggaaactttgcattgaagctaagatctctaataccacaactgatagccggtgtccaacccaaggagaggccacactggtggaagaacaggacgcaaacttcgtctgccgccgaacttttgttgatagaggctggggtaatgggtgtggattgttcggcaaaggctccctcataacctgcgctaagtttaagtgcgtgacaaaactggaggggaagattgtacagtacgaaaacttaaaatattcagtgatcgtcaccgtgcacactggagaccagcatcaagttggtaatgagagtacggaacacggcacaaccgccactattacaccccaggcgcctacaaccgagatccagctgactgactacggggccctcacacttgattgtagcccaaggacgggactggacttcaacgaaatggtgttgctaaccatgaaggagaaatcttggctggtccataagcagtggtttctcgatctgccgcttccctggacttccggcgcatcaacaagccaagagacctggaatcggcaggacctgttggtgacattcaaaactgctcacgccaagaagcaggaagtagttgtgctcggtagtcaagagggggctatgcacaccgccctgacgggcgcaaccgaaatccagacatctggaactaccacaatttttgccggccatttaaaatgccgtctgaagatggataaactaactctcaaggggatgtcctatgtcatgtgtaccggtagcttcaaactggagaaggaagtggctgagacgcagcacggaacagtccttgtgcagataaagtacgagggcaccgacgcgccttgcaaaatcccattctcgactcaagatgaaaagggggttacacagaacggacgcttgattaccgcaaatcccatcgtgactgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaaccgccagaggcgctaggcggatggccattctgggggatacagcatgggacttcggaagcatcggtggcgtgtttacgtccgttgggaaacttgtgcatcagattttcggaaccgcgtacggcgtcctgttttctggtgtgagctggactatgaagatagggatcggcgtattgctcacatggctgggattaaattcacgaagtacctccctgagcatgacatgtattgctgtgggcctaatcactctctacctgggggttatggtccaggccgattctggatgcgtgatcaactggaaaggccgcgaacttaagtgtggttcagggattttcgtgaccaatgaggtccacacgtggacagaacaatataagtttcaggcagacagtccgaaaagattgagcgccgctataggaaaggcctgggaggagggcgtttgcggtatcaggtccgcaacccggctggaaaacattatgtggaaacagatctctaacgagctcaatcatattctgttagaaaacgacatgaagttcactgtggtggtaggcgatgtcgctgggatcctggcccagggcaagaagatgatacgccctcaacccatggagtacaaatattcgtggaaaagctggggcaaggcgaagatcattggggccgacgtgcagaataccacatttatcattgatggaccaaacactcctgaatgtcccgacgatcagagagcttggaatatctgggaggttgaggactacggcttcggtatatttaccacaaacatttggcttaagttgagggattcctatacacaggtgtgcgaccaccgtctcatgtcagcagccatcaaagatagtaaggctgtccacgccgacatggggtactggattgaatctgagaaaaatgaaacctggaagctggcacgggcgagcttcatcgaggtgaagacttgtatatggccaaaatcccatacactatggtcaaacggagttctggaaagcgagatgatcattcccaagatctatggcggtcctatttctcaacacaattaccgaccaggctacttcacccaggccgctgggccgtggcatctcggaaaactggagcttgattttgacttgtgcgaaggcactacagtggtagtcgatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtgaaagaaaaggaggaaaatctggtcaagagcatggtttctgccggctccggtgaggtggactcatttagtcttggcctgttgtgtatcagcatcatgattgaagaggtaatgcgctcgcgatggtcccggcgtatgctcatgaccgggactctggcagtgttctttctactgatcatgggacagctcacatggaacgatctgattagactttgcataatggtcggcgctaatgcctctgacaggatggggatgggaaccacatacttggcactgatggccactttcaaaatgcgccctatgtttgctgtgggcttactcttccggagactgaccagcagggaggttcttctgctaacgatcggtctctcactggtggcgagtgtcgaattgccaaactccctggaggaattaggggatggactcgccatgggcattatgatcctgaaacttctgacagactttcaatctcatcagttgtgggcaaccctcctgagcctaactttcattaaaaccacattttccctgcactatgcttggaagactatggccatggtgctttcaatcgttagcctcttccccctgtgtttgagtaccacgtctcagaaaacaacctggctgccggtgttactcggctccctggggtgcaagcctcttactatgtttctgatagccgagaataagatctggggacgacgcagctggccattgaacgaaggtattatggctgtcggcatcgtatcgattctcctgtcatctctactgaaaaacgatgtgccccttgcagggcctctcatcgccggaggcatgctgatagcgtgttacgttattagtggttccagcgctgacttgtctttagagaaggccgcagaggtgagctgggaagaggaagccgagcattccggggcttcacacaatatcctggtcgaagtgcaggatgacggaacaatgaaaatcaaggatgaggagcgggacgataccctcactattctgcttaaagcaacactgttggccgtaagtggcgtgtatcccctaagcataccagcgaccctgttcgtctggtacttctggcaaagaaagaaacagaggtctggcgttctctgggacacgccttcacccccagaagtggagcgtgctgtgctggatgacgggatctatcgcattatgcagcggggacttttaggtagaagccaggtcggcgtgggggtttttcaagaaaacgtattccatactatgtggcacgtgaccaggggagccgtcctgatgtaccagggcaagcgactcgagccgagttgggcaagcgtgaagaaagacttgatctcctacggtgggggatggcggctgcagggctcttggaatacaggcgaggaagttcaggtgattgccgtcgagcctgggaagaaccccaaaaatgtgcaaaccgctccaggaacatttaagactcccgaaggtgaggtaggcgccatcgcactcgatttcaaacctgggacctcgggaagcccaatagtcaaccgcgaaggcaagatcgtgggtctgtatgggaatggagttgtgacgacatcaggcacttacgtctccgctattgcccaggcgaaggccagtcaggagggcccccttcctgagatcgaagacgaggtgtttagaaaaaggaacctgaccattatggatttgcacccggggtctggaaagacacggcgatatctaccagcaatcgttagagaagctataaaacgcaagctgaggaccctcattttagcccccactcgtgtggtcgctagcgagatggcagaagccctgaaaggtatgcctatccggtaccaaaccacagccgtgaagtccgagcatacgggcaaggagatcgtagaccttatgtgccacgctactttcaccatgagactgctctcaccagtgagggttcccaattataacatgattatcatggatgaagcgcattttacagacccttctagcatagcagcccgcgggtacattagtacccgagtcggaatgggcgaggctgccgcaatcttcatgactgccacaccgcccggttccgtggaggcttttccacagagcaatgcggtgattcaggatgaggaaagagacatccctgagcggtcttggaactcagggtatgagtggataaccgatttccccggaaaaacggtctggtttgtaccatccattaagagtggcaatgacatcgccaactgtttgaggaaaaatggcaagcgcgtgatccagctgagccgtaaaactttcgatacagaataccaaaagaccaagaacaacgactgggactacgttgtgaccactgatatttcggagatgggggcaaatttcagagctgaccgggtcatcgatcctaggcgctgcctcaaacccgtgattctgaaggacggaccagaacgagttatacttgccggtccgatgcctgtgacagtcgcatctgccgctcagagacggggcaggatcgggcgcaaccacaataaagagggagatcagtatatttacatgggccagcccctaaacaatgacgaggatcatgcccactggaccgaagcgaagatgctgttggacaacatcaatacaccagagggtatcattcccgcattatttgaacctgagagagaaaaatccgccgctatagatggggagtataggctgcggggcgaggcccgtaagactttcgtggaactcatgcgccgaggagacctgccagtatggcttagctacaaggtggcttcagagggctttcaatatagtgatagaaggtggtgcttcgacggggaacggaacaatcaggttctggaggaaaacatggatgtcgagatctggacgaaagagggagaacgcaagaaactcagacccaggtggttggacgcacggacctactctgaccctctggccctacgagagtttaaggagttcgctgccggtagacgctccgtgagcggcgatctgattctcgagatcgggaaacttccgcagcacctgacacagagggcacaaaatgcgttagacaacttggtgatgctgcataattcagaacagggaggccgggcctatcgtcacgctatggaggagctcccagatactattgaaaccctgatgcttctggccctcatcgcagtcttgacaggtggggttaccctgtttttcttaagtggcagaggactaggcaagactagcatagggctgctctgtgtgatggcttcctctgtacttctgtggatggccagcgtggagccccattggatcgcagcctccattatcttggaatttttcctgatggtcctcctgattcctgagcccgacaggcagcgcacgccacaggataaccaacttgcttacgtggttatcggactcctgtttatgatattgaccgtggcggccaatgagatgggtctgttagaaacaactaaaaaggacctaggcattgggcacgtcgcagtagagaaccaccatcacgctgccatgctggatgtggacctccatcctgcctcagcatggaccctttacgctgttgccacaaccatcattactcccatgatgcggcacacaatcgaaaacacgaccgcgaatatatctctgactgctatcgccaaccaggcagccattttgatgggactggataagggctggccaatcagtaaaatggacattggtgtgcctctcctggctcttgggtgctattcgcaggtcaatccgttaacactgaccgcagccgtgctcatgttggtcgcgcattacgctatcataggccccggactgcaagccaaggcaacccgagaggcccagaaaagaacagctgccggcattatgaagaacccaactgtggatgggatcgttgcaatcgacctagatcctgtggtatatgacgctaaattcgaaaagcagctgggacagattatgctccttatcctgtgtacgagccaaatattgctgatgaggaccacatgggccctctgcgagtccattactctggcgaccggccccttaacaaccctttgggagggttctccagggaagttttggaatactacgatcgccgtgtcaatggcaaacattttccgcggaagctacctggctggcgccggtctcgcattctccctaatgaaaagtctgggcgggggacggagaggcacaggggctcagggagaaaccttgggcgagaagtggaaacgtcagctgaatcagctctctaagagcgaatttaacacttataaaaggtcaggtatcatggaggtcgaccggtccgaagccaaggaggggcttaagcgcggagagaccacaaaacacgccgttagtcgaggcactgcgaagctgagatggttcgtggaaaggaatttggtcaaacctgagggtaaggtgatagatctgggctgtgggcggggaggctggagctactattgcgctgggctcaaaaaggtaaccgaagtgaagggatacacaaaaggcggtcccgggcacgaggaaccgatcccaatggcaacgtacggatggaacttagttaagctgcattctggcaaagacgtgtttttcattcctcccgagaagtgtgatacccttctgtgcgacatcggcgagtcctcaccaaatcccactattgaagaggggcgcacactaagagtcctcaaaatggtggaaccttggctgaggggaaaccaattttgtatcaagattttgaatccgtatatgcccagcgtcgtggagaccctggagcagatgcagcgaaaacacggtggcatgctcgttcggaacccactttcgcgtaattctactcatgaaatgtactgggtaagttgcgggacaggaaacatcgtgtccgccgtcaatatgaccagcagaatgctgttaaaccgcttcacgatggctcacaggaagcctacctatgagcgggatgtggacctgggcgccggtacaagacacgttgcagtggaacccgaggtcgccaacttggatataattgggcagcgcatcgaaaatatcaagcatgagcacaaatcaacttggcattacgacgaggataacccttataagacctgggcttaccacggatcctatgaagtgaaaccatctggcagcgcgagttccatggtaaatggcgtggttaagctcctgacaaaaccctgggacgtcattcctatggtgactcaaatagccatgaccgatacaaccccatttgggcagcagagggtgttcaaggagaaggtcgacactcgaacgcccaaagcaaagcggggaacagctcaaatcatggaagttaccgccaaatggctatggggttttcttagcagaaacaagaaaccgaggatttgtactcgcgaggagttcacccgtaaggtgcggtctaatgcagccatcggcgctgtatttgtggacgagaaccagtggaactcagccaaggaggcggtcgaagatgagagattctgggacctggtgcatagggaacgcgagctccacaaacaggggaagtgcgcaacatgcgtttacaacatgatgggaaaacgagaaaagaaactgggcgagtttggtaaggccaaggggagtcgggctatttggtacatgtggttgggagccagattcctggagttcgaagcactcggctttatgaatgaggatcactggttctccagggaaaacagcctttctggcgtggagggggagggactgcataaattaggttatatcctgcgcgacatatcgaagatccctggcgggaatatgtacgctgatgacacggccggatgggataccagaattactgaagacgatttgcagaacgaggctcggatcacagacattatggaaccagagcacgccctcctggcaaaatcaatctttaagctaacctatcaaaataaagtcgtgagggtacagcgtcccgcgaagaacggcactgttatggatgtgataagccgacgcgaccagagaggttccgggcaggtcggaacatacggccttaataccttcacaaacatggaagcccaactgattcggcagatggagagtgagggcatcttttctcctagcgaactcgagactccaaacctggctgaaagggtgttggattggttagagaaatatggggtggaacgcctgaagagaatggccatctccggagacgactgtgtcgttaagcccattgatgaccggttcgcaaccgctctcacggcccttaatgatatgggtaaagtgaggaaggacataccgcagtgggagccttcaaaaggctggaacgattggcagcaagtacccttttgcagtcatcacttccaccagctgatcatgaaggacgggcgagagattgtggtcccatgtcgtaatcaggatgagctagtgggcagagcacgcgtttctcagggcgccggttggagcctgcgggagaccgcgtgcctcgggaaatcctacgctcaaatgtggcagttgatgtattttcataggagagacctgcgccttgccgcaaacgccatctgttcagctgtgcctgtcgattggattcccacaagccggactacctggtctatccacgcccatcaccagtggatgacaactgaagacatgctgtccgtgtggaatagggtatggatagaggaaaacccatggatggaggataagacccatatcagtagctggggagacgttccctacctcggcaagcgagaggaccaatggtgcggctcgttaattgggctgacggcaagagctacatgggccaccaatatccaggtggcgattaaccaggtccggaggttgatcggaaatgaaaactacctggattatatgacttccatgaaacgcttcaagaatgagtctgaccctgaaggtgctctctggtga

SEQ ID NO: 13890 - RNA, 9879 nt, synthetic construct
  misc_feature 1..9879: note = derived and/or modified CDS sequence (opt3) from DENV-1__GU131717__SS-prME
  source 1..9879: mol_type = other RNA
agcgtgaccatgctgctaatgcttatgcccacagcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccgatcctgccgtgctcaggaaactgtgcattgaagctaagatctctaacacgaccacagacagccggtgtccaactcaaggagaggccacccttgtcgaagaacaagatgcaaattttgtttgccgccgaacattcgtggacagaggctggggtaacgggtgtggactgtttggcaaaggctccttgatgacttgcgctaagttcaagtgcgtaaccaaactcgaggggaagatagtgcagtacgaaaatctgaaatattcagtcattgtgacagttcacaccggagaccagcatcaagtgggtaacgagagtactgaacacggcacgacagccaccatcactccccaggcgcctagcaccgagattcagttaacagattacggggccctgaccctcgactgttctccaaggactggacttgattttaatgaaatggtcctgttgacaatgaaggagaaatcctggctagtgcataagcagtggttcctggacctcccgctgccctggacgtcaggcgcaagcaccagtcaagagacttggaaccggaaagatcttctggtaacatttaagaccgctcacgccaagaaacaggaagttgtggtcttgggttctcaggagggggctatgcacacagccctcactggcgcaaccgaaatccaaacgtccggaaccacaactatcttcgccggccatctgaagtgccgtttaaaaatggacaagctgaccctaaaagggatgagctatgtgatgtgtacaggatcgttcaagctcgagaaggaagtcgctgagactcagcacggtaccgtgctggttcagattaaatacgagggcacggatgcgccttgcaagataccattttctacacaggacgaaaaaggggtgacccaaaatggacgccttatcactgcaaaccccattgtaacagataaggagaaacctgtcaatatcgaagccgagccacccttcggcgagtcctatatagtgattggtgctggggaaaagaccttgaagctgtcatggtttaaaaagggcagtagcatcggaaaaatgttcgaggccactgcaagaggcgccaggcggatggctatcctcggggacaccgcctgggattttggatccattggtggcgttttcacatctgtggggaagctggtccatcagatctttggaacggcatacggcgtgcttttcagcggtgtatcatggaccatgaaaattgggataggcgtgctgttgacttggctcggactgaacagtcgatccaccagcttatctatgacatgtatcgcggttggcctggtcacactatacctcggggtgatggtgcaggctgactcaggatgcgtcattaattggaagggccgcgaactgaagtgtggtagtgggatctttgttactaacgaggtgcacacctggacggaacagtataaattccaagccgacagcccgaagagactttccgcagccatcggaaaggcttgggaggagggcgtgtgcggtattaggtctgccacacggttggaaaatataatgtggaagcagatctcgaacgagctgaaccatattctcctggaaaatgatatgaaatttaccgtagtcgtgggcgacgttgcagggatcttagctcagggaaagaaaatgattcgccctcagcccatggagtacaagtatagctggaagtcctggggcaaagccaagatcataggggcggatgtgcaaaacactaccttcatcattgacggaccaaatacacctgaatgtcccgatgaccagagagcctggaacatctgggaggtcgaggattacggctttggtattttcactaccaatatctggctgaaacttagggactcatatacacaggtgtgcgatcaccgtttgatgagtgctgcaataaaggactctaaagccgttcacgctgatatggggtactggattgaaagcgagaagaacgaaacgtggaagctcgcccgggcatccttcatcgaggtgaaaacctgtatttggccaaagtcacatactctgtggagcaatggagtactagaatctgagatgatcatacccaaaatctatggcggtcctatttcccagcacaactaccgaccaggctactttacacaaaccgcggggccgtggcatctgggaaagctcgagctggacttcgatctttgcgaaggcactacagtcgtggtggacgagcactgcgggaatagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaacctcgtgaagtctatggtatccgccggctcaggtgaggtggatagtttcagcctgggccttctgtgtatatcgattatgatcgaagaggtcatgaggtcccgctggtctcgaaaaatgttgatgaccgggactctcgctgtgtttttcctgctaatcatgggacagctgacatggaatgacctcattcggctgtgcatcatggttggcgccaacgcaagcgatcgtatggggatgggaaccacataccttgctttgatggccacttttaagatgagacctatgttcgcagtgggcctgttatttaggcgcctcacctcacgggaggtcctgcttctgacgattggtctaagtctcgtggcctccgttgaactgccaaattctttggaggaactgggggacggattagctatgggcataatgatcctcaaactgcttacagatttccagagccatcaactgtgggcgaccttgctctccctgacttttattaagaccacattctcactacactatgcctggaagactatggcaatggtgctgagcatcgtcagtctttttcccctctgtctgtctaccacgtcccagaaaacaacctggttgccggtactgttaggcagcctcgggtgcaagcctctgactatgttccttattgctgagaacaaaatctggggaagaaagtcgtggccactgaatgaaggtataatggccgtgggcatcgtttcaattttgctctctgccctgctcaagaatgacgtgcccctggctgggcctcttatcgcaggaggcatgctcattgcctgttacgtcatcagtggttccagcgcggatctgtctttggagaaggctgccgaggtgagctgggaagaggaagcagagcattccggggcctcacacaacatattagtagaagtgcaggacgatggaacaatgaaaattaaggacgaggagagggatgacaccctgactatcctcctgaaggctacacttctggcagtcagtggcgtttatcccttgagcatcccagccaccctattcgtgtggtacttttggcagaaaaagaaacaacgatctggcgtgctgtgggatacgccttcacccccagaagtcgagcgcgcggtgctcgacgacgggatttatcggataatgcagagaggactgcttggtaggagccaggttggcgtaggggtgttccaggaaaatgtctttcatactatgtggcacgtgacccgtggagctgttttaatgcaccaaggcaagcgcctggagccgagttgggccagcgtgaaaaaggatctcatctcctacggtgggggatggcggttgcagggctcttggaacacaggcgaggaagtccaggtgattgcagtagagcctgggaagaatcccaaaaacgtccagaccgccccaggaacattcaagacttcggaaggtgaggtgggcgctatcgccctggactttaaacccgggaccagcggatcacctattgttaatagagaaggcaagatcgtgggtctctacgggaacggagtcgtgacgacatccggcacttatgttagtgcaatagctcaagccaaagcgtctcaggagggcccactgcccgagatcgaagatgaggtgttcaggaagcgaaatcttaccattatggacctgcatcctgggagcggaaagacacggcgctacttgccggccatcgtcagagaagcaattaaaaggaagctacggaccctgatcctcgctccaactcgagtggtagcctccgagatggctgaagcattaaaaggtatgcccataagatatcagaccacagccgtgaagtcagagcacacgggcaaagagattgttgatctgatgtgccatgccacttttaccatgcgccttctgtctcctgtcagggtgccaaactacaatatgatcatcatggacgaagctcacttcacagatcccagcagtattgcggcacgtgggtatatctccacccgggtgggaatgggcgaggccgctgccatatttatgactgcaacacctccgggtagcgtcgaagccttcccccaatctaacgctgtaattcaggacgaggaaagagatatcccagagaggtcatggaactccgggtacgagtggattaccgactttcctggaaagacggtgtggttcgttcccagtatcaagagcggcaacgatatagcgaattgtctccgcaaaaacggcaagcgagtgattcagttgtcgagaaaaactttcgacacagaatatcagaagaccaaaaataacgactgggattacgtcgtgaccactgacatctctgagatgggggccaactttcgggcagatagggttatcgacccacgccgttgcctgaagcctgtgattctcaaggatggacccgaaagagtcatcctggctggtccaatgccggtgacagtagcctccgcagcccaacggaggggccgcattgggcgaaatcataacaaagagggagaccagtacatatatatgggccagcctcttaataacgatgaggaccacgctcactggaccgaagccaagatgctactggataatatcaacacacccgagggtattatcccagcgttgttcgaacccgagagagagaaatccgcagccatcgacggggagtaccggttaaggggcgaggctcgcaagacttttgtggaactgatgagaaggggagatctccctgtttggctgtcatataaagtcgccagtgagggcttccagtactctgaccggcgttggtgctttgatggggaacgcaataaccaagtgcttgaggaaaatatggacgtggagatttggacgaaggagggagaacgaaagaaactgagaccaaggtggctcgacgctcggacctattccgatcccttggcactgcgcgagttcaaagaatttgccgctggtagaaggagcgtctcaggcgacctaatactggagatcgggaaactccctcagcatcttacacagcgggcccagaacgcactggataatttagttatgttgcacaacagtgaacaaggaggccgagcgtacagacatgccatggaggagctgccggacactattgaaaccctcatgctgcttgctctgatcgccgtgctcacaggtggggtaaccttgttctttctgagcggccgcggattaggcaagacttccattgggctactgtgtgtgatggcatctagcgtcctcctttggatggcttccgtggagccacactggatcgccgcatcaataatcctggagttctttttgatggttctgctcattcccgagcctgataggcagcggacgccccaggacaatcagctggcctatgtggtcatcggacttctcttcatgattctgaccgtagctgcgaacgagatgggtttgctggaaacaactaaaaaggatttaggcatcgggcacgtggccgttgagaatcatcaccatgcagctatgctagacgtggatctgcacccagcctctgcctggaccctctacgcagtcgctacaaccataattactcctatgatgcgtcatacaatcgaaaacacgaccgccaacattagtcttactgcgatcgctaatcaagccgcaatactgatgggattggacaaaggctggcccatctcgaagatggatattggtgtgccactgctcgccctggggtgctacagccaggtcaaccctcttacattaaccgctgcagtgctgatgctcgttgcccactatgcgatcattggcccgggattgcaggctaaggccaccagagaggcacagaaaaggacagccgctggcatcatgaagaatcccactgtggacgggatagtagccattgatctggacccagtggtctacgacgcaaaatttgaaaagcagctaggacagatcatgctgctcatcctttgtacgtcccagattctgttgatgcgcaccacatgggctctgtgcgagtctatcactctcgccaccggccctctgacaaccttatgggagggttcacccgggaaattctggaacactacgatagcggttagcatggccaatattttccggggatcctatcttgcaggcgctggtctggcctttagtctcatgaagtctctaggcgggggacgaagaggcacaggggcacaaggagaaaccctgggcgagaagtggaaaaggcagttgaaccagctgagcaagtcagagttcaatacttacaaacgctccggtatcatggaggtggatcggagtgaagctaaggaggggctcaaaagaggagagaccacaaagcacgccgtcagccgtggcactgccaaacttaggtggtttgtggaacggaacctggtaaaaccagagggtaaggtgattgacttgggctgtgggcgcggaggctggtcttattactgcgcggggctgaaaaaggttaccgaagtgaaaggatatacaaagggcggtcctgggcatgaggaacccatcccgatggctacgtacggatggaatctcgtcaaattacactccggcaaggatgtgttctttataccacctgagaagtgtgacaccctgctttgcgatatcggcgagtcaagccccaacccaactattgaagaggggcgaacactgagagtcctaaaaatggtggaaccctggctcaggggaaatcagttctgtatcaagattctgaacccttacatgccgtcggttgtagagaccttggagcaaatgcagcggaaacatggtggcatgctggtgcgcaatcccctctctagaaacagtactcacgaaatgtattgggtctcctgcgggacaggaaatatcgtgagcgcagttaacatgacctcaaggatgcttctgaatcgatttacgatggcccaccggaagccaacctacgagcgtgacgtggatttaggcgctggtacaagacatgtcgccgtggaacctgaggtagcaaacctggacattatcgggcagcgcatagaaaacattaaacacgagcataagtccacttggcactatgatgaggacaatccctacaagacctgggcctatcatggatcttacgaagtgaaacctagcggcagtgcttccagcatggttaacggcgtcgtgaagttgctcacaaaaccatgggatgtgatccccatggtcactcagatcgcgatgaccgacacaacccctttcgggcaacagagggtttttaaggagaaagtggacactcggacgccaaaggccaagagaggaacagcacagattatggaagtaaccgctaaatggctgtggggtttcctatctcgcaataagaaacccaggatatgtactcgagaggaatttacccggaaggtgagatcaaacgccgcaatcggcgccgtcttcgtggatgagaatcaatggaacagtgctaaagaggccgttgaagacgagaggttttgggatcttgtgcaccgcgaacgtgagctgcacaagcaggggaagtgcgcgacatgcgtctataatatgatgggaaaacgggaaaagaaactcggcgagttcggtaaggcaaaagggtccagagccatttggtacatgtggctgggagctaggttcttggagtttgaagccctgggcttcatgaacgaggaccattggtttagccgcgaaaattctctctcgggcgtggagggggagggacttcacaagctgggttacatcttacgagatatttcaaaaatcccgggcgggaacatgtatgcagacgatacggctggatgggacacccggataactgaagatgacctgcagaatgaggccaagatcacagatattatggaacctgagcatgctttgctcgccaagagcatcttcaaactgacctaccagaacaaggtagttagagtgcaaaggccagccaaaaatggcactgtcatggacgtgatttcccgcagagatcagcggggtagtggacaggtgggaacatatggcctaaacacctttacaaatatggaagcgcagcttatcaggcaaatggagtctgagggcatattcagcccctccgaactggagactcctaacctcgccgggcgtgtcctggactggttggaaaagcacggagttgagcgattaaaacgcatggctatttcaggtgacgattgtgtggtaaagccaatcgacgatagatttgccgcagctctgaccgccctcaacgacatgggcaaggtgcggaaagatatcccccagtgggaaccgagtaaggggtggaatgactggcagcaggtccctttctgctctcaccattttcaccaacttattatgaaagatggaagggagatagtggttccctgtcgcaaccaggacgagctggtgggcagagcacgggtcagccagggtgccgggtggtccctaagggaaacggcgtgcctgggaaagtcatacgctcagatgtggcaactcatgtatttccatcgacgtgatttgagactggccgcaaatgccatctgtagcgctgtgccagtagactgggttcctacctctcgcacaacttggtccattcacgcccatcaccagtggatgaccacagaggatatgcttagtgtgtggaaccgggtctggatcgaagagaatccctggatggaagacaaaactcacattagctcgtggggcgacgtgccatacctgggcaagagggaggatcagtggtgcgggtccctcatcggattaaccgcaagagctacgtgggccacaaacatacaagttgcgatcaatcaggtgcgccggctgattggtaacgagaattatttggactacatgacctctatgaagaggtttaaaaacgaatcagatcccgagggcgctctgtggtga

SEQ ID NO: 13891 - RNA, 9879 nt, synthetic construct
  misc_feature 1..9879: note = derived and/or modified CDS sequence (opt3) from DENV-1__GU131718__SS-prME
  source 1..9879: mol_type = other RNA
agcgtgaccatgctgctcatgcttatgcccacagccctggctttccacttgactacgagaggaggggagcctcatatgatcgtcaccaagcaggaaaggggaaaatccttactgtttaagacatctgccggtgttaatatgtgcactttaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaattgaacacggcacgacagccaccatcactccccaggcgcctaccagtgagatccagctgacagactacggggccctcacccttgattgtagcccaaggactggactggacttcaacgaaatggtgttgctaacaatgaaggagaaatcttggctggtccataagcagtggtttctcgatctgccgcttccctggacgtccggcgcatcaaccagccaagagacttggaatcggcaggacctgttggtgacattcaaaaccgctcacgccaagaagcaggaagtagttgtgctcggtagtcaagagggggctatgcacacagccctgactggcgcaaccgaaattcagacgtctggaaccacaactatatttgccggccatttaaaatgccgtctgaagatggataaactaaccctcaaggggatgtcctatgtcatgtgtacaggtagcttcaaactggagaaggaagtggctgagactcagcacggaaccgtccttgtgcagatcaagtacgagggcacggacgcgccttgcaaaattccattctcgacacaagatgaaaagggggttacccagaacggacgcttgatcactgcaaatcccatagtgattgacaaagagaagcctgtaaacatcgaagccgagccaccctttggcgagtcttatatcgtcattggtgctggggaaaaagccctgaagctctcctggttcaagaaaggctcaagtatcggaaagatgtttgaggcaacagccagaggcgctaggcggatggccattctgggggataccgcatgggacttcggaagcataggtggcgtgtttacttccatcgggaaacttgttcatcagattttcggaaccgcgtacggcgtgctgttttctggtgtcagctggacaatgaagatcgggatcggcgtgttgctcacgtggctgggattaaattcacgaagtacctccctgagcatgacttgtattgctgtaggcctagtgacactctacctgggggttatggtccaggccgattctggatgcgtgataaactggaaaggccgcgaacttaagtgtggttcagggatcttcgtgaccaatgaggtccacacatggactgaacaatataagtttcaggcagacagtccgaaaagattgagcgccgctattggaaaggcctgggaggagggcgtttgcggtatcaggtccgcaacccggctggaaaacattatgtggaaacagatctctaacgagctcaatcatatactgttagaaaacgacatgaagttcacggtggtggtaggcgatgtcgtggggatcctggctcagggcaagaagatgattcgccctcaacccatggagcacaaatactcgtggaaaagctggggcaaggccaaaatcattggggcggacgttcagaatacaacctttatcatagatggaccaaacactcctgaatgtcccgacgatcagagagcctggaatatttgggaggtggaggactatggcttcggtatctttaccacaaacatttggcttaagatgagggattcctacactcaggtctgcgaccaccgtttgatgtcagctgcaatcaaagatagtaaggccgtgcatgctgacatggggtattggatagaatctgagaaaaatgaaacctggaagctcgcccgggcatccttcatcgaggttaagacatgtatttggccaaaatcccacacgctgtggtcaaacggagtgctagaaagcgagatgatcattcccaagatctacggcggtcctatatctcaacataattatcgaccaggctacttcacccagactgcggggccgtggcacctgggaaaactcgagctggattttgacctttgcgaaggcacaaccgtagtcgtggatgagcactgcgggaacagaggaccctccttgaggactacaaccgtgacgggcaagattatccatgaatggtgttgccgcagttgtactctgcctccattacggttcaaaggtgaggacgggtgctggtacggaatggagatcagacccgtcaaggaaaaggaggaaaatctcgttaaaagcatggtgtctgccggctccggtgaggtagactcatttagtctgggccttctgtgtattagcatcatgattgaagaggtgatgaggtcgcgctggtcccgaaagatgttgatgaccgggacactcgctgtcttcctgctactgataatgggacagctcacctggaacgatctgatccggctttgcattatggtgggcgccaatgcatctgaccgtatggggatgggaactacatatttggctctgatggccacctttaaaatgagacctatgttcgcagttggcttactctttaggcgcctgacaagccgggaggtgcttctgctaactatcggtctctcactggtcgccagtgtggaattgccaaactccctggaggaattaggggatggactcgctatgggcattatgatcctgaaacttctgaccgacttccaatctcaccagttgtgggcgacgctcctgagcctaacatttataaaaaccactctgtcccttcattacgcctggaagaccatggcaatggttctctcaatcgtgagcctgattcccttgtgtctgagtacaacttctcagaagaccacgtggttaccggtcctcctgggctcccttgggtgcaaacctctgacaatgttcttgatcgctgagaataagatttggggaagaaaaagctggccactcaacgaaggtatcatggccgtaggcgtggtttcgatactgctatcatctctgcttaagaacgatgtgcccctcgccgggcctctgattgctggaggcatgttgatcgcatgttatgtcatcagtggttccagcgccgacttatctctggagaaagcggctgaggtgagctgggaagaggaagccgagcactccggggcatcacataatattctcgtagaagtgcaggatgacggaaccatgaagataaaagatgaggagagggacgatactctgacaatccttctgaaggccaccttgctagctgtcagtggcgtttaccccctgagcattccagcaactctctttgtgtggtatttctggcaaaagaaaaagcagcgatctggcgtgctgtgggacacaccttcacccccagaagtcgagcgcgccgtgcttgatgacgggatctaccggattatgcagagaggattactgggtaggagccaggttggcgtaggggtgtttcaagaaaacgtcttccacaccatgtggcacgtgacgcgtggagcggttctcatgtatcagggcaaacgcttggagccgagttgggctagcgtgaagaaagacctgatctcctacggtgggggatggcggctccagggctcttggaatactggcgaggaagtccaggtgatagccgtagagcctgggaagaaccccaagaatgtccaaaccgcaccaggaacattcaaaacccccgaaggtgaggtgggcgccatcgctctggattttaagcctgggacatcgggaagcccaattgttaacagagaaggcaaaatcgtgggtctttacgggaatggagtcgtgactacctcaggcacgtatgtttccgccattgcacaggctaaggccagtcaggagggccccctgcctgagatcgaagacgaggtgttcaggaaacgaaacttgacaataatggatctacatccggggtctggaaagactcggcgctacctgccagcgattgtcagagaagccatcaagaggaaactccggaccttaatcctggcacccacacgagtggtagctagcgagatggccgaagctcttaagggtatgcctattagatatcaaaccactgcagtgaaatccgagcacaccggcaaggagatcgttgacctgatgtgccatgccacatttacgatgcgcctcttgtcaccagtcagggtgcccaattacaacatgataattatggatgaagcccacttcactgacccttctagcatcgctgcgcgtgggtatattagtacccgggtgggaatgggcgaggcagccgctatctttatgacagccaccccgcccggttccgtcgaagcattcccacagagcaatgccgtaatacaggatgaggaaagagacattcctgagaggtcttggaactcagggtacgagtggatcactgattttcccggaaaaacagtgtggttcgttccatccatcaagagtggcaatgacattgctaactgtctgcgcaagaatggcaaacgagtgatccagctcagcagaaagacctttgatacggaatatcagaagactaagaacaacgactgggactacgtcgtgacaaccgatatttcggagatgggggcgaatttccgggccgacagggttatagatcctcgccgttgcctgaaacccgtgatccttaaggacggaccagaaagagtcattctagcaggtccgatgcctgtgaccgtagcttctgccgcacagcggaggggccgcatcgggcgaaaccataataaggagggagatcagtacatctatatgggccagcccctgaacaatgacgaggatcacgcccactggactgaagctaaaatgttgttagacaacattaatacaccagagggtataatccccgccctgtttgaacctgagagagaaaagtccgcggcaattgatggggagtaccggctcaggggcgaggcccgcaaaaccttcgtggaactgatgagaaggggagaccttccagtttggctgagctataaggtcgcttcagagggcttccaatacagtgatcggcgttggtgctttgacggggaacgcaacaatcaggtgctcgaggaaaacatggatgtggagatctggacaaaagagggagaacgaaagaaattgagacccaggtggctggacgcccggacttattctgaccctctagctctgcgcgagttcaaggaatttgcagccggtagaaggtccgtcagcggcgatctcattcttgagatcgggaagctgccgcagcatttaacgcagcgggctcaaaatgccttggacaacctggttatgctccacaattcagaacagggaggccgagcatacagacatgcgatggaggagctgccagataccatagaaacacttatgctgctcgccttgatcgctgtgctgactggtggggtaaccttattctttctaagtggccgcggactgggcaaaacaagcattgggctcctttgtgtgatggcctcctctgtcctgttgtggatggcaagcgtggagccccactggatcgctgcctccattatcctggagttctttctcatggttctgcttatacctgagcccgacaggcagcggaccccacaggataaccaactcgcatatgtggtcattggactgttgttcatgatcctgactgtagccgctaatgagatgggtttactagaaacgaccaagaaagacctgggcattgggcacgtggcggttgagaaccatcaccatgccacaatgctcgatgtggaccttcaccctgcatcagcttggactctgtacgccgtcgccaccacaatcataacccccatgatgcgtcatactatcgaaaacacaacggcaaatatttctttgaccgctatcgccaaccaggcggctattctgatgggactcgataagggctggccaatcagtaaaatggacataggtgtgcctctgcttgccttagggtgctactcgcaggtcaatccgctgactctcacagcagccgtgttgatgctggttgctcactatgcaattatcggccccggactacaagccaaggcgaccagagaggctcagaagaggaccgccgcaggcatcatgaaaaacccaacagtggatgggattgtagccatcgacctggatcctgtggtctacgacgctaagtttgaaaaacagctcggacagataatgcttctgattttgtgtactagccaaatcctgctcatgcgcacgacctgggccctgtgcgagtccattacattagcaactggcccccttaccacactgtgggagggttctccagggaagttctggaataccactatcgctgtttcaatggccaacatatttcggggaagctatctcgcgggcgccggtctagcattctccctgatgaaaagtttgggcgggggacgaagaggcacgggggctcagggagaaacactgggcgagaagtggaagaggcagctcaatcagctttctaaaagcgaatttaacatctacaagcgctcaggtattatggaggtggaccggtccgaagccaaagaggggctgaagagaggagagaccactcgtcacgcagtcagtaggggcaccgctaaattgcggtggttcgtggaacgcaatctggtaaagcctgagggtaaggtgatcgatctcggctgtgggcgaggaggctggagctattactgcgccgggctaaagaaggttacagaagtgaaaggatatactaagggcggtcccgggcatgaggaaccgattccaatggccacctacggatggaacctggtcaaacttcactctggcaaggacgtgttctttacacctcccgagaaatgtgatacgctgctatgcgacatcggcgagtcctcaccaaatcccaccattgaagaggggagaactctcagggtcctgaagatggtggaaccttggttgcggggaaaccaattctgtatcaagatactgaatccgtacatgcccagcgttgtagagacactcgagcagatgcagcgcaaacatggtggcatgcttgtgagaaacccactgtcgagaaattctacccacgaaatgtattgggtcagttgcgggactggaaacattgtgtccgcggttaatatgacaagccgaatgttactgaaccggtttaccatggctcaccgtaagcctacgtacgagaaagatgtggacttgggcgcaggtaccagacatgtcgccgtggaacccgaggtagctaacctcgatatcatcgggcagcgcattgaaaatataaagcacgagcataaatcaacatggcactatgacgaggataacccttacaagacttgggcctatcatggatcctacgaagtgaagccatctggcagcgcaagttccatggttaatggcgtcgtgaaactgctaaccaagccctgggacgtgatccctatggtcacacaaattgccatgactgataccacaccattcgggcagcagagggtttttaaagagaaggtggacacccggactcccaaagctaagagaggaacggtacaaatcatggaagtgacagcgcgctggctttggggtttcctgagcaggaacaagaaaccgcgaatttgtacccgggaggaatttactagaaaggtcaggtctaatgccgcaatcggcgctgtgttcgttgacgagaaccagtggaactcagccaaagaggcagtggaagatgagcgcttttgggacctcgtcaagaaagaacgtgagctgcacaagcaggggaagtgcgcaacctgcgtgtataacatgatgggaaaacgggaaaagaaattgggcgagttcggtaaggctaaagggagtagagccatatggtacatgtggctgggagcgaggtttctcgagttcgaagcacttggctttatgaatgaggatcactggttctcccgcgaaaacagcctgtctggcgtagagggggagggattacataagctgggttacatcttgcgagacatttcgaaaatccctggcgggaatatgtatgccgatgacacagctggatgggatacgcggattaccgaagacgatctccagaacgaggccaagatcactgacataatggaaccagagcacgcactgctagctacatcaattttcaaacttacctaccaaaataaagttgtgagagtccagaggcccgccaagaacggcactgtgatggatgtgatcagccgcagagaccagcggggttccgggcaggtcggaacatatggcctgaatacctttacaaacatggaagctcaactcatcaggcagatggagagtgagggcattttcctgccttctgaattggagactccaaacttagccgaacgtgttctggattggctcgagaaatacggggtggaacgacttaagcgcatggcaataagcggagacgactgtgtagtgaaacccatcgatgacagatttgcgaccgccctgacggctctaaatgatatgggtaaggtccggaaggacattccgcagtgggagccttccaaaggctggaacgattggcagcaagtgcccttctgctcacatcactttcaccagctgatcatgaaggacgggagggagattgttgtgccatgtcgcaatcaggatgaactcgtcggaagggcccgggtgagtcagggcgcaggttggtctttgagggagaccgcttgcctggggaaaagctatgcccaaatgtggcagcttatgtacttccatcgacgtgacctgagactcgcagccaacgcgatctgttccgctgtacctgttgattgggtgcccacatcacgcactacctggagcatacacgcccatcaccagtggatgacaactgaagacatgttatctgtctggaatcgggtgtggatcgaggaaaacccatggatggaggataagacccatgtttccagttggggagacgtgccctatctgggcaaaagggaggaccaatggtgcggcagcttgattgggctgacggcaagagccacatgggcttcgaatatccaggtcgccattaaccaggtgcgccggctcatcggaaatgaaaactaccttgattacatgacctccatgaagaggtttaagaatgagggtgaccctgaaggcgcactgtggtga

SEQ ID NO: 13892 - RNA, 9879 nt, synthetic construct
  misc_feature 1..9879: note = derived and/or modified CDS sequence (opt3) from DENV-1__GU131720__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactttaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaagaagatgattcgccctcaacccatggagcacaaatactcgtggaaaagctggggcaaggccaaaatcataggggcggacgtccagaatactacctttatcattgatggaccaaacacacctgaatgtcccgacgatcagagagcctggaatatctgggaggtggaggactatggcttcggtatttttgctactaacatctggcttaagttgagggattcctacacccaggtttgcgaccaccgtctcatgtcagcagccataaaagatagtaaggctgtgcatgccgacatggggtattggattgaatctgagaaaaatgaaacatggaagctggcacgggcgagcttcatcgaggtaaagacgtgtatttggccaaaatcccacaccctatggtcaaacggagtcctggaaagcgagatgatcatacccaagatctacggcggtcctatttctcaacataattatcgaccaggctacttcactcagacagccgggccgtggcacctcggaaaactggagcttgattttgacttgtgcgaaggcaccactgtggtggtcgatgagcactgcgggaacagaggaccctccctgaggacaaccacggttactggcaagatcattcatgaatggtgttgccgcagttgtaccttacctccactccggttcaaaggtgaggacgggtgctggtacggaatggagatcagacccgtgaaggaaaaggaggaaaatctggtaaaaagcatggtgtctgctggctccggtgaggtcgactcatttagtcttggcctgttgtgtataagcattatgatcgaagaggtgatgaggtcgcgctggtcccgaaagatgctcatgacagggaccctggccgttttcctactgctcatcatgggacagctgacttggaacgatcttattcggttgtgcatcatggtgggcgcaaatgcttctgaccgtatggggatgggaacaacctatctggccttaatggcaacatttaaaatgagacctatgttcgccgtcggcctcctgtttaggcgccttactagccgggaggtgctgctactcaccattggtctgtcattggttgctagtgtggaactgccaaactccttagaggaactcggggatggactggcgatgggcataatgatccttaagctgttgacggacttccaatctcaccagctctgggccacactgctaagcctgacctttattaaaactaccctttccctccattacgcatggaagacaatggctatggtcctgtcaatcgtatccttgttccccctgtgtttaagtactacctctcagaagacgacatggctcccggtgctgcttggctcctttgggtgcaaacctctgaccatgttcttgattactgagaataagatctggggaagaaaaagctggccactcaacgaaggtataatggccgttggcgtggtctcgatcctgctatcatctctgcttaagaacgatgtgcccctcgccgggcctctgattgctggaggcatgttgatcgcatgttatgtaattagtggttccagcgccgacttatctctggagaaagcggctgaggtgagctgggaagaggaagccgagcactccggggcatcacataatatcctcgtcgaagttcaggatgacggaacaatgaagataaaagatgaggagagggacgataccctgactattcttctgaaggccacattgctagctgtgagtggcgtgtaccccctgagcatcccagcaaccctctttgtctggtatttctggcaaaagaaaaagcagcgatctggcgtgctgtgggacacgccttcacccccagaagttgagcgcgccgtacttgatgacgggatctaccggattatgcagagaggattactgggtaggagccaggtgggcgtcggggtgttccaagaaaacgtttttcacactatgtggcacgtgacccgtggagcggtcctcatgtatcagggcaaacgcttggagccgagttgggctagcgtgaagaaagacctgatatcctacggtgggggatggcggctccagggctcttggaatacaggcgaggaagtacaggtcatcgccgtggagcctgggaagaaccccaagaatgttcaaaccgcaccaggaacattcaaaactcccgaaggtgaggtgggcgccattgctctggattttaagcctgggacctcgggaagcccaatcgtcaacagagaaggcaaaattgtgggtctttacgggaatggagttgtgacgacatcaggcacttatgtctccgccatcgcacaggctaaggccagtcaggagggccccctgcctgagatagaagacgaggtgttcaggaaacgaaacttgaccatcatggatctacatccggggtctggaaagacacggcgctacctgccagcgattgtaagagaagccatcaagaggaaactccggaccttaattctggcacccactcgagtggttgctagcgagatggccgaagctcttaagggtatgcctatcagatatcaaaccacagcagtcaaatccgagcacacgggcaaggagatagtggacctgatgtgccatgccacttttaccatgcgcctcttgtcaccagtgagggtccccaattacaacatgattatcatggatgaagcccacttcacagacccttctagcatcgctgcgcgtgggtatattagtacccgggtaggaatgggcgaggcagccgctatctttatgactgccacaccgcccggttccgtggaagcattcccacagagcaatgccgttatacaggatgaggaaagagacattcctgagaggtcttggaactcagggtacgagtggatcaccgattttcccggaaaaacggtgtggttcgtcccatccattaagagtggcaatgacatcgctaactgtctgcgcaagaatggcaaacgagtgatacagctcagcagaaagacttttgatacagaatatcagaaaaccaagaacaacgactgggactacgttgtgaccactgatatttcggagatgggggcgaatttccgggccgacagggtcatcgatcctcgccgttgcctgaaacccgtgatccttaaggacggaccagaaagagtaattctagcaggtccgatgcctgtgacagttgcttctgccgcacagcggaggggccgcatcgggcgaaaccataataaggagggagatcagtacatttatatgggccagcccctgaacaatgacgaggatcacgcccactggaccgaagctaaaatgttgttagacaacataaatacaccagagggtatcattcccgccctgttcgaacctgagagagaaaagtccgcggcaatcgatggggagtaccggctcaggggcgaggcccgcaaaacttttgtcgaactgatgagaaggggagaccttccagtgtggctgagctataaggtggcttcagagggcttccaatacagtgatcggcgttggtgctttgacggggaacgcaacaatcaggtcctcgaggaaaacatggatgttgagatctggacgaaagagggagaacgaaagaaattgagacccaggtggctggacgcccggacctattctgaccctctagctctgcgcgagttcaaggaatttgcagccggtagaaggtccgtgagcggcgatctcattcttgagatagggaagctgccgcagcatttaacacagcgggctcaaaatgccttggacaacctggtaatgctccacaattcagaacagggaggccgagcatacagacatgcgatggaggagctgccagatactatcgaaacccttatgctgctcgccttgattgctgtgctgacaggtggggtcaccttattctttctaagtggccgcggactgggcaaaactagcatcgggctcctttgtgtgatggcctcctctgttctgttgtggatggcaagcgtggagccccactggattgctgcctccatcatactggagttctttctcatggtcctgcttatccctgagcccgacaggcagcggacgccacaggataaccaactcgcatatgtagtgattggactgttgttcatgatcctgaccgttgccgctaatgagatgggtttactagaaacaactaagaaagacctgggcattgggcacgtggcggtcgagaaccatcaccatgccaccatgctcgatgtggaccttcaccctgcatcagcttggacactgtacgccgtcgccaccactatcataacacccatgatgcgtcatacgattgaaaacaccactgcaaatatctctttgacagctattgccaaccaggcggctatcctgatgggactcgataagggctggccaataagtaaaatggacatcggtgtgcctctgcttgccttagggtgctactcgcaggttaatccgctgaccctcaccgcagccgtgttgatgctggtagctcactatgcaattatcggccccggactacaagccaaggcgacaagagaggctcagaagaggactgccgcaggcattatgaaaaacccaacggtggatgggatcgtcgccatagacctggatcctgttgtgtacgacgctaagtttgaaaaacagctcggacagattatgcttctgatcttgtgtaccagccaaatcctgctcatgcgcacaacttgggccctgtgcgagtccattaccttagcaacaggcccccttaccactctgtgggagggttctccagggaagttctggaatacgacaatcgctgtctcaatggccaacatatttcggggaagctatctcgcgggcgccggtctagcattctccctgatgaaaagtttgggcgggggacgaagaggcaccggggctcagggagaaactctgggcgagaagtggaagaggcagctcaatcagctttctaaaagcgagttcaacatttacaagcgctcaggtatcatggaggtggaccggtccgaagccaaagaggggctgaagagaggagagaccacacgtcacgcagtaagtaggggcactgctaaattgcggtggtttgtggaacgcaatctggttaagcctgagggtaaggtgattgatctcggctgtgggcgaggaggctggagctattactgcgccgggctaaagaaggtcaccgaagtgaaaggatatacaaagggcggtcccgggcatgaggaaccgatcccaatggccacgtacggatggaacctggtcaaacttcactctggcaaggacgtgttctttacccctcccgagaaatgtgatactctgctatgcgacataggcgagtcctcaccaaatcccacaatcgaagaggggagaaccctcagggttctgaagatggtagaaccttggttgcggggaaaccaattctgtattaagatcctgaatccgtacatgcccagcgtggtcgagactctcgagcagatgcagcgcaaacatggtggcatgcttgtgagaaacccactgtcgagaaattctacacacgaaatgtattgggttagttgcgggaccggaaacattgtgtccgcggtcaatatgacgagccgaatgttactgaaccggtttaccatggctcaccgtaagcctacatacgagagagatgtggacttgggcgcaggtactcgccatgtagccgtggaacccgaggttgctaacctcgatatcattgggcagaggatcgaaaatataaaacacgagcataagtcaacctggcactatgacgaggataacccttacaaaacatgggcctatcatggatcctacgaagtcaagccatctggcagcgcaagttccatggtgaatggcgtggtcaagctgctaactaaaccctgggacgttattcctatggtgacccaaatcgccatgacagataccactccattcgggcagcagcgggtatttaaggagaaagtggacacgagaacacccaaggctaaacgcggaaccgcgcaaatcatggaagtcactgccaggtggctttggggtttcctgagccgaaacaagaagccgcggatttgtaccagagaggaatttacaaggaaagtgcgctctaatgcagctataggcgccgttttcgtggacgagaaccagtggaactcagcaaaggaggccgtcgaagatgagcgtttttgggacctcgtgcagaaagaacgggagctgcacaagcaggggaaatgcgctacgtgcgtatataacatgatgggaaagagagaaaagaaattgggcgagttcggtaaggccaaagggagtagggcgatctggtacatgtggctgggagcacgctttctcgagttcgaagcccttggcttcatgaatgaggatcactggttttcccgagaaaacagcctgtctggcgttgagggggagggattacataagctgggttacattttgcgggacatctcgaaaattcctggcgggaatatgtatgctgatgacaccgccggatgggatactagaatcacagaagacgatctccaaaacgaggcaaagataaccgacatcatgaaaccagaacacgctctgctagccacttcaattttcaaacttacataccagaataaggtggtcagggtgcagcgccccgctaaaaacggcaccgtgatggatgtcatcagcagacgggaccagaggggttccgggcaagttggaacatatggcctgaatacttttaccaacatggaggcccagctcattcgtcagatggaaagtgagggcatcttcctgccttctgagttggaaacgccaaacttagcagagcgagtgctggattggctcgaaaagtacggggtagagcgccttaaaagaatggcgataagcggagacgactgtgtggtcaagcccattgatgaccggtttgccaccgctctgacagccctaaatgatatgggtaaagtgaggaaggacatcccgcagtgggaaccttccaagggctggaacgattggcaacaggttcccttctgctcacatcactttcaccagctgatcatgaaagacgggcgcgagattgtggtcccatgtagaaatcaggatgagctcgtgggacgggcaagggtaagtcaaggcgctggttggtctttgcgagaaactgcctgcctgggaaagagctatgcacagatgtggcagcttatgtacttccatcgtagagacctgcgcctcgccgcgaacgctatatgttccgccgttcctatcgattgggtgcccacctcacggacaacttggagcattcacgcacatcaccaatggatgaccacggaggacatgttatctgtctggaatagggtgtggatcgaagagaacccatggatggaagataaaacacatgtttccagttggggagacgtgccctatctgggcaagagagaggaccagtggtgcggcagcttgattgggctgaccgcccgcgctacttgggcctcgaatatccaggtcgcaataaaccaggtgcggaggctcatcggaaatgagaactaccttgattacatgacatccatgaaacgatttaagaatgaaggtgaccctgagggcgctctgtggtga

SEQ ID NO: 13893 - RNA, 9879 nt, synthetic construct
  misc_feature 1..9879: note = derived and/or modified CDS sequence (opt3) from DENV-1__HM181960__SS-prME
  source 1..9879: mol_type = other RNA
agcgtgaccatgctgctcatgcttatgcccacggccctggctttccacttgactacgcggggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgggagagccgtgctggatgacggaatatataggatcatgcagcgtggtcttttaggccgcagccaggttggggtaggagtgtttcaagagaacgtcttccataccatgtggcacgtgacacggggcgcggttctgatgtaccagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtatggaaatggcgtcgtgacaacttcaggcacctacgtttccgccatcgcacaggctaaggccagtcaggaagggccccttcctgagattgaggacgaagtgtttcggaaacgcaacctgacaatcatggatttgcacccgggatctggtaagaccagaaggtatctaccagcgattgtccgggaggccatcaaacgaaagctgagaactctcatattagcacccacccgcgtggtagctagcgaaatggccgaggctctgaagggcatgcctattaggtaccaaacaacggcagtgaaatccgaacatactgggaaggagatcgttgaccttatgtgccacgccaccttcacaatgcgtctgctctcaccagtccgggtgcccaattataacatgatcattatggatgaggcccattttaccgacccttctagcatcgctgcgagaggatacataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatatgagtggatcacggatttccccggcaaaactgtgtggtttgttccatccataaagagtggcaatgacattgctaactgtttgaggaaaaatgggaagcgggtgatccagctgagcaggaagacattcgataccgagtaccagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtatatctacatgggtcagcccctaaacaatgacgaggatcatgcccactggacagaggctaagatgctgttggacaacattaatactccagaagggatcatccccgccttatttgagcctgaaagggagaagtccgcggcaattgatggcgaatatcgcctgagaggagaggccaggaaaacgttcgtggagctcatgcggcgtggcgacctgccagtttggcttagctacaaggtcgcttcagaagggtttcaatatagtgatcgccgatggtgcttcgacggagagagaaacaatcaggtgctggaagagaacatggatgtggaaatatggaccaaagagggtgagaggaagaaactccggccccgctggttggacgccagaacatactctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatataggcacgcgatggaggaactcccagataccatcgagacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggaaccccattggatagctgcctccatcattttggagtttttcctgatggttctcctgatccctgaacccgaccgtcagagaaccccacaggataaccaacttgcatacgtggtcattggtctcctgtttatgatcttgacagtagccgctaatgagatgggcctgttagagactaccaagaaagacctagggataggacacgtggcggttgaaaaccaccatcacgccgcaatgctggatgtggacctccatcctgcttcagcctggacactttacgccgtcgcaaccactattatcacacccatgatgaggcacacgattgagaacaccactgctaatatctctctgacagccatagcgaaccaggctgccatcttgatgggcctggataagggttggccaattagtaaaatggacatcggggtgcctctcctggcacttggctgctattcgcaggtcaatccgttaaccctgaccgccgctgtgctcatgttggttgcacattacgccattatcggacccggcctgcaagcgaaggctacacgcgaagcccagaaacggactgcagccgggataatgaagaacccaacggtggatggaattgtagctatcgacctagatcctgtggtctatgacgccaagttcgagaaacagctgggccagatcatgctccttattctgtgtaccagccaaatcttgctgatgcgaacaacttgggcactctgcgaatccataaccctggctacaggtcccttaaccactctttgggaggggtctccaggaaagttttggaatacgacaattgccgtttcaatggcgaacatcttcagaggcagctacctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctataagagatcagggattatggaagtggaccgttccgaggcaaaagaaggacttaagaggggcgagacaactaaacacgctgtcagtcggggtaccgccaagctgcgctggttcgtggagcgaaatttggtaaaacctgaaggcagagtgatcgatctggggtgtggaaggggcgggtggagctactattgcgccggactcaagaaggttacagaggtgaaaggctacacgaagggtgggcccggacacgaggagccgataccaatggcgacctacggctggaacttagtcaaactgcattctggcaaggacgtgtttttcatccctcccgaaaaatgtgatactcttctgtgcgacattggggagtcctcaccaaatcccacaatcgaggaaggacggaccctacgcgtcctcaagatggtggagccttggctgagaggtaaccaattttgtattaaaatcttgaatccgtatatgcccagcgttgtagaaactctggagcagatgcagaggaagcacggcgggatgctcgtgcgaaacccactttcgagaaattctacacatgagatgtactgggtcagttgcggaaccggcaacattgtgtccgctgttaatatgacgagccgtatgctgttaaacagattcaccatggcacaccgcaagcctacatatgaaagggatgtggacctgggtgccgggactcggcacgtcgctgtggagcccgaagtagccaacttggatatcataggacagagaattgagaatatcaaacatgaacacaagtcaacctggcattacgacgaggataacccttataaaacatgggcataccacggctcctatgaggtgaagccatctggcagcgccagttccatggttaatggggtcgtgaaactcctgactaagccctgggacgtgatccctatggtcacccaaattgctatgacagataccactccatttggacagcagcgcgttttcaaggaaaaagtggacacgaggacacccaaggcgaaacgaggtaccgcccaaataatggaggtaactgcaaagtggctatggggctttcttagccggaacaaaaagccgagaatctgtaccagggaagagttcacacgcaaggtgcgttctaatgctgccattggggcagtctttgtggacgaaaaccagtggaactcagccaaagaggctgttgaggatgaacggttctgggacctggtgcatagagagagggaactccacaagcagggaaaatgcgccacgtgcgtctacaacatgatgggcaagcgcgagaaaaagctgggtgaatttgggaaggcgaaaggaagtcgagcaatctggtacatgtggttgggcgcccggttcctggagttcgaggctctcggctttatgaatgaagatcactggttctccagagagaacagcctttctggggtggaaggagagggtctgcataagttaggctatattctgagggacatctcgaaaatacctgggggaaatatgtacgccgatgacaccgcaggctgggatactcgcatcacagaggacgatttgcagaacgaagctagaattaccgacatcatggagccagaacacgccctcctggctaagtcaatttttaaactaacttatcaaaataaggtagttcgggtgcagaggcccgccaaaaacggtacagtcatggatgtgatcagccgtcgagaccagcgcgggtccggacaggtgggcacctacggccttaatacattcactaacatggaggcacaactgataagacagatggaaagtgaggggatattttctcctagcgagctcgaaaccccaaacctggcggagcgggtcttggattggttagaaaagtatggagttgagaggctgaagcgcatggccatctccggtgacgactgtgtggtaaaacccatcgatgacagattcgctacggccctcaccgcacttaatgatatgggcaaggtgcggaaagacattccgcagtgggaaccttcaaaggggtggaacgattggcagcaagtccccttttgcagtcatcacttccaccagctgataatgaaagacggaagggagatcgtggttccatgtcgaaatcaggatgagctagtgggccgtgctagagtctctcagggtgccgggtggagcctgcgcgaaacagcatgcctcggaaagtcctacgcccaaatgtggcagttgatgtattttcatcggagggacctgagacttgcggctaacgccatttgttcagcagtgcctgtagattggatccccactagccgcaccacatggtctattcacgcccatcaccagtggatgactaccgaggacatgctgtccgtttggaatcgggtgtggatcgaagagaacccatggatggaagataagacgcatataagtagctggggcgacgtcccctacctcggcaaaagggaggaccaatggtgcgggtcgttaatcggactgacagctcgagccacctgggcaactaatattcaggtggctatcaaccaggttagacggttgattggtaatgagaactacctggattatatgacatccatgaagaggttcaaaaatgaatctgaccctgagggcgccctctggtga

SEQ ID NO: 13894 - RNA, 9879 nt, synthetic construct
  misc_feature 1..9879: note = derived and/or modified CDS sequence (opt3) from DENV-1__HM181963__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaatcggagagcaccgccgagacaagcgtagcgtggccctggcaccccatgtcggccttggtctggagacgagaactgaaacctggatgtcctctgagggggcctggaaacagattcagagggtggaaacatgggctttgcggcaccctggatttactgttatcgcactcttcctggcccatgctattggcacctcgatcacacagaagggcataatctttattctgctcatgttagtgaccccatcaatggccatgcgctgcgtcgggatcggaagcagagatttcgtggagggtctgagtggcgcgacgtgggtagacgttgtgcttgagcacgggtcctgtgtcactacaatggcaaaggataaacccaccttggacattgaactgctaaagactgaggtgacaaaccctgccgtgctcaggaaactgtgcatcgaagctaagatatctaataccacgaccgatagccggtgtccaacacaaggagaggccactcttgtcgaagagcaggacgcaaactttgtttgccgccgaaccttcgtggatagaggctggggtaatgggtgtggactgtttggcaaaggctccttgattacatgcgctaagttcaagtgcgtaactaaactcgaggggaagatcgtgcagtacgaaaacctgaaatattcagtcattgtgaccgttcacacaggagaccagcatcaagtgggtaatgagagtaccgaacacggcactacggccacaatcaccccccaggcgcctagcactgagatccagttaaccgactacggggccctgacactcgattgttctccaaggaccggacttgactttaacgaaatggtcctgttgactatgaaggagaaatcctggctagtgcataagcagtggttcctggatctcccgctgccctggacatcaggcgcaagcacgagtcaagagacctggaatcggcaggaccttctggtaacttttaaaacagctcacgccaagaagcaggaagttgtggtcttgggttctcaagagggggctatgcacaccgccctcacaggcgcaactgaaattcagacctccggaacgaccacaatattcgccggccatctgaaatgccgtttaaagatggataaactgactctaaaggggatgagctatgtgatgtgtaccggatcgttcaaactcgagaaggaagtcgctgagacacagcacggtactgtgctggttcagatcaagtacgagggcaccgacgcgccttgcaaaattccattttctacgcaagatgaaaagggggtgacacagaacggacgccttatcaccgcaaatcccatagtaactgacaaagagaagcctgtcaacattgaagccgagccacccttcggcgagtcctatatcgtgatcggtgttggggaaaaagctttgaagctgtcatggtttaagaaaggcagtagcattggaaagatgttcgaggccacagcaagaggcgccaggcggatggctatcctcggggataccgcctgggactttggatccattggtggcgtgttcacttctgtcgggaaactggtgcatcagatatttggaaccgcatacggcgtacttttcagcggtgtgtcatggacaatgaagatcgggattggcgttctgttgacgtggctcggactgaatagtcgatccaccagcttatctatgacttgtatcgcggtcggcctggtgacactatacctcggggtgatggtccaggctgattcaggatgcgttatcaactggaaaggccgcgaactgaagtgtggtagtgggatttttgtgaccaatgaggtgcacacatggactgaacaatataagttccaggccgacagcccgaaaagactttccgcagccataggaaaggcttgggaggagggcgtatgcggtatcaggtctgccacccggttggaaaacattatgtggaaacagatctcgaacgagctgaatcatattctcctggaaaacgacatgaagttaacggtcgtggttggcgatgtggcagggatcctggctcagggaaaaaagatgatacgccctcaacccatggagtacaaatatagctggaagtcctggggcaaggccaaaatcattggggcggacgtccagaatacaacctttatcattgatggaccaaacactcctgaatgtcccgacgatcagagagcctggaatatctgggaggtggaggactacggcttcggtatatttaccacaaacatttggcttaagttgagggattcatatactcaggtttgcgaccaccgtctcatgagtgctgcaatcaaagattctaaggccgtgcacgctgacatggggtactggattgaaagcgagaaaaatgaaacctggaagctggcccgggcatccttcatcgaggtaaagacatgtatatggccaaaatcacatacgctatggagcaacggagtcctggaatctgagatgatcattcccaagatctatggcggtcctatttcccaacacaattaccgaccaggctacttcacccagactgcggggccgtggcatctcggaaaactggagcttgattttgacttgtgcgaaggcacaaccgtggtggtcgatgagcactgcgggaacagaggacccagtctgaggactacaaccgttacgggcaagatcatacacgaatggtgttgccgcagctgtactttacctccactccggttcaaaggtgaggacgggtgctggtatggaatggagattagacccgtgaaggaaaaggaggaaaatctggtaaaatctatggtgtccgccggctcaggtgaggtcgacagttttagccttggcctgttgtgtatctcgatcatgattgaagaggtgatgaggtcccgctggtctcgaaagatgctcatgaccgggacactggctgttttctttctactgatcatgggacagctcacctggaacgatctgattcggctttgcataatggtgggcgccaatgcaagcgaccgtatggggatgggaactacatacttggctctgatggccaccttcaaaatgagacctatgtttgcagtcggcttactcttcaggcgcctgacatcacgggaggtgcttctgctaactatcggtctcagtctggttgcctccgtggaattgccaaactctctggaggaattaggggatggactcgctatgggcattatgatcctgaagcttctgaccgactttcaaagccatcagttgtgggcgacgctcctgtccatgacattcattagaaccactttttcactacactatgcctggaaaaccatggcaatggtcctgagcatcgtaagtcttttccccctctgtctgtctacaacttcccagaagaccacgtggttgccggtgctgttaggcagcctcgggtgcaagcctctgacaatgtttcttatagctgagaataaaatctggggaaggaagtcgtggccactgaacgaaggtattatggccgttggcatcgtgtcaattttgctctctagtctgctaaaaaacgatgtccccctggccgggcctcttatcgctggaggcatgctcatagcatgttacgtgatttccggtagctctgccgacctgagcttggagaaggcggctgtagtgtcctgggaggaagaggccgaacattcaggggcaagtcacaatatcttagtcgaggttcaggatgacggaaccatgaaaatcaaggatgaagagcgagacgatactctgacaattctcctgaaagccacccttctggctgtgagcggcgtgtatcccttgtctataccagcaactctattcgtctggtacttctggcaaaagaagaaacagcgctccggcgtgctgtgggacacaccttcacccccagaggttgaacgggccgtactcgatgacgggatctatagaattatgcagaggggactgcttggtcgtagtcaggtgggcgtcggggtgtttcaagagaacgttttccataccatgtggcacgtgacgcgcggagcggtcttaatgtaccagggcaagcggctggaaccgagctgggcttccgtgaaaaaggacctcatctcttacggtgggggatggagattgcagggctcgtggaatactggcgaggaggtacaggtcattgccgtggaacctgggaaaaaccccaagaatgttcaaaccgcaccaggaacatttaagaccagcgagggtgaagtgggcgccatcgctctggatttcaaacccgggacatcaggatcccctatagtcaacagggagggcaaggtggttggtctctatgggaatggagtggtcactaccagtggcacgtacgtgtctgccatcgcacaggctaaagccagccaggaaggcccactgcccgagattgaggacgaagtatttcgaaagcggaaccttacaatcatggatctgcaccctgggtccggaaaaactcgcagatatttgccggcgattgtgagggaggccatcaagcggaagctacgaaccctgatactcgcaccaacaagagttgtcgcttcagaaatggccgaggctttaaaaggtatgcccattcgctaccaaaccactgcagtgaagtctgaacataccggcaaagagatcgtggacctgatgtgccacgccacattcacgatgaggcttctgagccctgtccgtgtaccaaattataacatgatcattatggatgaggcccattttactgaccccagttccatcgctgcgcgggggtacataagcaccagagtgggaatgggcgaagcagccgctattttcatgacagccacccctccgggttctgttgaggcatttccccagtcaaatgccgtgatccaggatgaagagagggacattccagaacgctcctggaacagtgggtatgagtggatcactgatttccctggaaagacagtctggtttgtgcccagcataaaatcgggcaatgacattgctaactgtctccgaaagaatggcaagagagttatccagttgtctcggaaaaccttcgatacggagtaccaaaagactaaaaacaacgactgggactacgtggtcacaaccgatatctccgaaatgggggcgaatttcagggccgaccgcgtgattgatccacgtagatgcctgaagcctgtaatcctcaaagacggacccgagcgggtgattctggcaggtccaatgccggttaccgtcgctagcgccgcacagaggcgcggccgaatagggagaaaccacaataaggaaggagatcagtatatctacatgggccagcctcttaacaatgacgaggatcatgcccactggactgaggctaagatgctactggacaacattaatacacccgaaggtatcatcccagccttgtttgagcccgaacgggagaaatcagcggcaattgatggggaatataggttacgcggcgaggccagaaagaccttcgtggagctgatgaggcggggagacctccctgtgtggctgagttacaaagtcgcttctgaaggctttcaatattccgatcgtcgctggtgcttcgacggggagcgaaacaatcaggttcttgaagagaacatggatgtggaaatatggacaaaggagggagagagaaaaaagctgaggccacggtggctcgacgcccgcacttacagcgaccccttggctctgagagaatttaaagagttcgcagccggtaggcggtcagtaagtggcgatctaatcctggaaattgggaagctccctcagcaccttacgcagcgagctcaaaatgccctggacaacttagtgatgttgcataatagcgagcagggaggcagagcatatcgccacgcgatggaagagctgccggataccatcgagacactcatgctgcttgccctgattgctgtcctcactggtggggtgaccttgtttttcctgtccggcaggggattaggcaagacatctatcgggctactgtgtgttatggccagctccgtgctcctttggatggcatcagtcgaaccacattggatagctgcctctatcattctggagtttttcttgatggtactgctcatccccgaacctgaccggcagcgtaccccccaggataaccaactggcatacgtggttattggacttctctttatgatcctgactgtggccgctaatgagatgggtttgctggagacgaccaaaaaggacttaggcatagggcacgtcgcggtggaaaaccaccatcacgccgcaatgctagatgtcgacctgcatccagctagtgcctggacactctacgccgtggcaactaccattatcacacctatgatgagacacaccattgagaacactacagctaatatctcgcttacggccatagcgaaccaggctgccatcctgatgggattggataaaggctggcccattagcaagatggacatcggtgttccactgctcgcactggggtgctattcccaggtgaatcctcttaccttaactgccgctgtactgatgctcgtggcacattacgccattatcggcccgggattgcaagcgaaagctacaagggaagcccagaagcgcaccgcagccggcataatgaagaaccccaccgtcgatgggattgttgctatcgacctggatccagtggtctatgacgccaaattcgagaagcagctaggacagatcatgctgctcattctttgtacatctcaaatcctgttgatgcggactacgtgggcactgtgcgaatcaataaccctcgctacaggccctctgactaccttatgggagggtagccccgggaaattttggaatacaaccattgccgtgtccatggcgaacatcttccgaggaagttaccttgccggcgcaggtctggctttctctctcatgaagagcctaggcgggggaagaaggggcactggggcccagggagagacgctgggcgaaaaatggaagcgccagttgaatcagctgtcaaagtccgagtttaacacatataaacggagtggtattatggaagtagacagaagcgaggcaaaggaagggctcaaacgtggagagaccactaagcacgctgtgtctaggggcaccgccaaacttcggtggttcgttgagcgcaatctggtgaagccagaaggtaaggtcatcgatttgggctgtgggcgaggaggctggtcctactattgcgccgggctgaaaaaggtgacagaggtcaaaggatacactaagggcggtcctgggcacgaagagcccataccgatggcgacctacggatggaacctcgtgaaattacattcaggcaaggacgtttttttcatcccacctgaaaaatgtgatacactgctttgcgacattggcgagagctcgcccaatccaacgatcgaggaagggagaaccctgagggtactaaagatggtggagccctggctccggggaaaccaattttgtattaagatcctgaatccttatatgccgtctgtcgtggaaactttggagcagatgcagcgcaaacacggtggcatgctggttagaaaccccctcagtaggaattccacacatgagatgtactgggtgagctgcgggaccggaaacattgtctcagctgtgaatatgacttcccgaatgcttctgaaccggttcacaatggcacaccgtaagccaacctatgaaagagatgtagacttaggcgccggtacgcgccacgtggctgttgagcctgaagtcgccaacctggatatcatagggcagaggattgagaatatcaaacatgaacacaagtctacctggcattacgacgaggataacccctataaaacatgggcataccacggaagctatgaggtgaagcctagtggctccgccagctctatggtgaatggcgtcgttaagttgctcactaaaccatgggacgtgatccccatggtaacccaaattgctatgacagatactaccccttttgggcagcagcgggtgttcaaggaaaaagtcgacacaagaaccccaaaggcgaaacgcggaactgcccaaataatggaggtgacggcaaagtggctgtggggttttctatcaaggaacaagaaaccccgaatctgtacacgggaagagttcaccagaaaggttaggagtaatgctgccattggcgcagtgtttgtcgacgaaaaccagtggaattccgccaaagaggctgtggaggatgaacgcttctgggaccttgtacatcgtgagcgggaactgcacaagcaggggaaatgcgccacttgcgtttacaacatgatgggaaagagagagaagaaactcggcgaatttggtaaggcgaaagggagcagggcaatctggtacatgtggctgggagcccgcttcttggagttcgaggctctgggctttatgaatgaagatcactggttctctcgagagaactcgctctcaggcgtggaaggggagggacttcataagctgggttatattttacgggacatcagcaaaataccgggcgggaatatgtacgccgatgacaccgcaggatgggatacaagaatcacggaggacgatctgcagaacgaagctaagattaccgacatcatggagcctgaacacgccttgctcgctaaatccatttttaagctgacttatcaaaataaggtcgtgagggtgcagcgcccagccaaaaacggcacagtcatggatgttatcagtagacgggaccagaggggttctgggcaggtgggaacctacggcctaaatactttcacaaacatggaggcacaacttatacgtcagatggaaagcgagggcattttttccccctcagagctggaaacccctaacctcgcggggcgagccctggattggttggagaagcatggagtagaacgcttaaaaagaatggctatcagtggtgacgactgtgtggtcaagccaatcgatgaccggttcgccacagcactgactgctctcaatgatatgggcaaagtgaggaaggacattccccagtgggagccgtctaaggggtggaacgattggcagcaagttcctttttgcagccaccacttccatcagcttataatgaaagacggacgcgaaatcgtggtcccctgtagaaatcaggatgagctggtgggccgggccagggtatcccagggtgcagggtggtcactacgagagaccgcctgcctgggaaagagctatgcgcaaatgtggcagctcatgtactttcaccgtagagacttgcgcctggctgccaacgcaatttgttctgccgttccagtggattgggtccctacgtcccggaccacatggagtatccatgctcaccatcagtggatgactaccgaagacatgcttagcgtgtggaatagggtttggattgaggaaaacccctggatggaggataaaacacacatctcgtcctggggcgacgtgccatatctgggcaagagagaagaccaatggtgcgggtctctcataggattaactgcccgcgcaacctgggctacgaatatccaggtcgccattaaccaggtgcggaggctgttgggtaatgagaactacctggattacatgacatcaatgaaacgattcaagaatgagagcgaccccgaaggcgcgctctggtga

SEQ ID NO: 13895 - RNA, 9879 nt, synthetic construct
  misc_feature 1..9879: note = derived and/or modified CDS sequence (opt3) from DENV-1__HM181964__SS-prME
  source 1..9879: mol_type = other RNA
agcgtgaccatgctgctcatgcttatgcccaccgccctggctttccacttgactacgagaggcggggaacctcatatgatcgtctccaagcaggaaaggggaaagtctttactgtttaagacctcagccggtgttaatatgtgcacgctaattgccatggacctcggcgagctgtgtgaagatactatgacctacaagtgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataagcccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctccgcgggatgtcctatgtgatgtgtaccgggagcttcaagctggagaaagaagtcgccgagacgcagcacggtacagtgcttgttcagataaagtacgagggcaccgacgctccttgcaagatcccattctcgactcaagatgaaaaaggggtgacacagaacggaagattgattaccgcgaatcccatcgtaactgacaaggagaaacctgtcaacatagaagcagagccaccctttggcgagtcttatattgtgatcggtgccggggaaaaggctctgaaactctcctggttcaagaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagtacaagtattcgtggaaaagctggggcaaggccaagataatcggggcggacgtgcagaataccacatttattatcgatggaccaaacactcctgaatgtcccgacgatcagagggcctggaatatttgggaggtcgaggactacggcttcggtatctttaccacaaacatatggcttaaattgcgtgattcctatacacaggtgtgcgaccaccggctcatgtcagctgcaattaaggatagtaaagccgttcacgctgacatggggtactggatcgaatctgagaagaatgaaacctggaaactggcccgagcatccttcattgaggtgaagacttgtatctggccaaagtcccatacactatggtcaaacggagtactggaaagcgagatgataatccccaaaatttatggcggtcctatctctcaacacaattacagaccaggctacttcacccagactgcggggccgtggcatctcggaaagctggagcttgattttgacttgtgcgaaggcacaaccgtcgtggtggatgagcactgcgggaacaggggaccctccctgcgcacgactaccgtcacaggcaaaattatccacgaatggtgttgccggagttgtaccttacctccactcagattcaggggtgaggacgggtgctggtatggaatggagatacgccccgttaaggaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattatgggacagctcacctggaacgatctgatcagactttgcattatggttggcgccaatgcatctgacaggatggggatgggaacaacttacttggctctgatggccaccttcaaaatgcgccctatgtttgcagtgggcttactcttccggagactgacgagcagggaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaaaacaactttttccctgcactgtgcctggaagaccatggcaatggtgctttcaattgtcagcctcttccccctgtgcttgagtacgacatctcagaaaaccacttggctgccggtattactcggctccctggggtgtaagcctcttacaatgtttctgatcgctgagaataagatatggggacgacgcagctggccattgaacgaaggtatcatggccgtgggcattgtttcgatcctcctgtcatctctactgaaaaacgatgtgccccttgccgggcctctcattgctggaggcatgctgatcgcatgctatgtcataagtggttccagcgccgacttgtctttagagaaggcggctgaggtgagctgggaagaggaagccgagcattccggggcatcacacaatattctggtagaagtgcaggatgacggaaccatgaaaatcaaggatgaggagcgggacgatactctcacaatcctgcttaaagccaccctgttggctgtcagtggcgtttaccccctaagcattccagcaacgctgttcgtgtggtatttctggcaaaagaaaaagcagagatctggcgtgctctgggacactccttcacccccagaagtcgagagggccgtgctggatgacgggatataccgtatcatgcagcgcggacttttaggtcggagccaggttggcgtaggggtgtttcaagaaaacgtcttccataccatgtggcacgtgacaagaggagcggttctgatgtatcagggcaagaggctcgagccgagttgggctagcgtgaaaaaggacttgatttcctacggtgggggatggcgactgcagggctcttggaataccggcgaggaagtccaggtgatcgccgtagagcctgggaaaaaccccaagaatgtccaaacagcaccaggaacttttaaaacccccgaaggtgaggtgggcgccattgctctcgatttcaagcctgggacgtcgggaagcccaatcgttaaccgggaaggcaagatagtgggtctgtacgggaatggagtcgtgacaacttcaggcacctatgtttccgccatcgcacaggctaaagccagtcaggagggcccccttcctgagattgaagacgaggtgtttcgcaagagaaacctgacaatcatggatttgcacccggggtctggaaaaaccaggcggtacctaccagcgattgtccgagaagccatcaagagaaaactgcgcactctcatattagcacccaccagggtggtagctagcgagatggccgaagctctgaagggtatgcctattcgttatcaaacaacggcagtgaagtccgagcatactggcaaagagatcgttgaccttatgtgtcacgccaccttcacaatgcggctgctctcaccagtcagagtgcccaattacaacatgatcattatggatgaagcccattttaccgacccttctagcatcgctgcgagggggtatataagtactcgcgtgggaatgggcgaggcagccgctattttcatgacagccaccccgcccggttccgtcgaagcatttccattgagcaatgccgtaatccaggatgaggaacgagacattcctgagagatcttggaactcagggtacgagtggatcacggatttccccggaaagactgtgtggtttgttccatccataaaaagtggcaatgacattgctaactgcctgcggaagaatggcaaaagggtgatccagctcagccgcaagacattcgataccgaatatcagaagaccaaaaacaacgactgggactacgtcgtgactacagatatctcggagatgggggcgaatttccgtgccgacagagttattgatcctcggaggtgcctgaagcccgtgatccttaaagacggaccagaacgcgtcattctagcaggtccgatgcctgtgaccgtagcttctgccgcacaacgaagaggccggatagggaggaaccacaataaggagggagatcagtacatctatatgggccagcccctgaacaatgacgaggatcatgcccactggacagaagctaaaatgttgttagacaacattaatactccagagggtatcatccccgccctgtttgaacctgagcgcgaaaagtccgcggcaattgatggggagtacagactcaggggcgaggcccggaagacgttcgtggaactgatgcgtcgcggagaccttccagtttggctgagctataaagtcgcttcagagggctttcagtacagtgatcgaagatggtgtttcgacggggaaaggaacaatcaagtgctcgaggaaaacatggatgtggagatatggaccaaggagggagaacggaaaaagttgcgccccagatggctggacgccaggacatattctgaccctctagctctgcgggagtttaaagagttcgcagccggtcgaagatccgtcagcggcgatctcatccttgagattgggaagctgccgcagcacttaactcagcgcgctcagaatgccttggacaacctggttatgctccataattcagaacaaggaggcagggcataccggcacgcgatggaggagctgccagataccatcgaaacacttatgctgctcgccttgattgctgtgctgaccggtggggtaactttatttttcctaagtggccgtggactgggcaaaacgagcatcgggctcctttgcgtgatggcctcctctgtcctgttgtggatggcaagcgtggagccccattggatagctgcctccatcattctggaatttttcctcatggttctgcttatccctgagcccgacaagcagagaaccccacaggataaccagctcgcatatgtggtcattggactgttgtttatgatcctgacagtagccgctaatgagatgggtttactagaaactaccaagaaagacctgggcatagggcacgtggcggttgagaaccaccatcacgccgcaatgctcgatgtggaccttcatcctgcttcagcctggacactgtacgccgtcgcaaccactattatcacacccatgatgaggcacacgattgaaaacaccactgctaatatctctttgacagccatagcgaaccaagctgccatcctgatgggactcgataagggctggccaattagtaaaatggacatcggtgtgcctctgcttgcattagggtgttactcgcaggtcaatccgctgaccctcaccgccgctgtgttgatgctggttgcacattatgccattatcggccccggactacaggcgaaggctacacgcgaggcccaaaaacggactgcagccggcataatgaagaacccaacggtggatgggattgtagctatcgacctggatcctgtggtctacgacgccaagttcgaaaaacagctcggacagatcatgcttctgattttgtgcaccagccagatcctgctcatgcgaacaacttgggcactgtgtgagtccataaccttagctacaggcccccttaccactctgtgggagggttctccagggaagttttggaatacgacaattgccgtttcaatggcgaacatcttcagaggaagctatctcgccggcgcaggtctagctttctccctgatgaaaagtttgggcgggggaaggcgcggcaccggggcccaaggagaaactctgggcgagaagtggaaacggcagctcaatcagctttctaagagcgaatttaacacctacaagagatcaggtattatggaggtggaccgttccgaagcaaaagaggggctgaagaggggagagacaactaaacacgctgtcagtcggggcaccgccaagttgcgctggttcgtggaacgaaatctggtaaaacctgagggtaaggtgatcgatctcggctgcgggagaggaggctggagctattactgtgccgggttaaagaaagttacagaagtgaagggatatacgaaaggcggtcccgggcacgaggaaccgataccaatggcgacctacggatggaacctggtcaaacttcattctggcaaagacgtgtttttcatccctcccgagaagtgcgatactctgctatgtgacattggcgagtcctcaccaaatcccacaatcgaagaggggaggaccctccgggtcctgaaaatggtggaaccttggttgcgcggaaaccagttttgcattaagatcctgaatccgtacatgcccagcgttgtagagactctcgagcaaatgcagagaaagcacggtggcatgcttgtgaggaacccactgtcgcgaaattctacacatgaaatgtattgggtcagttgtgggaccggaaacattgtgtccgctgttaatatgacgagccggatgttactgaaccgtttcaccatggcacacagaaaacctacatacgagcgcgatgtggacttgggcgccggtactaggcacgtcgctgtggaacccgaggtagccaacctcgatatcatagggcagcggattgaaaatatcaagcatgagcacaaatcaacctggcattatgacgaggataacccttacaagacatgggcatatcacggatcctacgaagtgaaaccatctggcagcgccagttccatggttaatggcgtcgtgaagctgctaactaagccctgggacgtgatccctatggtcacccagattgctatgacagataccactccatttgggcaacagagagttttcaaagagaaggtggacacgcgcacacccaaagcgaagaggggaaccgcccagataatggaagtaactgcaaaatggctttggggttttctgagccgaaacaagaagccgcggatctgcaccagagaggagttcacaaggaaagtgcgctctaatgctgccattggcgcagtctttgtggacgagaaccaatggaactcagccaaggaggctgttgaagatgagcgtttctgggacctcgtgcatcgggaaagagagctgcacaaacaggggaagtgcgccacgtgtgtctataacatgatgggaaaaagggaaaagaagttgggcgagtttggtaaagcgaaggggagtcgcgcaatctggtacatgtggctgggagcccgattcctcgagttcgaagctcttggctttatgaatgaggatcactggttctcccgggaaaacagcctgtctggcgtggagggggagggattacataaactgggttacattttgagagacatctcgaagatacctggcgggaatatgtatgccgatgacaccgcaggatgggatactaggatcacagaagacgatctccagaacgaggctcgcattaccgacatcatggaaccagagcacgccctgctagctaaatcaatttttaaacttacttaccagaataaagtagttagagtgcaacggcccgccaagaacggcacagtcatggatgtgatcagcaggcgtgaccagcgaggttccggacaggtgggaacctatggcctgaatacattcactaacatggaagcacagctcatacgccaaatggagagtgagggcatattttctcctagcgaactggagaccccaaacttggcggaaagagtcttagattggctggagaagtacggggttgaacggctcaaaaggatggccatctccggagacgactgcgtggtaaagcccatcgatgaccgcttcgctacggcccttaccgcactgaatgatatgggtaaagtgagaaaggacattccgcagtgggagccttcaaaaggctggaacgattggcagcaggtccccttttgtagtcatcacttccaccaactaataatgaaggacgggcgggagatcgtggttccatgcaggaatcaggatgaactggtgggacgagctcgtgtctctcagggcgccggttggagcctcagagagacagcatgtttggggaagtcctatgcccagatgtggcaactgatgtactttcatcgccgggaccttaggctggcggctaacgccatttgctcagcagtgcctgtagattggatccccactagcagaaccacatggtctattcacgcccatcaccagtggatgactaccgaagacatgctctccgtttggaatcgcgtgtggatcgaggaaaacccatggatggaggataaaacgcatataagtagctggggagacgtcccctatttaggcaagcgggaggaccagtggtgtggctcgctgatcgggttgacagctagggccacctgggcaactaatattcaagtggctatcaaccaggttcgaagactgattggaaatgaaaactacctcgattacatgacatccatgaaacggttcaagaatgagtctgaccctgaaggtgccctttggtga

SEQ ID NO: 13896 - RNA, 9879 nt, synthetic construct
  misc_feature 1..9879: note = derived and/or modified CDS sequence (opt3) from DENV-1__HM181966__SS-prME
  source 1..9879: mol_type = other RNA
agcgtgaccatgctgctcatgcttatgcccaccgccctggctttccacttgactacgcgaggaggggagcctcatatgatcgtcaccaagcaggaaaggggaaaatccttactgtttaagacatctgttggtgtgaacatgtgcactctgattgccatggacctcggcgagctgtgtgaagataccatgacatacaaatgcccacggataaccgaggccgaaccggacgatgtagactgttggtgcaatgcgactgatacatgggtgacctatgggacgtgttcacaaactggagagcaccgccgagacaagcgtagtgtcgctcttgcaccccatgtgggcctgggtttggagaccagaacagaaacttggatgagctccgagggggcatggaaacagatccagagggttgaaacctgggccctccggcaccctggattcacagtgattgctctgtttctggcacatgccatcggcacctctattacgcagaagggcatcatattcatcctcttaatgctggtcactccatcgatggctatgcgctgcgtggggattggatcaagagattttgtagagggtcttagcggcgccacatgggttgacgtggtcttggagcacgggagttgtgtgaccactatggcgaaggataaacccacactggacatcgaactactcaagaccgaggtgacgaaccctgcagtcctgaggaaactttgcattgaagccaagatctccaataccacaactgattctcggtgtccaacccaaggagaggctacactgatggaagaacaagacgccaacttcgtttgccgccgaacttttgtggatagaggctggggtaatgggtgtggattgttcggcaaaggcagcctcataacctgcgcaaagtttaagtgcgtaacaaaactggaggggaagattgtgcagtacgaaaacttaaaatattccgtcatcgtgaccgttcacactggagaccagcatcaagtgggtaatgagtcaacggaacacggcacaaccgctactattacaccccaggcccctacaagtgagatccagctgaccgactacggggcgctcactcttgattgtagcccaaggacaggactggacttcaacgaaatggtcttgctaacgatgaaggagaaatcttggctggtgcataagcagtggtttctcgatctgccgcttccctggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaatccagacctctggaacaactaccatttttgcaggccatttaaaatgccgtctgaagatggataaactaacactcaaggggatgtcctatgtgatgtgtactggtagcttcaaactggagaaggaagtcgccgagacccagcacggaacggtgcttgttcagataaagtacgagggcacagacgctccttgcaaaatcccattctcgaccttggatgaaaagggggtgactcaaaacggacgcctgattacagcgaatcccatcgtaaccgacaaagagaagcctgtcaacatagaagcagagccaccctttggcgagtcttatattgtgatcggtgccggggaaaaagctctcaagctgtcctggttcaagaaaggctcaagtatcggaaagatgtttgaggccactgcaagaggcgccaggcggatggctattcttggggataccgcctgggacttcggaagcatcggtggcgtttttacatccgtggggaaactggtccatcagattttcggaacggcatacggcgtgttgttttctggtgtaagctggaccatgaagatagggatcggcgtgctcctgacttggttaggactaaattcacgaagtacatccctaagcatgacctgtattgcggttggcctcgtcacactgtaccttggggtgatggtgcaggctgattctggatgcgtcatcaactggaaaggccgcgaattgaagtgtggttcagggatcttcgttactaatgaggtgcacacctggacggaacagtataagtttcaagccgacagtccgaaaagactgagcgcagccattggaaaggcttgggaggagggcgtgtgcggtataaggtccgccacacggctcgaaaacatcatgtggaaacagatttctaacgagctgaatcatatcttactggaaaacgacatgaagttcaccgtagtcgtgggcgatgttgtggggattcttgcacagggcaagaaaatgatccgccctcagcccatggagcacaaatactcgtggaaaagctggggcaaggctaaaataatcggggccgacgtccaaaatactacctttattatcgatggaccaaacacacctgaatgtcccgacgatcagagagcgtggaatatttgggaggtggaggactatggcttcggtatctttactaccaacatatggttgaagctcagggattcctacacacaggtttgcgaccaccgtctgatgtcagccgctattaaagatagtaaggcagtgcatgccgacatggggtattggatcgaatctgagaaaaatgaaacgtggaagctagctcgggccagcttcattgaggtaaagacctgtatctggccaaaatcccacactctgtggtcaaacggagtcctcgaaagcgagatgataatccccaagatttacggcggtcctatctctcagcataattatcgaccaggctacttcacacaaaccgcagggccgtggcacctgggaaaacttgagttggattttgacctgtgcgaaggcactacagtggtggtcgatgagcactgcgggaacagaggaccctccttaaggaccacgactgttaccggcaagattatccatgaatggtgttgccgcagttgtacactccctccactgcggttcaaaggtgaggacgggtgctggtacggaatggagataagacccgtgaaggaaaaggaggaaaatcttgtaaaaagcatggtgtctgcgggctccggtgaggtcgactcatttagtctgggcttgctctgtattagcatcatgatcgaagaggtgatgaggtcgcgctggtcccgaaagatgctgatgaccgggactctagccgttttcctgctcctgattatgggacagcttacatggaacgatttgatccggctgtgcattatggtgggcgctaatgcctctgaccgtatggggatgggaaccacatatttagcactcatagctacttttaaaatgagacctatgttcgccgtcggcctgctttttaggcgcctgaccagccgggaggtgctactcctgacgatcggtttgtcactggttgcaagtgtggaattaccaaactccctcgaggaactgggggatggacttgccatgggcattatgatcctgaagttgctcacagacttccagtctcaccaactgtgggctaccctactgagctttactttcattaaaaccacactttccctccattacgcgtggaagactatggccatggtcctgtcaatcgtatccttgtttcccctgtgtttaagtaccacgtctcagaagacaacctggctcccggtgctgcttggctccctggggtgcaaacctttgactatgttcctcatagcagagaataagatctggggaagaaaaagctggccactgaacgaaggtattatggctgttggcgtggtctcgatcctactgtcatctcttctcaagaacgatgtgcccctggccgggcctttgattgccggaggcatgttaatcgcttgttatgtaataagtggttccagcgcagacctgtctctcgagaaagccgcggaggtgagctgggaagaggaagctgagcactccggggcctcacataatattctggtcgaagttcaggatgacggaacaatgaagatcaaagatgaggagagggacgatacccttactatcctgttgaaggcaacactactggccgtgagtggcgtgtaccccctcagcattccagctaccctgtttgtctggtatttctggcagaagaaaaagcaacgatctggcgtgctttgggacacgccttcacccccaaaagttgaacgcgcagtattagatgacgggatataccggatcatgcagagaggactgctcggtaggagccaggtgggcgtcggggtgttccaggagaacgtttttcacactatgtggcacgtgacccgtggagccgtcttgatgtatcaaggcaagcgcctggaaccgagttgggcgagcgtgaaaaaggacctcatttcctacggtgggggatggcggctgcagggctcttggaatacaggcgaggaggtacaggtcatcgctgtggaacctgggaagaaccccaaaaatgttcagaccgccccaggaacattcaagacttcggagggtgaagtgggcgcaattgcccttgattttaaacccgggaccagcggatcacctatcgtcaacagagagggcaagatagtgggtctgtacgggaatggagttgtgacgacatccggcacttatgtcagtgctatcgcccaagcaaaggcttctcaggaaggcccattgcccgagattgaggacgaagtgttcaggaagcgaaacctaaccatcatggatctgcatcctgggagcggaaagacacggcgctacctcccggccattgtaagagaggcgatcaaaaggaagttacggaccctgatacttgccccaactcgagtggttgcatccgaaatggctgaggccctgaaaggtatgcccattagatatcagaccacagctgtcaagtcagaacacacgggcaaagagatcgtggacctcatgtgccatgcaacttttaccatgcgcttgctgtctcctgtgagggtcccaaattacaacatgatcattatggatgaggcccacttcacagaccccagcagtatcgccgctcgtgggtatatatccacccgggtaggaatgggcgaagcggcagccatttttatgactgctacacctccgggtagcgtggaggccttcccccaatctaatgcagttatccaggatgaagagagagacattccagaaaggtcatggaactccgggtacgagtggatcaccgattttcctggaaagacggtgtggttcgtccccagtataaagagcggcaatgacattgccaactgtctccgcaaaaatggcaagcgagtgatccagctgtcgagaaaaacttttgatacagagtatcagaagaccaaaaacaacgactgggactacgttgtgaccactgatatctctgaaatgggggctaatttccgggcggacagggtcattgatccacgccgttgccttaagcctgtgatcctaaaggacggacccgagagagtaattctggccggtccaatgccggtgacagttgcatccgctgcccaacggaggggccgcatagggcgaaaccataataaagaaggagatcagtacatctatatgggccagcctttgaacaatgacgaggatcacgcacactggaccgaggccaagatgttactggacaacattaatacacccgaaggtatcatcccagctctcttcgagcccgaaagagagaaaagcgccgcgattgatggggaataccggctgaggggcgaggcacgcaagacttttgtcgagcttatgagaaggggagacctgcctgtgtggctctcatataaagtggccagtgaaggcttccagtactctgatcggcgttggtgctttgacggggagcgcaacaatcaagtcttggaagagaacatggatgttgaaatatggacgaaggagggagagaggaaaaagctgagaccaagatggctagacgctcggacctattccgaccccctggccctccgcgagttcaaggagtttgctgcaggtagaaggagcgtgtcaggcgatcttatcctggaaattgggaaattacctcagcatttgacacagcgggcccagaatgctctggacaacctcgtaatgctgcacaatagtgagcaaggaggccgagcctacagacatgcaatggaagaacttccggatactatcgagaccctgatgctcttggcgctgattgccgtgttaacaggtggggtcaccctattctttctgagcggccgcggactcggcaagacttccatcgggcttctgtgtgtgatggcttctagcgccttgctgtggatggcatccgttgaaccacactggatagctgcctcaatcattctcgagttctttctgatggtgcttctcatccccgaacctgacaggcagcggacgccccaggataaccagctggcatatgtcgtaattggattgctgttcatgatcttaaccgtggccgctaatgagatgggtctactggagacaactaaaaaggacctcggcatagggcacgttgcggtggaaaaccatcaccatgccaccatgcttgatgtcgacctgcacccagcatctgcttggacattgtacgccgtggccaccactattatcacacctatgatgcgtcatacgattgagaacaccactgcaaatatcagtctgacagctatagccaaccaagcggctatcctcatgggactggataaaggctggcccatttcgaagatggacatcggtgtcccacttttagccctggggtgctacagccaggtgaatcctctcaccttgaccgcagccgttctgatgctagtggctcactatgcaattatcggcccgggactgcaggccaaggcgacaagagaagctcagaaaaggactgccgcaggcataatgaagaaccccacggtagatgggattgtggccatcgacctcgatccagtcgtttacgacgctaaatttgagaagcagcttggacagatcatgctgttgattctgtgtacctcccagatcctcctgatgcgcacaacttgggccttatgcgaatctataacccttgcaacaggccctctgaccactctctgggagggttcacccgggaaattctggaatacgacaattgctgtgagcatggccaacatctttcggggatcctatctagcgggcgccggtctggcattcagtttgatgaagtctctgggcgggggacgaagaggcaccggggctcaaggagagactctcggcgaaaagtggaaaaggcagcttaatcagctgagcaagtcagagttcaacatttacaaacgctccggtatcatggaagtcgaccggagtgaggccaaggaagggttgaaaagaggagagaccacacgtcacgcagtgagcaggggcactgctaagctgcggtggtttgtagagcgcaatctcgtgaagccagaaggtaaagttatagatttaggctgtgggcgaggaggctggtcttattactgcgccgggctgaagaaagtgaccgaggtcaagggatatacaaaaggcggtcctgggcatgaggaacccatcccgatggccacgtacggatggaaccttgtgaagctgcactccggcaaagacgtcttctttaccccacctgaaaagtgtgatactctactctgcgacattggcgagtcaagccccaatccaacaatcgaggaagggagaaccctgagggtgttgaagatggttgagccctggctgcggggaaaccagttctgtattaaaatcctcaatccttacatgccgtcggtagtggaaactcttgagcaaatgcagcgcaagcatggtggcatgctggtcagaaaccccttatctaggaatagtacacacgagatgtattgggtgtcctgcgggaccggaaacattgttagcgcggtgaatatgacgtcacgaatgctgttgaaccggtttaccatggctcaccgtaaaccaacatacgaaagagatgtcgacctcggcgcaggtactcgccatgtggccgtagagcctgaagtggctaacctggatatcatagggcagaggattgagaatatcaagcacgaacataaatccacctggcactatgacgaggataacccctacaagacatgggcctatcatggatcttacgaggttaagcctagcggcagtgcatccagcatggtcaatggcgtggtgaaactacttactaagccatgggacgtcatccccatggttacccagattgccatgacagataccactcctttcgggcaacagcgggtgtttaaagaaaaggtagacacgagaacaccaaaagctaagcgcggaaccgcgcagataatggaggtgactgccaggtggctgtggggtttcctctctcgaaacaagaaaccccggatctgtaccagagaagagtttacaaggaaggtccgctcaaatgcagctattggcgccgtgttcgttgacgaaaaccaatggaatagtgcaaaagaggccgtggaggatgaacgtttttgggacctggtccagaaggagcgggaattgcacaaacaggggaagtgcgctacgtgcgtgtataacatgatgggaaagagagagaaaaagctgggcgagttcggtaaagccaaggggtccagggcgatctggtacatgtggctcggagcacgctttcttgagttcgaggccctgggcttcatgaatgaagatcactggtttagccgagagaactctttatcgggcgtagaaggggagggactgcataaattgggttacattctccgggacatctcaaagataccgggcgggaatatgtatgctgatgacaccgccggatgggatactagaatcacagaggacgatctgcagaacgaagcaaaaattaccgacatcatggagcctgaacacgctctacttgccactagcattttcaagctgacataccaaaataaggttgtgagggtccagcgcccagctaaaaacggcaccgtgatggatgtgatctccagacgggaccagaggggtagtgggcaggtcggaacatatggcctcaatacttttaccaacatggaggcccaactgatacgtcagatggaatctgagggcattttcttgcccagcgagttagaaacgcctaacctggcagagcgagttctcgattggcttgaaaagtacggggtggagcgcctgaaaagaatggcgatctccggagacgactgtgtagtgaagccaatcgatgaccggtttgccaccgctctaacagccctgaatgatatgggtaaagtcaggaaggacattccccagtgggaaccgtcaaagggctggaacgattggcagcaagtgcctttctgcagtcatcactttcaccagctcgttatgaaagacgggcgcgagatagtggtcccctgtagaaatcaggatgagttggtgggacgggcaagggtatctcagggcgctggttggagcctgcgagaaactgcctgccttgggaagtcctatgcacaaatgtggcagctgatgtacttccatcgtagagacctccgcttagccgcgaacgctatctgttcagccgttccagtggattgggtccctaccagccggacaacttggtctattcacgcacatcaccagtggatgaccacggaggacatgctgtccgtgtggaatagggtttggatcgaagagaacccctggatggaagataaaacacatgtgagtagctggggagacgtcccatatttgggcaagagagaggaccaatggtgcggctcgctgattgggctcaccgcccgcgctacttgggcctccaatatccaggtggcaataaaccaggtacggaggcttatcggaaatgagaactacctggattacatgacatctatgaaacgatttaagaatgaaggtgaccccgagggcgctctatggtga

SEQ ID NO: 13897 - RNA, 9879 nt, synthetic construct
  misc_feature 1..9879: note = derived and/or modified CDS sequence (opt3) from DENV-1__GU131721__SS-prME
  source 1..9879: mol_type = other RNA
agcgtgaccatgctgctcatgcttatgcccacggccctggctttccacttgactacgcggggaggggaacctcatatgatcgtctccaagcaggaaagagggaaatctttactgtttaagacctcagccggtgttaatatgtgcacgctaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgcagggaaactggttcatcagatattcggaaccgcgtacggcgtgttgttttccggtgtctcttggactatgaagatcgggattggcgtgctcctgacatggttaggactgaatagccgatcaaccagtctatccatgacatgtatcgctgtaggcctcgtgactctgtaccttggggttatggtccaggccgatagcggatgcgtgatcaactggaaaggccgcgaattgaagtgtggttctgggattttcgtgaccaatgaggtccacacgtggacagaacaatataagtttcaggcagactcaccgaaaagactgagtgccgctataggaaaggcctgggaggagggcgtttgcggtatcaggagcgcaacccggctcgaaaacattatgtggaaacagatctccaacgagctgaatcatattttactggaaaacgacatgaagttcactgtggtggtaggcgatgtcgctgggatccttgcccagggcaagaagatgatacgccctcaacccatggagtacaaatattcttggaagtcgtggggcaaggcgaaaatcattggggccgacgtgcagaataccacatttatcattgatggaccaaacactcctgaatgtcccgacgatcagagagcttggaatatctgggaggttgaggactacggcttcggtatatttaccacaaacatttggttgaagctcagggatagctatacacaggtgtgcgaccaccgtctgatgtccgcagccatcaaagattcaaaggctgtccacgccgacatggggtactggattgaaagtgagaaaaatgaaacctggaagctagcacgggcgtctttcatcgaggtgaagacttgtatatggccaaaaagccatacactgtggtccaacggagttctcgaatcagagatgatcgtgcccaagatttatggcggtcctatcagccaacacaattaccgaccaggctacttcacccagactgccgggccgtggcatctgggaaaacttgagttggattttgacctgtgcgaaggcacaaccgtagtcgtggatgagcactgcgggaacagaggaccctctttaaggacgactaccgtgacaggcaagattatccacgaatggtgttgccgctcctgtaccctccctccactgcggttcagaggtgaggacgggtgctggtatggaatggagataaggcccgtcaaagaaaaggaggaaaatcttgttaagagtatggtgagcgctggctctggtgaggtagactccttttcactgggcttgctctgtattagtatcatcattgaagaggtgatgcgcagccgatggtcgcggaaaatgctgatgactgggacactagccgtcttctttctgctcatcatgggacagctgacctggaacgatcttattcgtttgtgcataatggtgggcgcaaatgcttccgacagaatggggatgggaacaacttacctggccttaatggcaaccttcaagatgaggcctatgtttgccgttggcctcctgttccgccggcttacgtctagagaggtgctgctactcacaatcggtctgagcttggtcgcttcagtggaactgccaaacagtttagaggaactcggggatggactggcgatgggcattatgatccttaaactgttgaccgactttcaatcccatcagctctgggccactctgctatctctgaccttcattaagacaacttttagccttcactatgcatggaaaaccatggctatggttctctccatcgtgtcactgttccccttgtgtctgagcacgacaagtcagaagaccacttggttaccggtcctcctgggctctcttgggtgcaagcctctgacaatgtttttgatagccgagaataaaatctggggaaggcgatcctggccactcaacgaaggtattatggccgtaggcatcgtgagcattctgctatcgtcactgcttaagaacgatgttcccctcgctgggcctctgatcgcaggaggcatgttgatagcctgttacgtgatttctggtagttccgcggacttaagcctggagaaagctgccgaggtctcttgggaagaggaagcagagcatagcggggcctcccacaatatcctcgtggaagtacaggatgacggaaccatgaagatcaaagatgaggagcgcgacgatactctgacaattcttctgaaggctaccttgctagcagtgtcaggcgtctatcccctgagtataccagccacactcttcgtttggtacttctggcagaagaagaagcagcggagcggcgtgctgtgggacactccttctcccccagaagtggagagagcggtccttgatgacgggatctataggattatgcagcgtggattactgggtcgctcccaggtgggcgttggggtatttcaagaaaacgtgttccataccatgtggcacgtcacacggggagctgtgctcatgtaccagggcaaaagattggagccgtcatgggccagtgttaagaaagacctgatcagctacggtgggggatggaggctccagggctcctggaataccggcgaggaagtgcaggtcattgcagtggagcctgggaagaaccccaaaaatgtacaaacagccccaggaacttttaagacccccgaaggtgaggtcggcgctatcgccctggatttcaagcctgggacgtctggatcgccaatagtgaaccgagaaggcaaaatcgttggtctttatgggaatggagtggtcacaactagcggcacctacgtgtcagcaattgctcaggccaaggcgtcccaggagggccccctgcctgagatcgaagacgaggtttttcggaaacgcaacttgacaattatggatctacacccggggagtggaaagaccagaaggtatctgccagccatcgtgcgggaagcaataaaacgaaagctcagaactttaattctggctcccacccgcgtcgtggcctctgagatggctgaagcacttaagggtatgcctatcaggtaccaaacaacggccgtaaaaagcgagcatactggcaaggagatcgtggacctgatgtgccacgccaccttcacaatgcgtctcttgtccccagttcgggtccccaattataacatgattatcatggatgaagctcattttaccgacccttcatctatagcggcaagagggtacattagcactagggtgggaatgggcgaggccgctgccatcttcatgacagcaaccccgcccggtagtgtggaagcctttccacagtccaatgctgtcattcaggatgaggaacgcgacatccctgagcgaagctggaactctgggtatgagtggataacggatttccccggaaaaactgtatggtttgtgccatcaattaagtccggcaatgacatcgcgaactgtctgaggaaaaatggcaagcgggttatccagctcagtaggaagacattcgataccgaataccagaaaaccaagaacaacgactgggactacgtggtcactacagatattagcgagatgggggccaatttccgcgcagaccgtgtgatcgatcctagacggtgcctgaaacccgttattcttaaggacggaccagaaagggtgatactagctggtccgatgcctgtcaccgtggcctcggcagcccagcgccgaggcagaatcgggcggaaccacaataaagagggagatcagtatatttacatgggccagcccctgaacaatgacgaggatcatgctcactggacagaagccaagatgttgttagacaacatcaatactccagagggtatcattcccgcgctgtttgaacctgagagggaaaagtctgcagccatagatggggagtatcgcctcagaggcgaggctaggaaaacgttcgtagaactgatgcggcgtggagaccttccagtgtggctgtcctacaaggttgccagcgagggctttcaatattcagatcgccgatggtgcttcgacggggaaagaaacaatcaggtcctcgaggaaaacatggatgtggagatctggaccaaagagggagaaaggaagaaattgcggccccgctggctggacgctagaacatacagtgaccctctagcactgagggagtttaaggagttcgccgctggtcggcgatctgtgtccggcgatctcattcttgagatcgggaaactgccgcagcacttaactcagagagcccaaaatgcattggacaacctggtcatgctccataatagcgaacagggaggccgcgcgtataggcacgccatggaggagctgccagataccattgaaacacttatgctgctcgctttgatcgccgttctgaccggtggggtgactttatttttcctatcaggccggggactgggcaagacgagtatagggctcctttgtgtaatggcaagctccgtgctgttgtggatggcttctgtcgagccccattggatcgccgcaagcattatcctggaatttttcctcatggtgctgcttattcctgagcccgaccgtcagagaaccccacaggataaccaactcgcctacgttgtgatcggactgttgtttatgatactgacagtcgctgcgaatgagatgggtttactagaaactaccaagaaagacctgggcattgggcacgtagccgtggagaaccaccatcacgcagctatgctcgatgttgaccttaggcctgcctccgcctggacactgtacgcagtggctaccactatcattacacccatgatgcgccatacgatcgaaaacaccactgccaatatatcattgacagcgatcgctaaccaggccgcaattctgatgggactcgataagggctggccaatctctaaaatggacattggtgtccctctgcttgccttagggtgctatagtcaggtgaatccgctgaccctcaccgctgcagtcttgatgctggtggcccactacgcgatcataggccccggactacaagctaaggccacacgggaggcacagaaacgaactgccgctggcattatgaagaacccaacggttgatgggatcgtggccatcgacctggatcctgtagtgtatgacgcaaagttcgaaaaacagctcggacagattatgcttctgatcttgtgtacctcgcaaatactgctcatgagaacaacttgggctctgtgcgagagcattaccttagccacaggcccccttaccactctgtgggagggttccccagggaagttttggaatacgacaatcgcggtctctatggccaacattttcaggggatcatacctcgcaggcgctggtctagccttcagcctgatgaaatccttgggcgggggacgccggggcaccggggcacagggagaaactctgggcgagaagtggaaaagacagctcaatcagcttagtaagtctgaatttaacacctataagcgtagcggtatcatggaggttgacaggtcagaagctaaagaggggctgaagcggggagagacaactaaacatgccgtgtcccgcggcaccgccaagttgcgatggttcgtcgaaagaaatctggtgaaacctgagggtaaggtaatagatctcggctgtgggaggggaggctggagttactattgcgcggggttaaagaaagtgacagaagttaagggatacacgaaaggcggtcccgggcacgaggaaccgatcccaatggctacctacggatggaacctggtgaaacttcacagcggcaaagacgtctttttcattcctcccgagaagtgtgatactctgctatgcgacatcggcgagtcttccccaaatcccacaattgaagaggggcggaccctccgcgtgctgaaaatggtcgaaccttggttgagaggaaaccaattttgtatcaagattctgaatccgtatatgccctcagtggttgagactctcgagcagatgcagaggaagcatggtggcatgcttgtacgaaacccactgagcagaaattcgacacacgaaatgtactgggtgtcttgcgggaccggaaacatcgtcagtgcagtgaatatgacgtcccgtatgttactgaacagattcaccatggcccatcgcaaacctacatatgagagggatgttgacttgggcgctggtactcggcacgtggccgtcgaacccgaggtggcaaacctcgatataattgggcagagaatcgaaaatatcaagcacgagcataaaagcacctggcactacgacgaggataacccttataagacatgggcctaccatggatcatatgaagtaaaaccatccggctctgctagcagtatggtgaatggcgttgtcaagctgctaactaagccctgggacgtgattcctatggtgacccaaatagcgatgacagataccactccatttgggcagcagcgcgtcttcaaagagaaggttgacacgaggacacccaaagccaagcgaggaaccgcacaaatcatggaagtgactgctaaatggctttggggttttctgtcccggaacaagaagccgagaatttgtaccagggaggagttcacacgcaaagtacgtagcaatgccgcaatcggcgccgtgtttgtcgacgagaaccagtggaactctgctaaggaggccgtggaagatgagcggttctgggacctcgttcacagagaaagggagctgcataaacaggggaagtgcgcgacgtgcgtgtacaacatgatgggaaaacgcgaaaagaagttgggcgagtttggtaaagcaaaggggtcacgagccatttggtacatgtggctgggagctcggttcctcgagttcgaagcccttggctttatgaatgaggatcactggttcagtagagaaaactccctgagcggcgtcgagggggagggattacacaaactgggttatatcttgagggacatatctaagatccctggcgggaatatgtacgcagatgacaccgctggatgggatactcgcattacagaagacgatctccagaacgaggccagaatcaccgacattatggaaccagagcatgctctgctagccaaatcgatctttaaacttacttatcaaaataaagtggtacgggttcagaggcccgcaaagaacggcacagtgatggatgtcatatcacgtcgagaccagcgcggtagcggacaggtgggaacctacggcctgaatacattcactaacatggaagcgcaactcattagacagatggagtccgagggcatctttagtccttctgaactggagaccccaaacttggccgaacgggtgttagattggctggagaagtatggggtcgaaaggctcaaacgcatggctatcagcggagacgactgtgttgtgaagcccattgatgacagattcgccacggcacttaccgctctgaatgatatgggtaaagtacggaaggacataccgcagtgggagccttccaaaggctggaacgattggcagcaagtgcccttttgctcacaccatttccaccagctaatcatgaaggacgggagggagattgtcgtgccatgtcgaaatcaggatgaactggttggacgtgccagagtgagtcagggcgcaggttggtctctccgcgagacagcctgcttgggaaagagctacgcgcaaatgtggcagctgatgtattttcaccggagggaccttagactggctgccaacgcaatctgttccgccgtccctgtggattggattcccacttcacgcaccacatggagcatccatgctcaccatcagtggatgactaccgaagacatgctctctgtatggaatcgggtttggatagaggaaaacccatggatggaggataaaacgcacatctccagttggggagacgtgccctacttaggcaagagggaggaccaatggtgcggcagcctgattgggttgacagcccgagcaacctgggctactaatatccaggtcgccattaaccaggtgagacggctgatcggaaatgaaaactacctcgattatatgacatcgatgaaaaggttcaagaatgagggtgaacctgagggcgcgctttggtga

SEQ ID NO: 13898 - RNA, 9879 nt, synthetic construct
  misc_feature 1..9879: note = derived and/or modified CDS sequence (opt3) from DENV-1__GU131723__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagcacaaatactcgtggaaaagctggggcaaggccaagataatcggggcggacgttcagaataccacatttattatcgatggaccaaacactcctgaatgtcccgacgatcagagagcctggaatatttgggaggtggaggactatggcttcggtatctttaccacaaacatatggttgaagctcagggattcctacacgcaggtctgcgaccaccgtctgatgtcagctgcaattaaagatagtaaggccgtgcatgctgacatggggtattggatcgaatctgagaaaaatgaaacctggaagctagcccgggcatccttcattgaggttaagacttgtatctggccaaaatcccacacactgtggtcaaacggagtgctcgaaagcgagatgataatccccaagatttacggcggtcctatctctcaacataattatcgaccaggctacttcacccagactgcggggccgtggcacctgggaaaacttgagttggattttgacctgtgcgaaggcacaaccgtagtcgtggatgagcactgcgggaacagaggaccctccttaaggacgactaccgtgacaggcaagattatccatgaatggtgttgccgcagttgtaccctccctccactgcggttcagaggtgaggacgggtgctggtacggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattgtgggacagctgacctggaacgatcttatccgtttgtgcattatggttggcgccaatgcatctgacagaatggggatgggaacaacttatctggctttaatggccaccttcaagatgaggcctatgtttgcagtgggcctcctgttccgccggcttacgagcagagaggtcctgctactcacaataggtctgtcattggtggccagtgttgaactgccaaactccttagaggaactcggggatggactggctatgggcatcatgattcttaaactgttgaccgactttcaatctcaccagctctgggcgactctgctaagcctgaccttcatcaagacaactttttcccttcattacgcctggaaaaccatggcaatggtgctctcagtcgtaagcctgttccccttgtgtctgagtacgacatctcagaagaccacttggttaccggtgctcctgggctcccttgggtgcaagcctctgacaatgtttttgattgctgagaataaaatctggggaaggcgaagctggccactcaacgaaggtataatggccgttggcatcgtgtcgattctgctatcatctctgcttaagaacgatgtccccctcgccgggcctctgatcgctggaggcatgttgattgcatgttatgtgatcagtggttccagcgccgacttatctctggagaaagcggctgaggtaagctgggaagaggaagccgagcactccggggcatcacataatatactcgtggaagtccaggatgacggaaccatgaagattaaagatgaggagcgcgacgatactctgacaatccttctgaaggccaccttgctagctgttagtggcgtgtaccccctgagcatcccagcaacactcttcgtgtggtatttctggcagaagaagaagcagcggtctggcgtcctgtgggacactccttcacccccagaagtggagagagccgttcttgatgacgggatttacaggataatgcagcgtggattactgggtcgcagccaggtaggcgtgggggtctttcaagaaaacgtgttccacaccatgtggcacgttacacggggagcggtgctcatgtatcagggcaaaagattggagccgagttgggctagcgtcaagaaagacctgatctcctacggtgggggatggaggctccagggctcttggaataccggcgaggaagtgcaggtaattgccgtcgagcctgggaagaaccccaaaaatgtgcaaacagcaccaggaacttttaagacccccgaaggtgaggttggcgccatcgctctggatttcaagcctgggacgtcgggaagcccaattgtgaaccgagaaggcaaaatcgtcggtctttacgggaatggagtggttacaacttcaggcacctatgtgtccgccatagcacaggctaaggccagtcaggagggccccctgcctgagatcgaagacgaggtctttcggaaacgcaacttgacaattatggatctacatccggggtctggaaagaccagaaggtacctgccagcgatcgtgcgggaagccattaaacgaaagctcagaactttaatcctggcacccacccgcgtagtggctagcgagatggccgaagctcttaagggtatgcctataaggtatcaaacaacggcagttaaatccgagcacactggcaaggagattgtcgacctgatgtgccatgccaccttcacaatgcgtctcttgtcaccagtgcgggtgcccaattacaacatgatcatcatggatgaagcccactttaccgacccttctagcattgctgcgagagggtatatcagtactagggtcggaatgggcgaggcagccgctatattcatgacagccaccccgcccggttccgtagaagcatttccacagagcaatgccgtgattcaggatgaggaacgcgacatccctgagcgatcttggaactcagggtacgagtggattacggatttccccggaaaaactgtttggtttgtgccatccatcaagagtggcaatgacatagctaactgtctgaggaaaaatggcaagcgggtcattcagctcagcaggaagacattcgataccgaatatcagaaaaccaagaacaacgactgggactacgtggttactacagatatctcggagatgggggcgaatttccgcgccgaccgtgtgatcgatcctagacggtgcctgaaacccgtcattcttaaggacggaccagaaagggtgatcctagcaggtccgatgcctgtaaccgtggcttctgccgcacagcgccgaggcagagttgggcggaaccataataaagagggagatcagtacatttatatgggccagcccctgaacaatgacgaggatcacgcccactggacagaagctaagatgttgttagacaacataaatactccagagggtatcattcccgccctgtttgaacctgagagggaaaagtccgcggcaatcgatggggagtaccgcctcagaggcgaggccaggaaaacgttcgtcgaactgatgcggcgtggagaccttccagtgtggctgagctataaggtggcttcagagggctttcaatacagtgatcgccgatggtgcttcgacggggaaagaaacaatcaggtcctcgaggaaaacatggatgttgagatctggaccaaagagggagaaaggaagaaattgcggccccgctggctggacgccagaacatattctgaccctctagctctgagggagtttaaggagttcgcagccggtcggcgatccgtgagcggcgatctcattcttgagatagggaaactgccgcagcatttaactcagagagctcaaaatgccttggacaacctggtaatgctccacaattcagaacagggaggccgcgcatacaggcatgcgatggaggagctgccagataccatcgaaacacttatgctgctcgccttgattgctgtgctgaccggtggggtcactttatttttcctaagtggccggggactgggcaagacgagcatcgggctcctttgtgtgatggcctcctctgttctgttgtggatggcaagcgtggagccccactggattgctgcctccatcatactggaatttttcctcatggtcctgcttatccctgagcccgaccgtcagagaaccccacaggataaccaactcgcatatgtagtgattggactgttgtttatgatcctgacagttgccgctaatgagatgggtttactagaaactaccaagaaagacctgggcattgggcacgtggcggtcgagaaccatcaccatgccgcaatgctcgatgtggaccttcaccctgcttcagcctggacactgtacgccgtcgcaaccactatcataacacccatgatgaggcatacgattgaaaacaccactgctaatatctctttgacagccattgcgaaccaggctgccatcctgatgggactcgataagggctggccaataagtaaaatggacatcggtgtgcctctgcttgcattagggtgctactcgcaggttaatccgctgaccctcaccgccgctgtgttgatgctggtagcacactatgccattatcggccccggactacaagcgaaggctacacgcgaggcccagaaacggactgcagccggcattatgaagaacccaacggtggatgggatcgtcgctatagacctggatcctgttgtgtacgacgccaagttcgaaaaacagctcggacagattatgcttctgatcttgtgtaccagccaaatcctgctcatgcgaacaacttgggcactgtgcgagtccattaccttagctacaggcccccttaccactctgtgggagggttctccagggaagttttggaatacgacaatcgccgtctcaatggcgaacatattcagaggaagctatctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctacaagagatcaggtattatggaggtggaccgttccgaagcaaaagaggggctgaagaggggagagacaactaaacacgctgtaagtcggggcaccgccaagttgcgctggttcgtggaacgaaatctggttaaacctgagggtaaggtgatcgatctcggctgtgggagaggaggctggagctattactgcgccgggttaaagaaagtcacagaagtgaagggatatacgaaaggcggtcccgggcatgaggaaccgattccaatggcgacctacggatggaacctggtcaaacttcactctggcaaagacgtgtttttcatccctcccgagaagtgtgatactctgctatgcgacataggcgagtcctcaccaaatcccacaatcgaagaggggaggaccctccgggttctgaaaatggtagaaccttggttgcgcggaaaccaattttgtattaagatcctgaatccgtacatgcccagcgtggtcgagactctcgagcagatgcagagaaagcatggtggcatgcttgtgaggaacccactgtcgcgaaattctacacacgaaatgtattgggttagttgcgggaccggaaacattgtgtccgctgtcaatatgacgagccggatgttactgaaccgtttcaccatggcacacagaaaacctacatacgagcgcgatgtggacttgggcgccggtactaggcatgtagctgtggaacccgaggttgccaacctcgatatcattgggcagcggatcgaaaatataaagcacgagcataaatcaacctggcactatgacgaggataacccttacaagacatgggcatatcatggatcctacgaagtcaaaccatctggcagcgccagttccatggtgaatggcgtggtcaagctgctaactaagccctgggacgttattcctatggtgacccaaatcgctatgacagataccactccatttgggcagcagagagtattcaaagagaaggtggacacgcgcacacccaaagcgaagaggggaaccgcccaaatcatggaagtcactgcaaaatggctttggggttttctgagccgaaacaagaagccgcggatttgtaccagagaggagttcacaaggaaagtgcgctctaatgctgccataggcgcagtttttgtggacgagaaccagtggaactcagccaaggaggctgtcgaagatgagcgtttctgggacctcgtgcaccgggaaagagagctgcacaaacaggggaagtgcgccacgtgcgtatataacatgatgggaaaaagggaaaagaagttgggcgagtttggtaaagcgaaggggagtcgcgcaatctggtacatgtggctgggagcccgattcctcgagttcgaagctcttggctttatgaatgaggatcattggttctcccgggaaaacagcctgtctggcgttgagggggagggattacacaaactgggttacattttgagagacatctcgaagattcctggcgggaatatgtatgccgatgacaccgcaggatgggatactaggatcacagaagacgatctccagaacgaggctcgcataaccgacatcatggaaccagagcatgccctgctagctaaatcaatttttaaacttacttaccaaaataaagtggtcagagtgcagcggcccgccaagaacggcacagtgatggatgtcatcagcaggcgtgaccagcgaggttccgggcaggttggaacctatggcctgaatacattcactaacatggaagcacaactcattcgccagatggagagtgagggcatcttttctcctagcgaactggagaccccaaacttggcggaaagagtgttagattggctggagaagtacggggtagaacggctcaaaaggatggccatatccggagacgactgtgtggtcaagcccattgatgaccgcttcgctacggcccttaccgcactgaatgatatgggtaaagtgagaaaggacatcccgcagtgggagccttcaaaaggctggaacgattggcagcaagttcccttttgcagtcaccacttccatcagctaatcatgaaggacgggcgggagattgtggtcccatgtaggaatcaggatgaactggtgggacgagctcgtgtatctcagggcgccggttggagcctcagagagacagcatgcttggggaagtcctatgcccaaatgtggcagctgatgtactttcaccgccgggaccttaggctggcggctaacgccatatgttcagcagttcctgtggattggatccccactagcagaaccacatggtctattcatgcccaccatcagtggatgactaccgaagacatgctctccgtctggaatcgcgtgtggatcgaggaaaacccatggatggaggataaaacgcacattagtagctggggagacgttccctatttaggcaagcgggaggaccaatggtgcggctcgctgatcgggttgacagctagggccacctgggcaactaatatacaggtggctatcaaccaggtccgaagactgattggaaatgaaaactacctcgattacatgacatccatgaaacggttcaagaatgagtctgaccctgaaggtgccctttggtga

SEQ ID NO: 13899 - RNA, 9879 nt, synthetic construct
  misc_feature 1..9879: note = derived and/or modified CDS sequence (opt3) from DENV-1__GU131725__SS-prME
  source 1..9879: mol_type = other RNA
agcgtgaccatgctgctcatgcttatgcccactgcactggctttccacttgactacgagaggaggggaacctcatatgatcgtctccaagcaggaaaggggaaaatctttactgtttaagacctcagccggtgttaatatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttctctgaaatggtcttgctaacgatgaaggagaaatcctggctggtgcataagcagtggtttctcgatctgccgcttccctggacctcaggcgcaagcacaagtcaagagacatggaaccggcaggacctgttggtaaccttcaaaacagctcacgccaagaagcaggaagttgtggtcctcggttctcaagagggggctatgcacactgccctgaccggcgcaacggaaatccagacctccggaacaactaccatttttgccggccatttaaaatgccgtctgaagatggataaactaacactcaaggggatgagctatgtgatgtgtactggatcgttcaaactggagaaggaagtcgctgagacccagcacggtacggtgcttgttcagataaagtacgagggcacagacgcgccttgcaaaatcccattctctacccaagatgaaaagggggtgactcagaatggacgcttgattacagcaaaccccatcgtaaccgacaaagagaagcctgtcaatatagaagccgagccaccctttggcgagtcctatattgtgatcggtgctggggaaaaagccctgaagctctcatggttcaagaaaggcagtagcatcggaaagatgtttgaggcaactgccagaggcgctaggcggatggccattctgggggataccgcatgggacttcggatccatcggtggcgtttttacatctgtggggaaacttgtccatcagattttcggaacggcgtacggcgtgctgtttagcggtgtatcatggaccatgaagatagggatcggcgtgttgctcacttggctgggattaaacagtcgatccacaagcctgtctatgacctgtattgctgttggcctagtcacactctacctgggggtgatggtgcaggccgattcaggatgcgtcatcaattggaaaggccgcgaacttaagtgtggtagtgggatcttcgttactaacgaggtgcacacctggacggaacaatataagtttcaggcagacagcccgaaaagattgtccgccgctattggaaaggcctgggaggagggcgtgtgcggtataaggtctgcaacacggctggaaaatatcatgtggaaacagatttcgaacgagctcaaccatatcctgttagaaaatgacatgaagctgaccgtagtcgtgggcgatgttgctgggattcttggacagggcaaaaagatgatccgccctcaacccatggagtacaaatatagctggaagtcctgggggaaggccaaaataatcggagcggacgcccagaacactaccttcattatcgatggcccaaatacacctgaatgtcccgacgatcagagagcttggaacatttgggaggtggaggactacggttttgggatcttcactaccaatatatggttgaagctcagggattcatatacacaggtctgcgaccaccgtctgatgagtgcagccattaaagattctaaggctgtgcacgccgacatgggatactggatcgaaagcgagaaaaacgaaacgtggaagctagcacgggcgtcctttattgaggttaagacctgtatctggccaaaatcacatactctgtggagcaatggcgtgctcgaatctgagatgataatccccaagatttatggtggccctatctcccaacacaactaccgaccagggtacttcacacagaccgccggaccgtggcatctgggcaaacttgagttggatttcgacctgtgcgaagggactacagtagtcgtggatgagcactgcggaaatagaggccccagtttaaggaccacgactgtgaccggtaagattatccacgaatggtgttgccgcagctgtacactccctccactgcggtttagaggggaggacggatgctggtatggcatggagataaggcccgtcaaagaaaaggaggaaaaccttgttaagtctatggtgtccgctggttcaggcgaggtagacagtttcagcctggggttgctctgtatttcgatcatgatcgaagaggtgatgcgctcccgatggtctcggaaaatgctgatgaccggaactctagccgtctttttcctgctcattatgggccagctgacatggaatgatcttatccgtttgtgcattatggtgggggcaaacgctagcgacagaatgggaatgggcaccacatacctggccttaatggcaacttttaagatgaggcctatgttcgccgttggtctcctgtttcgccggcttacctcaagagaggtgctgctactcacgatagggctgagtttggtcgcttccgtggaactgccaaattctttagaggaactcggagatggcctggcgatgggcatcatgattcttaaactgttgacagacttccaaagctatcagctctgggccaccctgctatccctgacttttatcaagaccacattctcacttcattacgcatggaaaactatggctatggttctcagcattgtgagtctgtttcccttgtgtctgtctaccacgtcccagaagacaacctggttaccggtcctcctggggagccttggatgcaagcctctgactatgttcttgatcgccgagaacaaaatatggggtaggaagtcgtggccactcaatgaaggcatcatggccgtagggattgtgtcaatcctgctatctagtctgcttaaaaacgatgttcccctcgctggacctctgattgcaggcggtatgttgatcgcctgttatgtgatatccgggagctctgcggacttaagcctggagaaggctgccgaggtctcctgggaagaggaagcagagcactcaggagccagtcataacattctcgtggaagtacaggatgacggcacaatgaaaatcaaggatgaggagcgagacgataccctgactatccttctgaaagctacattgctagcagtgagcggcgtctaccccctgtctattccagccaccctctttgtttggtatttctggcaaaagaagaaacagcgctccggggtgctgtgggacacgccttcacccccagaagtggagcgggcggtccttgatgacggaatatacagaatcatgcagaggggtttactgggccgtagtcaggtgggggttggagtattccaagaaaatgtgtttcacactatgtggcatgtcacccgcggcgctgtgctcatgtaccagggtaagcggttggagccgagctgggcctccgttaaaaaggacctgatttcttatgggggaggctggagactcaggggctcgtggaacacaggggaggaagtgcaggtcatcgcagtggagcctggcaagaatcccaagaacgtacagaccgccccaggtacattcaagactcccgaaggcgaggtcggggctattgccctggattttaaacctggaaccagcggctcaccaatcgtgaatcgagaaggtaagatagttgggctttacggaaacggcgtggtcacgacatccggcacttatgtgagtgcaatcgctcaagccaaagcgtctcaggaggggcccctgcctgagattgaagacgaggttttccggaagcgcaatttgaccatcatggatctacacccgggaagcggtaaaacaagaaggtacctgccagccattgtgcgggaagcaatcaagcgaaagctcagaaccttaatactggctcccactcgcgtcgtggcctccgagatggctgaagcacttaaaggcatgcctattaggtatcagaccacagccgtaaagggggagcacacgggaaaagagatcgtggacctgatgtgccatgccacttttaccatgcgtctcttgtcaccagttcgggtccccaactacaatatgatcattatggatgaagctcacttcacagacccttctagcatcgcggcaagaggctatataagtaccagggtgggtatgggggaggccgctgccatttttatgactgcaacaccgcccggatccgtggaagccttcccacaaagcaacgctgtcatccaggatgaggaacgcgacattcctgagcgatcttggaactcaggctacgagtggatcaccgattttcccggcaagacggtatggttcgtgccatccataaaaagtgggaacgacattgcgaattgtctgagaaagaacggaaagcgggttatccagctcagcaggaaaacttttgatacagaataccagaagaccaaaaataacgactgggactatgtggtcaccactgatatctcggagatgggtgccaacttccgcgcagaccgtgtgattgatcctagacggtgcctgaagcccgttatccttaaagacggcccagaaagggtgattctagctgggccgatgcctgtcacagtggcctctgcagcccaacgccgaggaagaataggccggaatcataacaaggagggtgatcagtacatctatatggggcagcccctgaataacgacgaggatcacgctcattggaccgaagccaagatgttgttagacaatattaacacaccagagggcatcatccccgcgctgttcgaacctgagagggaaaaatccgcagccgtagatggagagtaccgcctcagaggcgaggctaggaagacttttgtggaactgatgcggcgtggggaccttccagtttggctgagctataaagtcgcctcagagggattccagtacagtgatcgccgatggtgctttgacggtgaaagaaataaccaagtgctcgaggaaaatatggatgtggagatttggacgaaggagggcgaaaggaaaaagttgcggccccgctggctggacgctagaacctattctgaccctctagcactgagggagttcaaagaatttgccgctgggcggcgatccgtcagcggagatctcatacttgagatcggcaagctgccgcagcacttaacacagagagcccagaacgcattggacaatctggttatgctccacaactcagaacaaggtgggcgcgcgtacaggcatgccatggaggagctgccagatactattgaaacccttatgctgctcgctttgatcgccgtgctgacaggcggagtaaccttattctttctaagtggccgggggctgggaaagactagcattggtctcctttgtgtgatggcatcctctgtcctgttgtggatggctagcgtggagccccactggatcgccgcatccataatcctggagttctttctcatggttctgcttattcctgagcccgaccgtcagagaacgccacaggataatcagctcgcctacgtggtcatcggcctgttgttcatgattctgaccgtagctgcgaacgagatggggttactagaaacaactaaaaaggacctgggaatcggccatgtggccgttgagaatcaccaccatgcagctatgctcgatgtggaccttcaccctgcctcagcctggaccctgtatgcagtcgctacaaccataattactcccatgatgaggcatacaatcgaaaacacgaccgccaacatttctttgactgcgatcgctaatcaagccgcaatactgatgggtctcgataaagggtggccaatcagtaagatggacattggcgtgcctctgcttgccttaggatgctactcgcaggtcaacccgctgacactcaccgctgcagtgttgatgctggttgcccactatgcgatcattggccccgggctacaggctaaagccacccgcgaggcacaaaagcggacagccgctggaatcatgaagaatccaactgtggatggcatagtagccattgacctggatcctgtggtctacgacgcaaaatttgaaaagcagctcggtcagatcatgcttctgatcttgtgtacgagccagattctgctcatgcgaaccacatgggctctgtgcgagtccatcactttagccaccgggccccttacaaccctgtgggagggatctccaggcaaattctggaacactacgatagcggtttcaatggccaatatttttagaggtagctatctcgcaggcgctgggctagccttctccctgatgaagagtttgggaggcgggaggcgcggaacaggcgcacaaggtgaaaccctgggggagaaatggaagcggcagctcaaccagctttctaagagcgagttcaatacttacaaaagatcaggaatcatggaggtggaccgttccgaagctaaggagggcctgaaaaggggtgagaccacaaagcatgccgtcagtcggggcactgccaaattgcgctggtttgtggaacgaaacctggtaaagcctgaggggaaggtgattgatctcggatgtggcagagggggatggagctattactgcgcgggcctgaaaaaggttaccgaagtgaaaggttacacaaaagggggacccggccacgaggaaccgatcccaatggctacgtatggctggaatctagtcaaacttcactctgggaaggacgtgttctttatacctcccgagaaatgtgataccctgctatgcgacatcggagagtcctcaccaaaccccactattgaagagggtaggacactccgggtcctgaagatggtggaaccttggttgcgcggcaatcagttctgtatcaagattctgaacccgtacatgcccagcgttgtagagaccctcgagcaaatgcagagaaaacatgggggaatgcttgtgaggaatccactgtcgcgaaactctactcacgaaatgtattgggtcagttgcggcacaggtaatatcgtgtccgcagttaacatgaccagccggatgttactgaatcgttttacgatggcccatagaaagcctacctacgagcgcgatgtggacttggggacaggaactaggcacgtcgctgtggaacccgaggtagccaacctcgatattatcggccagcggatagaaaacattaaacacgagcataagtcaacctggcactatgacgaggataatccttacaaaacatgggcatatcatggctcctacgaagtgaagccatctgggagcgccagttccatggttaacggagtcgtgaagctgctaactaaaccctgggacgtgatccctatggtcacccagatcgctatgacagataccactccattcggtcaacagagagtttttaaggagaaagtggacacgcgcacacccaaggcgaaaaggggcaccgcccagattatggaagtaactgcacgatggctttgggggttcctgagccggaataagaagccgagaatatgtaccagggaggaatttacacgcaaagtgcgttctaacgctgccatcggagcagtcttcgtggacgagaatcaatggaactcagccaaggaggctgttgaagatgagcggttttgggacctcgtgcacagagaaagggagctgcataaacagggcaagtgcgccacgtgcgtctacaatatgatgggtaaacgcgaaaagaagttgggggagttcggaaaagcgaagggcagtcgagcaatttggtatatgtggctgggcgcccggtttctcgagttcgaagctcttgggttcatgaacgaggatcactggttttccagagaaaatagcctgtctggagtggagggtgagggcttacacaaactggggtacatcttgagggacatttcgaagatccctggaggcaacatgtatgccgatgacaccgcaggttgggatactcgcataacagaagacgatctccagaatgaggctaaaatcaccgacattatggaaccagagcatgccctgctagctaaggccatcttcaaacttacttaccagaacaaggtagttagagtgcaacggcccgcaaagaatgggacagtcatggatgtgatttcaaggcgtgaccagcgaggaagcggccaggtgggcacctatgggctgaacacatttactaatatggaagcgcagctcatccgccaaatggagtccgagggaatattcagtccttctgaactggagaccccaaacttggccgaaagagctttagattggctggagaaatacggtgtcgaacggctcaagaggatggccattagcggcgacgactgtgttgtgaaacccatcgatgaccgctttgcaacggctcttaccgccctgaacgatatggggaaggtaagaaaagacatcccgcagtgggagccttcccggggatggaatgattggcaacaggtgcccttctgctcacaccattttcaccaactaattatgaaggacggcagggagatagtcgtgccatgtcgaaaccaggatgaactggttggtcgtgcaagagtgagtcagggggccggatggtctctccgcgagacagcgtgcttgggcaagagctatgctcagatgtggcaactgatgtacttccaccggagggaccttagactggccgcaaatgccatctgttccgctgtccctgtggattgggtacccacttcacgcaccacatggagcattcatgcccaccatcagtggatgactaccgaagacatgctctctgtttggaaccgggtgtggatcgaggaaaatccatggatggaggataaaacgcacatttccagttgggaggacgtcccctacttaggcaagagggaagaccagtggtgcgggagcctgatcggattgacagcacgagctacctgggccactaacatacaagtggcgatcaatcaggttagacggctgattggtaacgagaattatctcgattacatgacatcgatgaaaaggtttaagaacgaatccgaccctgagggcgctctttggtga

SEQ ID NO: 13900 - RNA, 9879 nt, synthetic construct
  misc_feature 1..9879: note = derived and/or modified CDS sequence (opt3) from DENV-1__GU131726__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggagaactgtgtgaagataccatgacctacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggctcgttcaaactggagaaggaagtggctgagacccagcacggtacggtccttgtgcagataaagtacgagggcacagacgcgccttgcaaaatcccattctcgacccaagatgaaaagggggcaactcagaacggacgcttgattacagccaatcccatcgttaccgacaaagagaagcctgtgaacatagaagctgagccaccctttggcgagtcttatattgtaatcggtgccggggaaaaagcactgaagctctcctggttcaagaaaggctcaagtatcggaaagatgtttgaggccactgctagaggcgccaggcggatggcaattctgggggataccgcgtgggacttcggaagcgtcggtggcgtgtttacatccgttgggaaacttgtgcatcagatcttcggaacggcttacggcgtcctgttttctggtgtgagctggaccatgaagattgggataggcgtattgctcacttggctgggattaaattcacgaagtacatccctgagcatgacctgtatcgccgtgggcctagttacactctacctgggggtcatggtgcaggcagattctggatgcgtgattaactggaaaggccgcgaacttaagtgtggttcagggatcttcgtcactaatgaggttcacacctggacggaacaatataagtttcaggccgacagtccgaaaagattgagcgctgccatcggaaaggcatgggaggagggcgtgtgcggtattaggtccgctacacggctggaaaacataatgtggaaacagatctctaacgagctcaatcatattctgttagaaaacgacatgaagttcaccgtggtagtcggcgatgtggttgggatcctggcccagggcaaaaagatgattcgccctcaacccatggagcacaaatactcgtggaaaagctggggcaaggcgaagatcataggggccgacgtgcagaatactacctttatcattgatggaccaaacacacctgaatgtcccgacgatcagagagcttggaatatctgggaggtcgaggactatggcttcggtatttttgcaactaacatctggcttaagttgagggattcctacacccaggtgtgcgaccaccgtctcatgtcagccgctataaaagatagtaaggccgttcatgcagacatggggtattggattgaatctgagaaaaatgaaacatggaagctggcgcgggccagcttcatcgaggtgaagacgtgtatttggccaaaatcccacaccctatggtcaaacggagtactggaaagcgagatgatcatacccaagatctacggcggtcctatttctcaacataattatcgaccaggctacttcactcagacagctgggccgtggcacctcggaaaactggagcttgattttgacttgtgcgaaggcaccactgtcgtggtggatgagcactgcgggaacagaggaccctccctgaggacaaccacggtcactggcaagatcattcatgaatggtgttgccgcagttgtaccttacctccactccggttcaaaggtgaggacgggtgctggtacggaatggagatcagacccgttaaggaaaaggaggaaaatctggtgaaaagcatggtatctgccggctccggtgaggtggactcatttagtcttggcctgttgtgtataagcattatgatcgaagaggtcatgaggtcgcgctggtcccgaaagatgctcatgacagggaccctggcagtgttcctactgctcatcatgggacagctgacttggaacgatcttattcggttgtgcatcatggttggcgctaatgcctctgaccgtatggggatgggaacaacctatctggcattaatggccacatttaaaatgagacctatgttcgctgtgggcctcctgcttaggcgcctgactagccgggaggtcctactcctgaccattggtttgtcactggtggcgagtgttgaattaccaaactccctcgaggaactgggggatggacttgccatgggcataatgatcctgaagttgctcacggactttcaatctcaccagctgtgggcaacactactgagccttaccttcattaaaactaccctctccctgcattacgcttggaagacaatggccatggtgttgtcaatcgtcagcctgtttcccttatgtctcagtactacctctcagaagacgacatggctgccggtacttctgggctccttcgggtgcaaacctttgaccatgtttctcattactgagaataagatctggggaagaaaaagctggccactgaacgaaggtataatggccgtgggcgttgtgtcgatcctactgtcatctcttctcaagaacgatgtccccctggctgggcctttgattgcaggaggcatgttaatcgcctgttatgtgattagtggttccagccccgacctgtctctcgagaaagcggctgaggtaagctgggaagaggaagccgagcactccggggcatcacataatatcctggtggaagtccaggatgacggaacaatgaagataaaagatgaggagagggacgatacccttactattctgttgaaggccacactactggctgttagtggcgtgtacccactcagcatccctgcaaccctgttcgtgtggtatttttggcaaaagaaaaagcagcgatctggcgtcctttgggacacgccctccccaccggaagtggagcgcgccgttttagatgacgggatctaccggattatgcagagaggactgctcggtaggtcacaggtaggcgtgggggtcttccaagaaaacgtgttccacactatgtggcacgttacccgtggagcggtgttgatgtatcagggcaaacgcctggagcctagttgggctagcgtcaagaaagacctcatatcctacggtgggggatggcggctgcagggctcttggaatacaggcgaggaagtgcaggtaatcgccgtcgagcccgggaagaacccaaagaatgtgcaaaccgcacccggaacatttaaaactcctgaaggtgaggttggcgccattgctcttgatttcaagccagggacctcgggaagccccatcgtgaacagagaaggcaaaattgtcggtctgtacgggaatggagtggttacgacatcaggcacttatgtgtccgccatcgcacaggctaaggccagtcaggagggccctttgccggagatagaagacgaggtctttaggaaacgaaacctaaccatcatggatctgcatccagggtctggaaagacacggcgctacctccccgcgattgtgagagaagccatcaagaggaaattacggaccctgattcttgcacctactcgagtagtggctagcgagatggccgaagctctgaagggtatgccaatcagatatcaaaccacagcagttaaatccgagcacacgggcaaggagatagtcgacctcatgtgccatgccactttcaccatgcgcttgctgtcacccgtgagggtgcctaattacaacatgattatcatggatgaagcccactttacagacccgtctagcatcgctgcgcgtgggtatattagtacccgggtcggaatgggcgaggcagccgctatcttcatgactgccacacccccaggttccgtagaagcatttcctcagagcaatgccgtgatacaggatgaggaaagagacattcccgagaggtcttggaactcagggtacgagtggatcaccgatttcccaggaaaaacggtttggtttgtgccttccattaagagtggcaatgacatcgctaactgtctccgcaagaatggcaaacgagtcatacagctgagcagaaagactttcgatacagaatatcagaaaaccaagaacaacgactgggactacgtggttaccactgatatttcggagatgggggcgaattttcgggccgacagggtgatcgatccccgccgttgccttaaaccagtcatcctaaaggacggaccggaaagagtgattctggcaggtcctatgcccgtaacagtggcttctgccgcacagcggaggggccgcatcgggcgaaaccataataaggagggagatcagtacatttatatgggccagccattgaacaatgacgaggatcacgcccactggaccgaagctaaaatgttactggacaacataaatacacccgagggtatcattcctgccctcttcgaaccagagagagaaaagtccgcggcaatcgatggggagtaccggctgaggggcgaggcccgcaaaactttcgttgaacttatgagaaggggagacctgcccgtctggctcagctataaggtggcttcagagggctttcaatacagtgatcggcgttggtgcttcgacggggaacgcaacaatcaggtgttggaggaaaacatggatgtcgagatctggacgaaagagggagaacgaaagaaactgagacctaggtggctagacgcccggacctattctgacccgctggctctccgcgagtttaaggagttcgcagccggtagaaggtccgttagcggcgatcttattctggagatagggaagttaccacagcatttgacacagcgggctcaaaatgccctggacaacctcgtgatgctgcacaattcagaacagggaggccgagcatacagacatgcgatggaggagcttcccgatactatcgaaaccctgatgctcttggccctgattgctgtattaacaggtggggtgaccctatttttcctgagtggccgcggactcggcaaaactagcatcgggcttctgtgtgtcatggcctcctctgtgttgctgtggatggcaagcgttgagcctcactggattgctgcctccatcatactcgaatttttcctgatggtgcttctcatccccgagccagacaggcagcggacgcctcaggataaccaactggcatatgtcgtaattggattgctgtttatgatcttaaccgtggccgctaatgagatgggtctactggaaacaactaagaaagacctcggcattgggcacgttgcggtggagaaccatcaccatgccaccatgcttgatgtcgacctgcaccccgcatcagcttggacattgtacgccgtggccaccactatcataacaccaatgatgcgtcatacgattgaaaacaccactgcaaatatctctctgacagctattgccaaccaggcggctatcctcatgggactggataagggctggcctataagtaaaatggacatcggtgtcccgcttttagccctggggtgctacagccaggtgaatcccctcaccttgaccgcagccgttctgatgctagtggctcactatgcaattatcggcccaggactgcaagccaaggcgacaagagaggctcagaagaggactgccgcaggcattatgaaaaaccctacggtagatgggatcgtggccatagacctcgatcccgtcgtttacgacgctaagttcgaaaaacagcttggacagattatgctgttgatcctgtgtaccagccaaatcctcctgatgcgcacaacttgggccttatgcgagtccattacccttgcaacaggcccactgaccactctctgggagggttctcctgggaagttttggaatacgacaatcgctgtgtcaatggccaacatattccggggaagctatctagcgggcgccggtctggcattttccttgatgaaaagtctgggcgggggacgaagaggcaccggggctcagggagaaactctcggcgagaagtggaagaggcagcttaatcagctgtctaaaagcgagttcaacatttacaagcgctcaggtatcatggaggtcgaccggtccgaagccaaagaggggttgaagagaggagagaccacacgtcacgcagtgagtaggggcactgctaaactgcggtggttcgtagaacgcaatctcgtgaagcccgagggtaaggttattgatttaggctgtgggcgaggaggctggagctattactgcgccgggctgaaaaaggtgaccgaagtcaaaggatatacaaagggcggtccggggcatgaggaaccaatccctatggccacgtacggatggaaccttgtgaaactgcactctggcaaggacgtctttttcacacccccagagaaatgtgatactctactctgcgacataggcgagtcctcacccaatcctacaatcgaagaggggagaaccctgagggtgttgaagatggttgaaccgtggctgcggggaaaccaattttgtattaagatcctcaatccctacatgccaagcgtagtggagactcttgagcagatgcagcgcaaacatggtggcatgctggtcagaaaccctttatcgagaaattctacacacgaaatgtattgggtgagttgcgggaccggaaacattgtttccgcggtgaatatgacgagccgaatgctgttgaaccggttcaccatggctcaccgtaagcccacatacgagagagatgtcgacctcggcgcaggtactcgccatgtggccgtagaacctgaggtggctaacctggatatcattgggcagaggatcgaaaatataaaacacgagcataagtcaacctggcactatgacgaggataacccatacaaaacatgggcctatcatggatcctacgaagttaagccctctggcagcgcaagttccatggtcaatggcgtggtgaagctacttactaaaccttgggacgtcattccaatggttacccaaatcgccatgacagataccactccctttgggcagcagcgggtgttcaaggagaaagtagacacgagaacaccgaaggctaaacgcggaaccgcgcaaatcatggaagtgactgccaggtggctgtggggttttctcagccgaaacaagaagcctcggatttgtaccagagaggagttcacaaggaaagtccgctctaatgcagctataggcgccgtgtttgttgacgagaaccagtggaactcagcaaaggaggccgtggaagatgagcgtttctgggacctggtccagaaagaacgggagttgcacaagcaggggaaatgcgctacgtgcgtgtataacatgatgggaaagagagaaaagaaactgggcgagtttggtaaggccaaagggagtagggcgatctggtacatgtggctcggagcacgcttccttgagtttgaagccctgggcttcatgaatgaggatcactggttctcccgagaaaacagcttatctggcgtagagggggagggactgcataagttgggttacattctccgggacatctcgaaaattccaggcgggaatatgtatgctgatgacaccgccggatgggatactagaatcacagaagacgatctgcaaaacgaggcaaagataaccgacatcatggaacccgagcacgctctacttgccacttcaatttttaaactgacataccagaataaggttgtgagggtccagcgccctgctaagaacggcaccgtgatggatgtgatcagcagacgggaccagaggggttccgggcaagtcggaacatatggcctcaatactttcaccaacatggaagcccagctgattcgtcagatggagagtgagggcatctttttgccatctgaattagagacgcccaacctggcagaacgagttctcgattggcttgagaaatacggggtggaacgcctgaagagaatggcgataagcggagacgactgtgtagtgaaaccgattgatgaccggttcgccaccgctctaacagccctgaatgatatgggtaaggtcaggaaagacatccctcagtgggagccctccaagggctggaacgattggcaacaggtgccattttgctcacatcacttccaccagctcatcatgaaggacgggcgcgagattgttgtgccttgtagaaatcaggatgaattggtcggacgggcaagggtgagtcaaggcgctggttggtctctgcgagagactgcctgccttgggaaaagctatgcacagatgtggcagctgatgtactttcatcgtagagacctccgcttagccgcgaacgctatatgttccgccgtacccatcgattgggttccaacctcacggacaacttggagcattcacgcacatcaccaatggatgaccacggaagacatgctgtctgtgtggaatagggtctggatcgaggaaaacccctggatggaggataagacacatgtgtccagttggggagacgttccttatttgggcaaaagagaggaccagtggtgcggcagcctgattgggctcaccgcccgcgctacttgggcctcgaatatccaggtggcaataaaccaggtccggaggcttatcggaaatgaaaactacctggattacatgacatccatgaagcgattcaaaaatgagggtgacccagaaggcgctctatggtga

SEQ ID NO: 13901 - RNA, 9879 nt, synthetic construct
  misc_feature 1..9879: note = derived and/or modified CDS sequence (opt3) from DENV-1__GU131727__SS-prME
  source 1..9879: mol_type = other RNA
agcgtgaccatgctgctcatgcttatgcccaccgccctggctttccacttgactacgaggggaggggagcctcatatgatcgtaaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgtcagcttgttccccctgtgtttaagtaccacgtctcagaagacaacctggctcccggtgctgcttggctccctggggtgcaaacctttgactatgtatctcattacagagaataagatctggggaagaaaaagctggccactgaacgaaggtataatggctgttggcgtggtctcgatcctactgtcatctcttctcaagaacgatgtgcccctggccgggcctttgattgccggaggcatgttaatcgcttgttacgtaattagtggttccagcgcagacctgtctctcgagaaagccgcggaggtgagctgggaagaggaagctgagcactccggggcctcacataatatcctggtcgaagttcaggatgacggaaccatgaagataaaagatgaggagagggacgatactcttacaattctgttgaaggcaaccctactggccgtgagtggcgtgtatcccctcagcatcccagctacgctgtttgtctggtacttctggcaaaagaaaaagcagcgatctggcgtgctttgggacactccttcacccccagaagttgagcgcgcagtattagatgacgggatctatcggattatgcagagaggactgctcggtaggagccaggtgggcgtcggggtgtttcaagaaaacgttttccacaccatgtggcacgtgacacgtggagccgtcttgatgtaccagggcaaacgcctggagccgagttgggcgagcgtgaagaaagacctcatatcctacggtgggggatggcggctgcagggctcttggaataccggcgaggaagtacaggtcatcgctgtggagcctgggaagaaccccaagaatgttcaaacagccccaggaactttcaaaacccccgaaggtgaggtgggcgcaattgcccttgattttaagcctgggacgtcgggaagcccaatcgtcaacagagaaggcaaaattgtgggtctgtatgggaatggagttgtgacaacttcaggcacctacgtctccgctatcgcccaggcaaaggctagtcaggagggccccttgcctgagatagaagacgaggtgttcaggaaacgaaacctaacaatcatggatctgcatccggggtctggaaagacccggcgctatctcccagccattgtaagagaagcgatcaagaggaaattacggactctgattcttgcccccacccgagtggttgcaagcgagatggctgaagccctgaagggtatgcctatcagataccaaacaacggctgtcaaatccgagcacactggcaaggagatagtggacctcatgtgccatgcaacctttacaatgcgcttgctgtcaccagtgagggtccccaattataacatgattatcatggatgaagcccacttcaccgacccttctagcatcgccgctcgtgggtacattagtactcgggtaggaatgggcgaggcggcagccatctttatgacagctaccccgcccggttccgtggaagccttcccacagagcaatgcagttatacaggatgaggaaagagacattcctgagaggtcttggaactcagggtatgagtggatcacggattttcccggaaaaactgtgtggttcgtcccatccattaagagtggcaatgacatcgccaactgtctccgcaagaatggcaaacgagtgatacagctgagcagaaagacatttgataccgaataccagaaaaccaagaacaacgactgggactacgttgtgactacagatatttcggagatgggggctaatttccgggcggacagggtcatcgatcctcgccgttgccttaaacccgtgatcctaaaggacggaccagaaagagtaattctggccggtccgatgcctgtgaccgttgcatctgctgcccagcggaggggccgcatcgggcgaaaccataataaggagggagatcagtatatttacatgggccagcccttgaacaatgacgaggatcacgcacactggacagaagccaaaatgttactggacaacataaatactccagagggtatcattcccgctctctttgaacctgagagagaaaagtccgccgcgatcgatggggagtatcggctgaggggcgaggcacgcaaaacgttcgtcgaacttatgagaaggggagacctgccagtgtggctcagctacaaggtggcctcagagggcttccaatatagtgatcggcgttggtgctttgacggggaacgcaacaatcaggtcttggaggaaaacatggatgttgagatctggaccaaagagggagaacgaaagaaactgagacccaggtggctagacgctcggacatactctgaccctctggccctccgcgagttcaaggaatttgctgcaggtagaaggtccgtgagcggcgatcttattctggagatagggaagttaccgcagcatttgactcagcgggcccaaaatgctctggacaacctcgtaatgctgcacaattcagaacagggaggccgagcctatagacatgcaatggaggagcttccagataccatcgaaacactgatgctcttggcgctgattgccgtgttaaccggtggggtcactctattctttctgagtggccgcggactcggcaaaacgagcatcgggcttctgtgtgtgatggcttcctctgttttgctgtggatggccagcgtggagccccactggattgcagcttccatcatactcgagttctttctgatggtccttctcatccctgagcccgacaggcagcggaccccacaggataaccaactggcctacgtagtgattggattgctgttcatgatcttaacagttgcagccaatgagatgggtctactggaaactaccaagaaagacctcggcattgggcacgtggctgtcgagaaccatcaccatgcgacaatgcttgatgtggacctgcaccctgcctcagcatggaccttgtacgctgtcgccactacaatcataacgcccatgatgcgtcataccattgaaaacactacagccaatatctctctgaccgcaattgctaaccaggccgcgatcctcatgggactggataagggctggccaataagtaaaatggacatcggtgtgcctcttttagctctggggtgctattcgcaggttaatccgctcaccttgacagccgcagtgctgatgctagtagcccactacgctattatcggccccggactgcaagcaaaggccactagagaggcgcagaagaggacggctgccggcattatgaaaaacccaaccgtggatgggatcgtcgcaatagacctcgatcctgttgtgtatgacgccaagtttgaaaaacagcttggacagattatgctgttgatcctgtgtacaagccaaatcctcctgatgcgcactacctgggctttatgcgagtccattacacttgccaccggccccctgactacgctctgggagggttctccagggaagttctggaatacaaccatcgcagtctcaatggctaacatatttcggggaagctacctagccggcgcgggtctggccttctccttgatgaaaagtctgggcgggggacgaagaggcactggggcacagggagaaaccctcggcgagaagtggaagaggcagcttaatcagctgtctaaaagcgaatttaacatttataagcgctcaggtatcatggaggtggaccggtccgaagctaaagaggggttgaagagaggagagacaactcgtcacgccgtaagtaggggcaccgcaaaactgcggtggttcgtggaacgcaatctcgttaagcctgagggtaaggtgattgatttaggctgtgggcgaggaggctggagctactattgcgctgggctgaaaaaggtcacagaagtgaaaggatacacgaagggcggtcccgggcatgaggaaccgatcccaatggccacctacggatggaaccttgtcaaactgcactctggcaaggacgtgttctttactcctcccgagaaatgtgatacactactctgcgacataggcgagtcctcaccaaatcccaccatcgaagaggggagaactctgagggttttgaagatggtagaaccttggctgcggggaaaccaattctgtattaagatcctcaatccgtatatgcccagcgtggtcgagacacttgagcagatgcagcgcaaacatggtggcatgctggtgagaaacccattatcgagaaattctacccacgaaatgtactgggttagttgcgggacgggaaacattgtgtccgccgtcaatatgaccagccgaatgctgttgaaccggtttacaatggcgcaccgtaagcctacttatgagagagatgtggacctcggcgctggtacccgccatgtagcagtggaacccgaggttgccaacctggatatcattgggcagaggatcgaaaatataaaacacgagcataagtcaacatggcactacgacgaggataacccttataaaacttgggcttaccatggatcctatgaagtcaagccatctggcagcgccagttccatggtgaatggcgtggtcaagctacttaccaaaccctgggacgttattcctatggtgacacaaatcgcaatgaccgatactacgccattcgggcagcagcgggtatttaaggagaaagtggacacaagaacccccaaggccaaacgcggaactgctcaaatcatggaagtcaccgcgaggtggctgtggggtttcctcagccgaaacaagaagccgcggatttgtacaagagaggaatttacgaggaaagtgcgctctaatgccgcaataggcgctgttttcgtggacgagaaccagtggaactcagccaaggaggcagtcgaagatgagcgtttttgggacctggtgcagaaagaacgggagttgcacaagcaggggaaatgcgcaacctgcgtatacaacatgatgggaaagagagaaaagaaactgggcgagttcggtaaggctaaagggagtagggccatctggtacatgtggctcggagcgcgctttcttgagttcgaagcactgggctttatgaatgaggatcactggttctcccgagaaaacagcttatctggcgttgagggggagggactgcataagttgggttatattctccgggacatctcgaaaattcctggcgggaatatgtacgccgatgacactgctggatgggatacaagaatcaccgaagacgatctgcaaaacgaggccaagataactgacatcatggaaccagagcacgcactacttgctacatcaattttcaaactgacctatcagaataaggtggtcagggtgcagcgccccgccaagaacggcacagtgatggatgtcatcagcagacgggaccagaggggttccgggcaagttggaacttacggcctcaatacctttacgaacatggaagctcagctgattcgtcagatggagagtgagggcatcttcttgccttctgaattagagaccccaaacctggccgaacgagtgctcgattggcttgagaaatatggggtagaacgcctgaagagaatggcaataagcggagacgactgtgtggtcaaacccattgatgaccggtttgcgacagccctaactgctctgaatgatatgggtaaggtgaggaaagacatcccgcagtgggagccttccaagggctggaacgattggcaacaggttcccttctgctcacatcactttcaccagctcatcatgaaggacgggcgcgagattgtggtcccatgtagaaatcaggatgaattggtgggacgggccagggtaagtcaaggcgcaggttggtctctgcgagagaccgcttgccttgggaaaagctacgcccagatgtggcagctgatgtatttccatcgtagagacctccgcttagcagccaacgcgatatgttccgctgttcctgtggattgggtccccacatcacggactacctggagcatccacgcccatcaccaatggatgacgacagaagacatgctgtctgtgtggaatagggtttggattgaggaaaacccatggatggaggataagacccatgtgtccagttggggagacgtcccctacttgggcaaaagagaggaccagtggtgcggcagcctgatcgggctcactgcacgcgccacatgggcttcgaatattcaggtggccatcaaccaggtacggaggcttataggaaatgaaaactacctggattatatgacctccatgaagcgatttaaaaatgagggtgaccctgaaggcgcactatggtga

SEQ ID NO: 13902 - RNA, 9879 nt, synthetic construct
  misc_feature 1..9879: note = derived and/or modified CDS sequence (opt3) from DENV-1__HM631850__SS-prME
  source 1..9879: mol_type = other RNA
agcgtgaccatgctgctaatgcttatgcccacagcactggctttccacttgactacgagaggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcaccccacaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctcccgacctgagcttggagaaggcggctgaggtgtcctgggaagaggaagccgagcattcaggggcaagtcacaatatattagtagaagtgcaggatgacggaacaatgaaaattaaggatgaggagagggacgataccctgactatcctcctgaaggccacacttctggctgtcagcggcgtttatccattgtctatccctgcaaccctattcgtgtggtacttttggcagaaaaagaaacaacgatccggcgtgctgtgggacacgccctcaccaccggaagtcgagcgcgccgtgctcgatgacgggatttatcggataatgcagagaggactgcttggtaggagtcaggttggcgtaggggtgttccaggaaaacgtctttcatactatgtggcacgtgacccgtggagcggttttaatgtaccaaggcaagcgcctggagcctagctgggcttccgtgaaaaaggacctcatctcttacggtgggggatggcggttgcagggctcgtggaatacaggcgaggaagtccaggtgattgccgtagagcccgggaagaaccccaagaatgtccagaccgcacccggaacattcaagactagcgaaggtgaggtgggcgccatcgctctggattttaaacctgggacctcaggatccccaattgttaacagagaaggcaagatcgtgggtctctatgggaatggagtcgtgacgacaagtggcacttacgtttctgccatagcacaagctaaagccagccaggagggccccctgcctgagatcgaagacgaggtgttcaggaagcgaaaccttaccattatggatctgcacccggggtccggaaagacacggcgctatttgccagcgatcgtcagagaagccattaaaaggaagctacggaccctgatcctcgcacccactcgagtggtagcttcagagatggccgaggctttaaaaggtatgcctataagataccagaccacagcagtgaagtctgagcatacgggcaaagagattgttgacctgatgtgccacgccacttttaccatgcgccttctgagcccagtcagggtgcccaattataacatgatcatcatggatgaagcccatttcacagaccctagttccattgctgcgcgtgggtacatcagcacccgggtgggaatgggcgaggcagccgctatatttatgactgccacaccgcccggttctgtcgaagcattcccacaatcaaatgccgtaattcaggatgaggaaagagacatccctgagaggtcctggaacagtgggtatgagtggattaccgattttcccggaaagacggtgtggttcgttccaagcatcaagtcgggcaatgacatagctaactgtctccgcaaaaatggcaagcgagtgattcagttgtctagaaaaactttcgatacagaataccagaagaccaaaaacaacgactgggactacgtcgtgaccactgatatctccgagatgggggcgaattttcgggccgacagggttatcgatcctcgccgttgcctgaagcccgtgattctcaaggacggaccagaaagagtcatcctggcaggtccgatgcctgtgacagtagctagcgccgcacaacggaggggccgcattgggcgaaaccacaataaagagggagatcagtatatatacatgggccagccccttaacaatgacgaggatcatgcccactggaccgaagctaagatgctactggacaacatcaatacaccagagggtattatccccgccttgttcgaacctgagagagaaaaatcagcggcaatcgatggggagtatcggttaaggggcgaggcccgcaagacttttgtggaactgatgagaaggggagacctcccagtttggctgagttacaaagtcgcttctgagggcttccagtattccgatcggcgttggtgctttgacggggaacgcaacaatcaagtgcttgaggaaaacatggatgtggagatttggacgaaggagggagaacgaaagaaactgagacccaggtggctcgacgcccggacctacagcgaccctttggctctgcgcgagttcaaagaatttgcagccggtagaaggtcagtcagtggcgatctaatactggagatcgggaaactcccgcagcaccttacacagaaggctcagaatgccctggacaacttagttatgttgcataatagcgaacaaggaggccgggcatatcgacacgcgatggaggagctgccagatactattgaaaccctcatgctgcttgccctgatcgctgtgctcacaggtggggtaaccttgttctttctgtccggcagaggattaggcaaaacttctattgggctactgtgtgtgatggccagctccgtcctcctttggatggcatcagtggagccccattggatcgctgcctctataatcctggagttctttttgatggttctgctcattcctgagcccgaccgccagaggacgccacaggataaccagctggcatacgtggtcatcggacttctcttcatgattctgaccgtagccgctaatgagatgggtttgctggaaacaactaagaaagacttaggcatcgggcacgtggcggttgagaaccaccatcacgccgcaatgctagatgtggacctgcatcctgctagtgcctggaccctctacgccgtcgcaacaaccataattactcccatgatgcggcacacaatcgaaaacacgaccgctaatatttcgcttactgccatcgcgaaccaagctgccatactgatgggattggataagggctggccaatcagcaagatggacattggtgtgcctctgctcgcactggggtgctattcccaggtcaatccgcttacattaaccgccgctgtgctgatgctcgttgcacattacgccatcattggccccggattgcaggcgaaagctacccgtgaggcccaaaagagaacagcagccggcatcatgaaaaacccaactgtggatgggatagtagctattgacctggatcctgtggtctatgacgccaagtttgaaaaacagctaggacagatcatgctgctcatcctttgtacgtctcagattctgttgatgaggaccacatgggcactgtgcgagtcaatcactctcgctaccggccccctgacaaccttatgggagggtagcccagggaagttctggaatactacgatagccgtttccatggcgaacattttccgcggaagttaccttgccggcgcaggtctggctttttctctcatgaaaagcctaggcgggggacggcgaggcacaggggcccaaggagaaaccctgggcgagaaatggaagagacagttgaatcagctgtcaaaatccgagttcaacacttataagaggagtggtatcatggaggtggaccgcagcgaagcaaaagaggggctcaagcggggagagaccacaaagcacgctgtctctagaggcactgccaaacttcgttggtttgtggaaaggaatctggtaaagcctgagggtaaagtgattgatttgggctgtgggcggggaggctggtcctactattgcgccgggctgaagaaagttaccgaagtgaagggatacacaaaaggcggtcccgggcacgaggaaccgatcccaatggcgacgtacggatggaacctcgtcaagttacattcaggcaaggacgtgttctttatacctcccgagaaatgtgataccctgctttgcgacatcggcgagagctcgccaaatcccactattgaagaggggcgcacactgcgagtcctaaagatggtggaaccttggctcagaggaaaccagttctgtatcaaaattctgaatccgtatatgccctctgttgtagagaccttggagcaaatgcagaggaagcacggtggcatgctggtgcggaacccactcagtcgcaattccactcatgaaatgtactgggtcagctgcgggacaggaaacatcgtgtcagctgttaatatgacctccagaatgcttctgaacaggtttacgatggcacaccgaaaacctacctatgagcgggatgtggacttaggcgccggtacacgtcacgtcgctgtggaacccgaggtagccaacctggatattatcgggcagagaatagaaaatattaagcatgagcacaagtctacttggcattacgacgaggataacccttataaaacctgggcataccacggaagctatgaagtgaagccaagtggctccgccagctctatggttaatggcgtcgtgaaattgctcacaaagccctgggacgtgatccctatggtcactcagatcgctatgaccgatacaaccccattcgggcaacagcgcgtttttaaagagaaggtggacactaggacgcccaaggcgaaacggggaacagcccagattatggaagtaaccgcaaagtggctgtggggtttcctatcaagaaacaaaaagccgcgcatatgtactagggaggaatttacccgaaaagtgcggagtaatgctgccatcggcgcagtcttcgtggacgagaaccaatggaactccgccaaggaggctgttgaagatgagagattttgggaccttgtgcatagggaacgcgagctgcacaagcaggggaaatgcgccacatgcgtctacaacatgatgggaaagcgtgagaaaaagctcggcgagttcggtaaagcgaaggggagccgggcaatttggtacatgtggctgggagccagattcttggagtttgaagctctgggcttcatgaatgaggatcactggttttctagggaaaactcgctctcaggcgtggagggggagggacttcataaactgggttatatcttacgcgacattagcaagatccctggcgggaatatgtacgccgatgacacggcaggatgggatacccgaataactgaagacgatctgcagaacgaggctaagatcacagacattatggaaccagagcacgccttgctcgctaaatccatcttcaagctgacctatcagaataaagtagttcgggtgcaaagacccgccaagaacggcactgtcatggatgtgattagtaggcgcgaccagagaggttctggacaggtgggaacatacggcctaaatacctttacaaacatggaagcacagcttatccggcaaatggagagcgagggcatattctccccttcagaactggagactccaaacctcgcggggagggtcctggattggttggaaaaacatggagttgagcgtttaaagcgaatggccattagtggtgacgactgtgtggtaaagcccatcgatgaccgctttgctaccgccctgacggcactcaatgatatgggcaaagtgagaaaggacatcccgcagtgggaaccttctaaagggtggaacgattggcagcaggtccccttctgcagccaccactttcatcaacttattatgaaggacggacgggagatagtggttccatgtaggaatcaggatgagctggtgggccgcgctagagtctcccagggtgccgggtggtcactacgggaaaccgcatgcctgggaaaaagctatgcccagatgtggcaactcatgtacttccacaggcgagacttgcgtctggcggctaacgccatctgttctgcagtgcctgtagattgggttcccacatccagaactacctggagtattcatgcccaccatcagtggatgacaactgaggacatgcttagcgtgtggaatcgcgtctggatcgaagagaacccatggatggaagataagacccacatttcgaattggggcgacgtgccctatctgggcaagcgggaggaccagtggtgcgggtccctcatcggattaacggctagggccacatgggcaaccaacatacaagttgctatcaatcaggtgagacgcctgattggtaacgagaattacttggattacatgacttctatgaaacggtttaagaacgaatcagaccctgagggcgccctgtggtga

SEQ ID NO: 13903 - RNA, 9879 nt, synthetic construct
  misc_feature 1..9879: note = derived and/or modified CDS sequence (opt3) from DENV-1__KF955446__SS-prME
  source 1..9879: mol_type = other RNA
agcgtgaccatgttcctgatgctcatgcccacagcccttgcttttcacctgactacgaggggaggggaacctcatatgatcgtctccaagcaggaaaggggaaaatctttgttattcaagacctcagccggtgttaatatgtgcacactgattgccatggacctaggcgaactctgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctctggcaccccatgtcggccttggtctggagaccagaacagaaacttggatgtcctctgagggggcatggaaacagatccagagggtggaaacctgggccttgcggcaccctggatttacagttattgctctcttcctggcacatgccatcggcacctcgattacgcagaagggcatcatatttatcctgctcatgttagtgactccatcaatggctatgcgctgcgtcgggattggaagccgggatttcgtggagggtctgagtggcgccacatgggtagacgttgtgcttgagcacgggtcctgtgtcaccactatggcgaaggataaacccacattggacatcgaactgctaaagaccgaggtgacgaaccctgcagtgctcaggaaactgtgcattgaagccaagatctctaataccacaactgatagccggtgtccaacccaaggagaggctacacttgtcgaagaacaggacgccaactttgtttgccgccgaactttcgtggatagaggctggggtaatgggtgtggactgtttggcaaaggctccttgataacctgcgcaaagttcaagtgcgtaacaaaactcgaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagttaactgactacggggcgctgacactcgattgtagcccaaggacgggacttgactttaacgaaatggtcctgttgaccatgaaggagaaatcttggctagtgcataagcagtggttcctggatctcccgctgccctggacttccggcgcctcaacaagccaagagacctggaatcggcaggaccttctggtaacatttaaaactgcacacgctaagaagcaggaagttgtggtcttgggtagtcaagagggggccatgcacaccgctctcacgggcgccaccgaaatccagacatctggaactaccacaattttcgcaggccatctgaaatgccgtttaaagatggataaactgactctaaaggggatgtcctatgtgatgtgtaccggtagcttcaaactcgagaaggaactggccgagacgcagcacggaacagtccttgtgcagataaagtacgagggcaccgacgctccttgcaaaatcccattttcgactcaagatgaaaagggggttacacagaacggacgcttgattaccgcgaatcccatcgtgactgacaaagagaagcctgtaaacatagaagcagagccacccttcggcgagtcttatattgtcatcggtgccggggaaaaagctctgaagctctcctggtttaagaaaggctcaagtatcggaaagatgttcgaggccaccgcaagaggcgccaggcggatggctattctgggggatacagcctgggactttggaagcatcggtggcgtgttcacgtccgttgggaaacttgtgcatcagatttttggaaccgcatacggcgtcctgttctctggtgtgagctggactatgaagatagggatcggcgtattgctcacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatctttgtcaccaatgaggttcacacgtggacagaacaatataagttccaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagtttactgtggtagtcggcgatgtggcagggattctggctcagggcaagaagatgatccgccctcaacccatggagtacaaatattcgtggaaaagctggggcaaggccaagataatcggggcggacgttcagaataccacattcattatcgatggaccaaacactcctgaatgtcccgacgatcagagagcctggaatatttgggaggtggaggactacggctttggtatcttcaccacaaacatatggcttaagttgagggattcctatacgcaggtctgcgaccaccgtctcatgtcagctgcaattaaagatagtaaggccgtgcacgctgacatggggtactggatcgaatctgagaaaaatgaaacctggaagctggcccgggcctccttcattgaggttaagacttgtatctggccaaaatcccatacactatggtcaaacggagtgctggaaagcgagatgataatccccaagatttatggcggtcctatctctcaacacaattaccgaccaggctactttacccagactgcggggccgtggcatctcggaaaactggagcttgatttcgacttgtgcgaaggcacaaccgtagtcgtggatgagcactgcgggaacagaggaccctccctgaggacgactaccgtgacaggcaagattatccacgaatggtgttgccgcagttgtaccttacctccactccggtttagaggtgaggacgggtgctggtatggaatggagataaggcccgtcaaagaaaaggaggaaaatctggttaagagcatggtgtctgccggctccggtgaggtagactcattcagtcttggcctgttgtgtattagcatcatgatcgaagaggtgatgcgctcgcgatggtcccggaaaatgctcatgactgggacactggctgtctttttcctactgattatgggacagctcacctggaacgatctgatccgtctttgcattatggtgggcgccaatgcatctgacagaatggggatgggaacaacttacttggctctgatggccacctttaagatgaggcctatgttcgcagttggcttactctttcgccggctgacgagcagagaggtgcttctgctaacaataggtctctcactggtcgccagtgtggaattgccaaactccctggaggaattaggggatggactcgctatgggcatcatgattctgaaacttctgaccgacttccaatctcatcagttgtgggcgactctcctgagcctaacctttatcaagacaactttctccctgcactatgcctggaaaaccatggcaatggttctttcaattgtgagcctctttcccctgtgtttgagtacgacatctcagaagaccacttggctgccggtcttactcggctccctggggtgcaagcctcttacaatgttcctgatcgctgagaataaaatatggggaaggcgaagctggccattgaacgaaggtatcatggccgtaggcattgtgtcgatcctcctgtcatctctactgaagaacgatgttccccttgccgggcctctcattgctggaggcatgctgatcgcatgttacgtgataagtggttccagcgccgacttgtctttagagaaagcggctgaggtcagctgggaagaggaagccgagcattccggggcatcacacaatattctggtggaagtacaggatgacggaaccatgaagatcaaagatgaggagcgcgacgatactctcacaatcctgcttaaggccaccctgttggctgtgagtggcgtctatcccctaagcattccagcaacgctgttcgtttggtacttttggcagaaaaagaagcagcggtctggcgtgctctgggacactccttcacccccagaagtggagagagccgtcctggatgacgggatatataggatcatgcagcgtggacttttaggtcgcagccaggtgggcgttggggtattccaagaaaacgtgtttcataccatgtggcacgtcacacggggagcggtgctgatgtaccagggcaaaagactcgagccgagttgggctagcgttaagaaagacttgatttcctacggtgggggatggaggctgcagggctcttggaataccggcgaggaagtgcaggtcatcgccgtggagcctgggaagaaccccaaaaatgtacaaacagcaccaggaactttcaagacccccgaaggtgaggtcggcgccattgctctcgattttaagcctgggacgtcgggaagcccaatcgtgaaccgagaaggcaaaatagttggtctgtatgggaatggagtggtcacaacttcaggcacctacgtgtccgccatcgcacaggctcgggccagtcaggagggcccccttcctgagattgaagcggaggttttccgcaagagaaacctgacaatcatggacttgcacccggggtctggaaaaaccaggcggtatctaccagccattgtgcgagaagcaatcaagagaaaactgcgcactctcatattagctcccaccagggtcggtgccagcgagatggctgaagcactgaagggcatgcctattcgttaccaaacaacggccgtgaagtccgagcatactgggaaagagatcgtagatcttatgggacacgccacctttacaatgggcctgctcgctccaggtcgggtgcccaattataacatggttatcatggacgaagcgcatttcaccgatccttcaagaattgcagccagggggtacatctctactcgcgtcggaatgggcgaggctgccgcaatatttatgacagccaccccgcccggcagcgtggaggctttcccacagagtaatgcggtgattcaggacgaggaacgagatatccctgagagatcctggaacagcgggtatgagtggattacggactttcccggaaagactgtctggttcgtaccatctatcaaatcaggtaatgatatagccaactgcttgcggaagaatggcaaaagggtgattcagctgtcccgcaagacattcgacaccgaataccaaaagaccaaaaacaacgattgggactacgttgtgactacagacatcagtgagatgggggcaaattttcgtgctgatagagtcatcgaccctcggaggtgtctcaaccccgtgattctgaaggatggaccagaacgcgttatccttgccggcccgatgcctgtgaccgtcgcaagcgccgctcagcgaagaggtcggattgggaggaatcacaacaaagagggcgaccagtatatatacatgggacagcccctaaataacgatgaggaccatgccccatggacagaagcgaagatgctgttggataatatcaacactcccgagggcattatccctgcattattcgaaccagagcgcgaaaaatcggccgctatcgacggggagtctagactgaggggagaggcccggaagacgtttgtggaactcatgcgtcgcggtgatctgcccgtatggctttcctataaggtggctagcgagggcttccaatactcagaccgaagatggtgctttgatggggaaaggaccaatcaggttctggaggaaaacatggcagtcgagatttggcctaaagagggagaacggaagaaactccgcccgagatgcttggacgccaggacatatagtgatccactggctctacgggagttcaaggaatttccccctggccgaagatctgtgtccggtgacctgatactcgagatcgggaaacttccccacccactgactcagcgccctcagaatgccttagcaaccttggtgatgagccacacatcagaacaaggcggaagggcgtaccggcatgccatggaggagctgcccgctaccattgaaactctcatgctgcttgccctgatcgcagtcctcacgggcggggttaccttgttctttctgagtggacgtggtttaggcaagacaagcattgggctactgtgtgtgatggcttcctctgtactcctttggatggccagcgtggagccacactggatcgcagcctccataatcctggagttctttttgatggtcctgctcattcctgagccggactcaaacgctactagacaggataatcagctggcgtatgtggttatcggacttctcttcatgattctgaccgtggccgcaaacgagatgggcttgctggaaacaaccaaaaaggacttaggtatcgggcatgtcgctgtagagaatcaccaccatgccgccatgctagatgtggacctgcaccccgcatctgcttggactctctacgccgttgcgacaacgataattaccccaatgatgaggcatactatcgaaaacacaaccgctaacattagtcttaccgccatcgcaaatcaggccgctatactgatgggcttggcaaagggatggcctatctcgaaaatggatattggcgtgcccctgctcgccctggggtgctacagccaagtcaacccacttacattaactgcgcctgtgctgatgctcgtcccccactatccgatcattggaccaggcttgcaggctaaggccacgcgcgaggcacagaaacggaccgccgctggtatcatgaagaatcctacagtggacgggatagttgccattgatctggaccccgtggtatacgatgcaaaatttgaaaagcaactaggacagatcatgctgctcatcctttgtacttcccagattctgttgatgcgaaccacatgggctctgtgcgagtctatcaccctcgccactggcccactgacgacattatgggagggttcacccggcaagttctggaacaccactatagcggtgagcatggccaatattttcagagggtcctatcttgcaggagctggcctggcctttagtctcatgaaatctctagggggaggcaggcgcggtaccggggcacagggagaaacactgggcgagaagtggaaacggcaattgaaccagctgactaagagcgagttcaatacctacaaaagatcaggtatcatggaggtcgaccgttccgaagctaaggagggcctcaagagaggggaaacaacgaaacatcctgttagtcggggaaccgccaaacttcgctggtttgtggaacgaactctggtcaaaccggagggcaaggtgattgatttggggtgtggaagaggcggttggagctattactgcgccgggctgaaaaaggtaacagaagtgaagggatataccaaaggcggccccgggcacgaggacccaatccctatgggaacttacggttggaacctcgttaagttaaggtctggcaaagatgtgttctttataccccctgaaaagtgtgacacactgctttgcgacatcggggagtcctcaccaaatcccaccattgaggaaggacggacgctgcgcgtcctaaaaatggtggagccttggctcagaggcaaccagttctgtatcaagattctgaatccatacatggcgagcgtcgtggaaaccttggagcagatgcaaaggaaacacggtgggatgctggttcgaaaccccctctcgagaaattctacacatgagatgtattgggtaagttggggaactggcaacatcgtgtccgctgtcaatatgaccagccgtatgcttctgaacagatttacaatggcacaccgcaagccgacttacgaaagggatgtggacttaggcgccgggacccggcatgttgctgtggagcctgaagtcgccaatctggatattatcggacagagaatagagaacattaagcacgaacacaaatcaacatggcattatgacgaggataacccatacaagacctgggcatatcacggttcctacgagggcaaaccctctgggagcgccagttccatggtgaatggaggcgtaaagttgctcactaaaccttgggacggtatcccaatggtgacgcagatcgctatgacagataccactcccttcgggcagcaacgcgtttttaaggaaaaggtcgacaccaggacaccgaaagcgaagcgaggaacggcccagattatggaggtgaccgcaaaatggctgtggggcttcctaagccggaacaagaaacctagaatatgcactagggaagagtttacacgcaaggtgcgttctaatgctgccatcggcgcagtcttcgttgatgaaaaccagtggaactcagccaaggaggctgtggaggacgaacggttttgggatcttgtacatagagagagggaactgcacaaacaagggaagtgtgcaacctgcgtgtataacatgatgggaaaacgcgagaagaaactcggtgagttcggcaaggcgaaggggagtcgagcaatttggtacatgtggctgggagcccggttcttggagtttgaggctctgggcttcatgaatgaagaccattggttttccagagagaacagcctctctggtgtcgaaggggagggacttcacaaactgggctacatcttaagggacatttcgaagatccccggcgggaatatgtatgccgatgacactgcaggatgggatacacgcataaccgaggacgatctgcagaacgaagctagaatcacagacattatggagccagaacacgccttgctcgctaaatcaatcttcaagctgacttaccagaataaagtggttcgggtgcagaggcctgccaagaacggtaccgtcatggatgtgattagccgtcgagaccaacgcggctccgggcaggtaggaacgtatggcctaaatacctttacaaacatggaggcacagcttatcagacagatggaaagtggtgggatattctctccccgggagctggagactccaaatctcgcggaaagggttctggattgggtggagaaatacggagtcgaacgcttggagagaatggccattagcggcgacgattgcttaggcgaacccatctatgaccggtttgctaccgccctgacagcactcaacgatatggggaaggtgaggaaggacatccctcaatgggagccatccaaaggatggaacgactggcagcagggtccgttctgttcacatcactttcatcagcttattatgaaggatggccgagagatagtggtcccctgccgtaatcaagacgaactggttgggagagctcgcgtgagtcagggagccggctggtctctacgggagactgcatgtctgggtaaaagctacgcccagatgtggcagctcatggatttccacaggagagacttgcgcctggcggctaacgccatctggtccgcagggcctggagattggattccaacccggaggacgacatggtcaatccacgcccatcaccaatggatgaccactgaagacatgcttagcgtatggaatcgagtgtggattgaggaaaacccctggatggaggataagacacatatctcttcctggggcgacgtcccttatctgggcaaaagagaggatcagtggtgcgggagtctcataggattaaccgctcgggccacttgggcaaccaatatccaggtggctattaaccaagttaggcgcctgatcggtaatgaaaactacttggactacatggccagcatgaagcgttttaagaatgagtcggatccagaaggcgcgctgtggtga

SEQ ID NO: 13904 - RNA, 9879 nt, synthetic construct
  misc_feature 1..9879: note = derived and/or modified CDS sequence (opt3) from DENV-1__KF921942__SS-prME
  source 1..9879: mol_type = other RNA
tccgtgaccatgctgctcatgcttatgcccacagccctggctttccacttgactacgagaggaggggaacctcatatgatcgtctccaagcaagaaagaggaaaatctttactgtttaagacctcagccggtgttaatatgtgcacactgattgccatggacctcggcgaactgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtggcaaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaacttgctgagacccagcacggaacggtcttggtgcagataaagtacgagggcacagacgcgccttgcaaaatcccattctcgacccaagatgaaaagggggttactcagaacggacgcctgattacagcaaatcccatcgtgaccgacaaagagaagcctgtaaacatagaagccgagccaccctttggcgagtcttatattgtcatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtgtttacatccgcggggaaactggttcatcagattttcggaacggcttacggcgtgttgttttctggtgtcagctggaccatgaagatagggatcggcgtgctcctgacttggttaggactaaattcacgaagtacatccctaagcatgacctgtattgccgtaggcctcgtgacactgtaccttggggttatggtccaggcagattctggatgcgtgatcaactggaaaggccgcgaattgaagtgtggttcagggatcttcgtgactaatgaggtccacacctggacggaacaatataagtttcaggccgacagtccgaaaagactgagcgctgccattggaaaggcatgggaggagggcgtttgcggtataaggtccgctacacggctcgaaaacatcatgtggaaacagatttctaacgagctgaatcatatcttactggaaaacgacatgaagttcaccgtggtggtaggcgatgtcgccgggattcttgcgcagggcaagaagatgatccgccctcaacccatggagtacaaatattcgtggaaaagctggggcaaggccaagataatcggggctgacgtgcagaatactacctttattatcgatggaccaaacacacctgaatgtcccgacgatcagagagcatggaatatttgggaggttgaggactacggcttcggtatctttactaccaacatatggttgaagctcagggattcctatacacaggtgtgcgaccaccgtctgatgtcagccgctattaaagatagtaaggccgtccacgcagacatggggtactggatcgaatctgagaaaaatgaaacgtggaagctagcgcgggccagcttcattgaggtgaagacctgtatctggccaaaatcccatactctgtggtcaaacggagttctcgaaagcgagatgataatccccaagatttatggcggtcctatctctcaacacaattaccgaccaggctacttcacacagaccgctgggccgtggcatctgggaaaacttgagttggattttgacctgtgcgaaggcactacagtggtagtcgatgagcactgcgggaacagaggaccctccttaaggaccacgactgtgaccggcaagattatccacgaatggtgttgccgcagttgtacactccctccactgcggttcagaggtgaggacgggtgctggtatggaatggagataaggcccgtgaaagaaaaggaggaaaatcttgtcaagagcatggtttctgccggctccggtgaggtggactcatttagtctgggcttgctctgtattagcatcatgatcgaagaggtaatgcgctcgcgatggtcccggaaaatgctgatgaccgggactctagcagtgttctttctgctcattatgggacagctgacatggaacgatcttatccgtttgtgcattatggtcggcgctaatgcctctgacagaatggggatgggaaccacatacctggcattaatggccactttcaagatgaggcctatgtttgctgtgggcctcctgttccgccggcttaccagcagagaggttctgctactcacgataggtctgtcattggtggcgagtgtcgaactgccaaactccttagaggaactcggggatggactggccatgggcatcatgattcttaaactgttgacagactttcaatctcatcagctctgggcaaccctgctaagcctgactttcatcaagaccacattttcccttcactatgcttggaaaactatggccatggtgctctcaattgttagcctgttccccttgtgtctgagtaccacgtctcagaagacaacctggttaccggtgctcctgggctcccttgggtgcaagcctctgactatgtttttgatcgccgagaataaaatatggggaaggcgaagctggccactcaacgaaggtatcatggctgtcggcattgtatcgatcctgctatcatctctgcttaagaacgatgtgcccctcgcagggcctctgattgccggaggcatgttgatcgcgtgttacgttataagtggttccagcgctgacttatctctggagaaagccgcagaggtgagctgggaagaggaagccgagcattccggggcttcacacaatattctcgtcgaagtgcaggatgacggaacaatgaagatcaaagatgaggagcgcgacgataccctgactatccttctgaaggcaacattgctagccgtaagtggcgtgtatcccctgagcattccagcgaccctcttcgtctggtacttctggcagaagaagaagcagcggtctggcgttctgtgggacacgccttcacccccagaagtggagagagctgtgcttgatgacgggatatataggatcatgcagcgtggattactgggtcgcagccaggtcggcgtgggggtttttcaagaaaacgtattccatactatgtggcacgtgacccggggagccgtcctcatgtaccagggcaaaagattggagccgagttgggcaagcgtgaagaaagacctgatttcctacggtgggggatggaggctccagggctcttggaatacaggcgaggaagttcaggtgatcgccgtcgagcctgggaagaaccccaaaaatgtgcaaaccgctccaggaacatttaagactcccgaaggtgaggtaggcgccattgcactggatttcaagcctgggacctcgggaagcccaatcgtcaaccgagaaggcaaaatagtgggtctttatgggaatggagttgtgacgacatcaggcacttacgtctccgctatcgcccaggcgaaggccagtcaggagggccccctgcctgagattgaagacgaggtgtttcggaaacgcaacttgaccatcatggatctacacccggggtctggaaagacaagaaggtatctgccagcaattgttcgggaagctatcaaacgaaagctcagaaccttaatactggcccccactcgcgtggtcgctagcgagatggcagaagcccttaagggtatgcctattaggtaccaaaccacagccgtgaaatccgagcatacgggcaaggagatcgtagacctgatgtgccacgctactttcaccatgcgtctcttgtcaccagtgcgggttcccaattataacatgatcattatggatgaagcgcattttacagacccttctagcatcgcagccagagggtacataagtaccagggtcggaatgggcgaggctgccgcaattttcatgactgccacaccgcccggttccgtggaggcttttccacagagcaatgcggtgatccaggatgaggaacgcgacattcctgagcgatcttggaactcagggtatgagtggatcaccgatttccccggaaaaacggtctggtttgtaccatccataaagagtggcaatgacattgccaactgtctgaggaaaaatggcaagcgggtgatccagctcagcaggaagactttcgatacagaataccagaaaaccaagaacaacgactgggactacgttgtgaccactgatatctcggagatgggggcaaatttccgcgctgaccgtgtcattgatcctagacggtgcctgaaacccgtgatccttaaggacggaccagaaagggttattctagccggtccgatgcctgtgacagtcgcatctgccgctcagcgccgaggcagaatagggcggaaccacaataaagagggagatcagtatatctacatgggccagcccctgaacaatgacgaggatcatgcccactggaccgaagcgaagatgttgttagacaacattaatacaccagagggtatcatccccgcactgtttgaacctgagagggaaaagtccgccgctattgatggggagtatcgcctcagaggcgaggccaggaaaactttcgtggaactgatgcggcgtggagaccttccagtatggctgagctacaaggtggcttcagagggctttcaatatagtgatcgccgatggtgcttcgacggggaaagaaacaatcaggttctcgaggaaaacatggatgtcgagatatggacgaaagagggagaaaggaagaaattgcggccccgctggctggacgcaagaacctactctgaccctctagccctgagggagtttaaggagttcgctgccggtcggcgatccgtgagcggcgatctcatccttgagattgggaaactgccgcagcacttaacacagagagcacaaaatgcgttggacaacctggtgatgctccataattcagaacagggaggccgcgcctataggcacgctatggaggagctgccagatactatcgaaacccttatgctgctcgccttgattgcagtcctgacaggtggggttaccttatttttcctaagtggccggggactgggcaagactagcatcgggctcctttgtgtgatggcttcctctgtactgttgtggatggccagcgtggagccccattggatagcagcctccatcattctggaatttttcctcatggtcctgcttatccctgagcccgaccgtcagagaacgccacaggataaccaactcgcttacgtggttattggactgttgtttatgatcctgaccgtggcggccaatgagatgggtttactagaaacaactaagaaagacctgggcatagggcacgtcgcagtagagaaccaccatcacgctgccatgctcgatgtggaccttcatcctgcctcagcatggaccctgtacgctgttgccacaaccattatcactcccatgatgaggcacacaattgaaaacacgaccgcgaatatctctttgactgctatagccaaccaggcagccatcctgatgggactcgataagggctggccaattagtaaaatggacatcggtgtgcctctgcttgctttagggtgctattcgcaggtcaatccgctgacactcaccgcagccgtgttgatgctggtcgcgcattacgctattatcggccccggactacaagccaaggcaacccgcgaggcccagaaacggacagctgccggcataatgaagaacccaactgtggatgggattgttgcaatcgacctggatcctgtggtatatgacgctaagttcgaaaaacagctcggacagatcatgcttctgattttgtgtacgagccaaatcctgctcatgcgaaccacatgggccctgtgcgagtccataactttagcgaccggcccccttacaaccctgtgggagggttctccagggaagttttggaatactacgattgccgtgtcaatggcaaacatcttcagaggaagctacctcgctggcgccggtctagcattctccctgatgaaaagtttgggcgggggaaggcgcggcacaggggctcagggagaaaccctgggcgagaagtggaaacggcagctcaatcagctttctaagagcgaatttaacacttataagagatcaggtattatggaggtcgaccgttccgaagccaaagaggggctgaagaggggagagaccacaaaacacgccgttagtcggggcactgcgaagttgcgctggttcgtggaacgaaatctggtcaaacctgagggtaaggtgatcgatctcggctgtgggagaggaggctggagctactattgcgctgggttaaagaaagtaaccgaagtgaagggatacacaaaaggcggtcccgggcacgaggaaccgataccaatggcaacgtacggatggaacctggttaaacttcattctggcaaagacgtgtttttcatccctcccgagaagtgtgataccctgctatgcgacattggcgagtcctcaccaaatcccactatcgaagaggggaggacactccgggtcctgaaaatggtggaaccttggttgcgcggaaaccaattttgtattaagatcctgaatccgtatatgcccagcgtcgtggagaccctcgagcagatgcagagaaagcacggtggcatgcttgttaggaacccactgtcgcgaaattctactcatgaaatgtactgggtaagttgcgggacaggaaacattgtgtccgccgtcaatatgaccagccggatgttactgaaccgtttcacgatggctcacagaaaacctacctatgagcgcgatgtggacttgggcgccggtacaaggcacgttgcagtggaacccgaggtcgccaacctcgatatcatagggcagcggattgaaaatatcaagcatgagcacaaatcaacttggcattacgacgaggataacccttataagacctgggcttaccacggatcctatgaagtgaaaccatctggcagcgcgagttccatggtaaatggcgtggttaagctgctaacaaagccctgggacgtcatccctatggtgactcaaattgccatgaccgatacaaccccatttgggcagcagagagtgttcaaagagaaggtcgacactcgcacgcccaaagcaaagaggggaacagctcaaataatggaagttaccgccaaatggctttggggttttctgagccgaaacaagaagccgcggatctgtactagagaggagttcaccaggaaagtgcgctctaatgcagccattggcgctgtatttgtggacgagaaccagtggaactcagccaaggaggcggtcgaagatgagcgtttctgggacctcgtgcatcgggaaagagagctgcacaaacaggggaagtgcgcaacatgcgtttacaacatgatgggaaaaagggaaaagaagttgggcgagtttggtaaagccaaggggagtcgcgctatctggtacatgtggctgggagcccgattcctcgagttcgaagcacttggctttatgaatgaggatcactggttctcccgggaaaacagcctgtctggcgtggagggggagggattacataaactgggttatattttgagagacatctcgaagatacctggcgggaatatgtacgctgatgacacggccggatgggataccaggatcactgaagacgatctccagaacgaggctcgcattacagacatcatggaaccagagcacgccctgctagcaaaatcaatttttaaacttacctatcaaaataaagtcgtgagagtacagcggcccgcgaagaacggcactgttatggatgtgatcagcaggcgtgaccagcgaggttccgggcaggtcggaacatacggcctgaataccttcacaaacatggaagcccaactcatacgccagatggagagtgagggcatattttctcctagcgaactggagactccaaacttggctgaaagagtgttagattggctggagaagtatggggtggaacggctcaaaaggatggccatctccggagacgactgtgtcgttaagcccatcgatgaccgcttcgcaaccgctcttacggccctgaatgatatgggtaaagtgagaaaggacattccgcagtgggagccttcaaaaggctggaacgattggcagcaagtacccttttgcagtcatcacttccaccagctaataatgaaggacgggcgggagatcgtggtcccatgtaggaatcaggatgaactggtgggacgagcacgtgtttctcagggcgccggttggagcctcagagagaccgcgtgcttggggaagtcctacgctcaaatgtggcagctgatgtattttcatcgccgggaccttaggctggccgcaaacgccatttgttcagctgtgcctgtcgattggatccccacaagcagaactacctggtctattcacgcccatcaccagtggatgacaactgaagacatgctctccgtgtggaatcgcgtatggatcgaggaaaacccatggatggaggataaaacccatataagtagctggggagacgttccctacttaggcaagcgggaggaccaatggtgcggctcgctgatcgggttgacggcaagggctacatgggccaccaatattcaggtggcgatcaaccaggtccgaagactgattggaaatgaaaactacctcgattatatgacttccatgaaacggttcaagaatgagtctgaccctgaaggtgctctttggtga

SEQ ID NO: 13905 - RNA, 9879 nt, synthetic construct
  misc_feature 1..9879: note = derived and/or modified CDS sequence (opt3) from DENV-1__JF937602__SS-prME
  source 1..9879: mol_type = other RNA
tccgtgacaatgctgctcatgcttatgcccacagcactggctttccacttgactacgagaggaggggagcctcatatgatcgtctccaagcaggaaaggggaaaatctttactgtttaagacatcagccggtgttaacatgtgcacattaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaggaacaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccatttcttacacaagatgaaaagggggtgacccagaacggacgcttgattactgcaaatcccatcgtaacagacaaagagaagcctgtcaacatagaagccgagccacccttcggcgagtcttatattgtgatcggtgctggggaaaaagccctgaagctctcctggtttaagaaaggctcaagtatcggaaagatgttcgaggcaaccgccagaggcgctaggcggatggccattctgggggatactgcatgggactttggaagcatcggtggcgttttcacctccgtggggaaacttgtccatcagatttttggaacagcgtacggcgtgctgttctctggtgtaagctggacgatgaagatagggatcggcgtgttgctcacctggctgggattaaattcacgaagtacttccctgagcatgacatgtattgctgttggcctagtcaccctctacctgggggtgatggtgcaggccgattctggatgcgtcatcaactggaaaggccgcgaacttaagtgtggttcagggatctttgttacaaatgaggtgcacacttggaccgaacaatataagttccaggcagacagtccgaaaagattgagcgccgctattggaaaggcctgggaggagggcgtgtgcggtataaggtccgcaacgcggctggaaaacatcatgtggaaacagatttctaacgagctcaattacatcctgttagaaaacgacatgaagctgacagtagtcgtgggcgatgttgctgggattcttgcccagggcaagaagatgatccgccctcaacccatggagtataaatactcgtggaaaagctggggcaaggcgaaaataatcggggccgacgtgcagaataccacttttattatcgatggaccaaacacccctgaatgtcccgacgatcagagagcttggaatatttgggaggtcgaggactatggcttcggtatctttacaactaacatatggttgaagctcagggattcctacacccaggtgtgcgaccatcgtctgatgtcagcagccattaaagatagtaaggctgttcacgccgacatggggtattggatcgaatctgagaaaaatgaaacatggaagctagcacgggcgagcttcattgaggtgaagacgtgtatctggccaaaatcccacaccctgtggtcaaacggagtactcgaaagcgagatgataatccccaagatttacggcggtcctatctctcaacataattaccgaccaggctatttcactcagacagccgggccgtggcacctgggaaaacttgagttggattttgacctgtgcgaaggcaccactgtcgtggtggatgagcattgcgggaacagaggaccctccttaaggacaaccacggtcactggcaagattatccacgaatggtgttgccgcagttgtaccctccctccactgcggttcaaaggtgaggacgggtgctggtacggaatggagataagacccgttaaggaaaaggaggaaaatcttgtgaaaagcatggtatctgctggctccggtgaggtggactcatttagtctgggcttgctctgtattagcatcatgatcgaagaggtcatgaggtcgcgctggtcccgaaagatgctgatgacagggaccctagccgtgttctttctgctcattatgggacagctgacttggaacgatcttatccggttgtgcattatggttggcgcaaatgcttctgaccgtatggggatgggaacaacctatctggccttaatggcaacattcaaaatgagacctatgtttgccgtgggcctcctgttcaggcgccttactagccgggaggtcctgctactcaccataggtctgtcattggtggctagtgttgaactgccaaactccttagaggaactcggggatggactggcgatgggcatcatgattcttaagctgttgacggactttcaatctcaccagctctgggccacactgctaagcctgaccttcgtgagaactaccttttcccttcattacgcatggaaaacaatggctatggtcctctcaatcgtaagcctgttccccttgtgtctgagtactacctctcagaagacgacatggttaccggtgctcctgggctcccttgggtgcaagcctctgaccatgtttttgattgccgagaataaaatctggggaagaaagagctggccactcaacgaaggtataatggccgttggcatcgtgtcgattctgctatcatctctgcttaaaaacgatgtccccctcgctgggcctctgatcgcaggaggcatgttgattgcctgttatgtgatcagtggttccagcgcggacttatctctggagaaggctgccgtagtgagctgggaggaagaggcagaacactccggggcctcacataatatactcgtcgaggttcaggatgacggaactatgaaaattaaggatgaggaacgagacgatacactgaccatccttctgaaagctactttgctagcagtgagtggcgtgtaccccctgagcatcccagccacactcttcgtctggtatttctggcaaaagaagaaacagcgctctggcgtgctgtgggacaccccttcacccccagaggttgaacgggcggtacttgatgacgggatttacagaataatgcagaggggattactgggtcgtagccaggtgggcgtcggggtgtttcaagagaacgttttccacacgatgtggcatgtgactcgcggagctgtcctcatgtaccagggcaagcggttggaaccgagttgggccagcgtgaaaaaggacctgatctcctatggtgggggatggagactccagggctcttggaataccggcgaggaggtacaggtcattgcagtggaacctgggaaaaaccccaagaatgttcaaacagccccaggaacctttaagacatcggagggtgaagtgggcgctatcgccctggatttcaaacccgggactagcggatcacctattgtcaacagggagggcaagatcgtgggtctttacgggaatggagttgtgaccacgtccggcacatatgtcagtgcaatagctcaggccaaagcgtctcaggaaggcccactgcccgagatcgaggacgaagtgtttcgaaagcggaacttgactattatggatctacaccctgggagcggaaaaacccgcagatacctgccggccatcgtaagggaggcaattaagcggaagctccgaacattaatcctggctccaaccagagtggttgcctccgaaatggctgaggcacttaaaggtatgcccatacgctatcaaactaccgccgtcaagtcagaacacacaggcaaagagattgtggacctgatgtgccatgccacgttcactatgaggctcttgtctcctgtgcgtgtcccaaattacaacatgatcatcatggatgaggctcactttaccgaccccagcagtattgcggcacgggggtatatctccacaagagtaggaatgggcgaagccgctgccatattcatgaccgcaactcctccgggtagcgtggaggcctttccccagtctaatgctgttattcaggatgaagagagggacatcccagaacgctcatggaactccgggtacgagtggattacagatttccctggaaagaccgtgtggtttgtccccagtatcaaaagcggcaatgacatagcgaactgtctgcgaaagaatggcaagagagtgattcagctctcgcggaaaacgttcgatactgagtaccaaaagaccaaaaacaacgactgggactatgttgtgaccaccgatatctctgaaatgggggccaatttcagggcagaccgcgtcatcgatccacgtagatgcctgaagcctgtgattcttaaagacggacccgagcgggtaatcctagctggtccaatgccggtgactgttgcctccgcagcccagaggcgcggccgaattgggagaaaccataataaggaaggagatcagtacatatatatgggccagcctctgaacaatgacgaggatcacgctcattggacagaggccaagatgttgttagacaacatcaatacccccgaaggtattatcccagcgctgtttgagcccgaacgggagaaaagcgcagccatcgatggggaatacaggctccgcggcgaggctagaaagacattcgtcgagctgatgaggcggggagaccttcctgtgtggctgtcatataaagtggccagtgaaggctttcaatactctgatcgtcgctggtgcttcgacggggagcgaaacaatcaggtcctcgaagagaacatggatgttgaaatttggactaaggagggagagaggaaaaagttgaggccacggtggctggacgctcgcacgtattccgaccccctagcactgagagaatttaaagagttcgccgctggtaggcggagcgtgtcaggcgatctcatacttgaaatcgggaagctgcctcagcacttaacccagcgagcccaaaatgcattggacaacctggtaatgctccacaatagtgagcagggaggcagagcgtaccgccatgccatggaggaactgccggatacaattgagactcttatgctgctcgctttgatcgccgtgctgaccggtggggtcacattatttttcctaagcggcaggggactgggcaagacctccattgggctcctttgtgtgatggcatctagcgttctgttgtggatggcttccgtggaaccacactggatcgccgcatcaataatcctggagtttttcctcatggtcctgcttattcccgaacctgaccggcagcgtactccccaggataaccaactcgcctacgtagtgatcggactgttgtttatgattctgacggttgctgcgaatgagatgggtttactagagaccaccaaaaaggacctgggcatcgggcatgtggccgtcgaaaaccaccaccatgcagctatgctcgatgtggaccttcacccagcctctgcctggactctgtatgcagtcgctaccacaataattacccctatgatgagacatactatcgagaacacaacggccaatattagtttgaccgcgatcgctaaccaggccgcaatactgatgggactcgataaaggctggcccatctcgaagatggacattggtgtgccactgcttgccttagggtgctacagccaggttaatcctctgactctcacagctgcagtgttgatgctggtagcccactatgcgatcattggcccgggactacaagctaaagccaccagggaagcacagaagcgcaccgccgctggcatcatgaagaaccccacagtggatgggatagtcgccattgacctggatccagttgtgtacgacgcaaaattcgagaagcagctcggacagatcatgcttctgatcttgtgtacttcccaaattctgctcatgcggacgacctgggctctgtgcgaatctatcacattagccactggccctcttaccacactgtgggagggttcacccgggaaattttggaataccactatagcggtcagcatggccaacattttccgaggatcctatctcgcaggcgctggtctagccttcagtctgatgaagtctttgggcgggggaagaaggggcacgggggcacagggagagacactgggcgaaaaatggaagcgccagctcaatcagcttagcaagtcagagtttaacacctacaaacggtccggtatcatggaagtggacagaagtgaggctaaggaagggctgaaacgtggagagactaccaagcatgccgtaagcaggggcacagccaaattgcggtggttcgtggagcgcaatctggttaagccagaaggtaaggtgattgatctcggctgtgggcgaggaggctggtcttattactgcgcggggctaaagaaggtcactgaggtgaaaggatacaccaagggcggtcctgggcacgaggaacccatcccgatggctacatatggatggaacctggtcaaacttcactccggcaaggacgtgtttttcataccacctgaaaaatgtgatacgctgctatgcgacatcggcgagtcaagccccaatccaaccattgaggaagggagaactctcagggttctgaagatggtagagccctggttgcggggaaaccaattttgtatcaagattctgaatccttacatgccgtcggtggtcgaaacactcgagcagatgcagcgcaaacatggtggcatgcttgtgagaaaccccctgtctaggaatagtacccacgagatgtattgggtttcctgcgggactggaaacatcgtgagcgcagtcaatatgacatcacgaatgttactgaaccggttcaccatggcccatcgtaagccaacgtacgaaagagatgtggacttgggcgctggtacccgccacgtagccgtggagcctgaagttgcaaacctcgatattatcgggcagaggatagagaatattaaacacgaacataagtccacatggcactatgacgaggataacccctacaaaacttgggcctatcatggatcttacgaggtcaagcctagcggcagtgcttccagcatggtgaatggcgtggtcaagctgctaaccaaaccatgggacgttatccccatggtgacacaaatcgcgatgactgataccacaccttttgggcagcagcgggtattcaaggaaaaagtggacaccagaactccaaaggccaaacgcggaacggcacaaattatggaggtcacagctaagtggctttggggttttctgtctaggaacaagaaaccccgaatatgtacccgggaagagttcactagaaaggtgaggtcaaatgccgcaatcggcgccgtttttgtggacgaaaaccagtggaatagtgctaaagaggccgtcgaggatgaacgcttctgggacctcgtgcaccgtgagcgggaactgcataagcaggggaaatgcgcgacctgcgtatacaacatgatgggaaagagagagaagaaattgggcgaatttggtaaggcaaaagggtccagggccatttggtatatgtggctgggagctcgcttcctcgagttcgaggcccttggctttatgaatgaagatcactggttcagccgagagaactctctgtcgggcgttgaaggggagggattacacaagctgggttacatcttgcgggacatttcaaaaatcccgggcgggaatatgtatgcagatgacacagctggatgggatacgagaataaccgaggacgatctccagaacgaagccaagatcactgacattatggagcctgaacatgctctgctagccaaaagcatctttaaacttacataccaaaataaggtggtcagggtgcagcgcccagccaaaaacggcaccgtgatggatgtcatttccagacgggaccagaggggtagtgggcaggttggaacttatggcctgaatacattcaccaacatggaggcgcaactcatccgtcagatggaatctgagggcatatttagcccctccgagctggaaacacctaacttggccgggcgagtgttagattggctggagaagcacggagtagaacgcctcaaaagaatggctatttcaggtgacgactgtgtggtcaagccaatcgatgaccggttcgccactgcacttaccgctctgaatgatatgggcaaagtgaggaaggacatcccccagtgggagccgagtaaggggtggaacgattggcagcaagttcctttttgctctcatcacttccaccagctaattatgaaagacggacgcgaaatagtggtcccctgtagaaatcaggatgagctggtgggccgggccagggtaagccagggtgcagggtggtccctccgagagacggcctgcttgggaaagtcatacgcgcaaatgtggcagctgatgtattttcatcgtagagaccttcgcctggctgccaacgcaatctgtagcgccgttccagtggattgggtccctacctctcggacaacttggtccattcacgctcatcaccagtggatgaccacagaagacatgctcagtgtgtggaatagggtttggatcgaggaaaacccctggatggaggataaaactcatattagctcgtggggcgacgtgccatacttaggcaagagagaagaccaatggtgcgggtccctgatcggattgaccgcccgcgcaacgtgggctacaaatatacaggtcgccatcaaccaggtgcggaggctgctcggtaatgagaactaccttgattatatgacctctatgaaacgattcaagaatgagtcagaccccgaaggcgcgctgtggtga

SEQ ID NO: 13906 - RNA, 9879 nt, synthetic construct
  misc_feature 1..9879: note = derived and/or modified CDS sequence (opt3) from DENV-1__GU131729__SS-prME
  source 1..9879: mol_type = other RNA
agcgtgaccatgctgctcatgcttatgcccacagcactggctttccacttgactacgcgaggcggggagcctcatatgatcgtctccaagcaggaaaggggaaaatctttactgtttaagacctcagccggtgttaacatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagccaaactggagagcaccgccgagacaagcgtagcgtggctcttgcaccacatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagccgggattttgtggagggtcttagtggcgccacatgggtagacgttgtgttggagcacgggtcctgtgtcaccactatggcgaaggataaacccacactggacatcgaactgctcaagaccgaggtgacgaaccctgcagtgctgggaaaactttgcattgaagccaagatctctaataccacaactgatagtaggtgtccaacccaaggcgaggctacactggtcgaagaacaagacgccaacttcgtttgccggcgcacttttgtggatcgaggttgggggaatggatgtggcttgttcggcaaagggtccctcataacctgcgcaaagtttaagtgcgtaacaaaactggagggaaagattgtgcagtacgaaaacttaaaatattcagtcatcgtgaccgttcacactggtgaccagcatcaagtgggcaatgagagtacggaacacgggacaaccgctactattacaccccaagcccctaccaccgagatccagctgactgactacggagcgctcacacttgattgtagcccaagaacgggcctggacttcaacgaaatggtcttgctaaccatgaaggagaaatcttggctggtgcataagcagtggtttctcgatctgccgcttccctggacttccggtgcctcaacaagccaagagacctggaataggcaggacctgttggtaacattcaaaactgcacacgctaagaagcaggaagttgtggtcctcgggagtcaagagggcgccatgcacaccgctctgacgggagccaccgaaatccagacatctggcactaccacaatttttgcagggcatttaaaatgccggctgaagatggataaactaactctcaagggaatgtcctatgtgatgtgtaccggtagcttcaaactggagaaggaacttgccgagacgcagcacggcacagtcttggtgcagataaagtacgaggggaccgacgctccttgcaaaatcccattctcgactcaagatgaaaagggagttacacagaacggccgtctgattaccgcgaatcccatcgtgactgacaaagagaagcctgtaaacatagaagcagagccaccctttggtgagtcttatattgtcatcggggccggcgaaaaagctctcaagctgtcctggttcaagaaaggatcaagtatcggcaagatgtttgaggccaccgcacgcggggccagaaggatggctattcttggagatacagcctgggacttcggtagcatcggcggggtgtttacgtccgttggaaaactggtgcatcagattttcggcaccgcatacggtgtcttgttttctggggtgagctggactatgaagataggcatcggagtactcctgacatggttaggcctaaattcacggagtacctccctaagcatgacatgtattgcggtggggctcgttactctgtaccttggagtcatggtgcaggctgattctggctgcgtgatcaactggaaaggtcgagaattgaagtgtgggtcaggaatcttcgtcaccaatgaggttcacacgtggacagaacaatataagtttcaggccgacagtccgaaacgcctgagcgcagccattggcaaggcttgggaggagggtgtgtgcggcataagatccgccaccaggctcgaaaacatcatgtggaaacagatttctaacgagctgaatcatatcttactggaaaacgacatgaagttcactgtggtagtcggggatgtggcagggattcttgctcagggcaaaaagatgatccggcctcaacccatggagtacaaatattcgtggaaaagctgggggaaggccaaaataatcggagcggacgttcagaataccacatttattatcgatggcccaaacactcctgaatgtcccgacgatcagcgcgcctggaatatttgggaggtggaggactacggtttcgggatctttaccacaaacatatggttgaagctcagagattcctatacgcaggtctgcgaccacaggctgatgtcagctgcaattaaagatagtaaggccgtgcacgctgacatgggatactggatcgaatctgagaaaaatgaaacctggaagctagcccgtgccagcttcattgaggttaagacttgtatctggccaaaatcccatacactgtggtcaaacggcgtgctcgaaagcgagatgataatccccaagatttatggtggccctatctctcaacacaattaccggccagggtacttcacccagactgcgggaccgtggcatctgggcaaacttgagttggattttgacctgtgcgaagggacaaccgtagtcgtggatgagcactgcggaaaccgaggcccctccttaagaacgactaccgtgacaggtaagattatccacgaatggtgttgcaggagttgtaccctccctccactgcgcttcagaggggaagacggatgctggtatggcatggagataagacccgtcaaagaaaaggaggaaaatcttgttaagagcatggtgtctgccggttccggcgaggtagactcatttagtctggggttgctctgtattagcatcatgatcgaagaggtgatgaggtcgcgctggtcccgaaaaatgctgatgactggaacactagctgtcttctttctgctcattatgggccagctgacctggaacgatcttatccggttgtgcattatggtgggggccaatgcatctgaccgtatgggaatgggcacaacttacctggctttaatggccaccttcaagatgagacctatgtttgcagttggtctcctgttcaggcgccttacgagccgggaggtgctgctactcacaatagggctgtcattggtcgccagtgtggaactgccaaactccttagaggaactcggagatggcctggctatgggcatcatgattcttaaactgttgaccgactttcaatctcatcagctctgggcgactctgctaagcctgaccttcatcaagacaactttttcccttcactatgcctggaaaaccatggcaatgattctctcaatcgttagcctgttccccttgtgtctgagtacgacatctcagaagaccacttggttaccggtgctcctggggtcccttggatgcaagcctctgacaatgtttttgatagctgagaataaaatctggggtagaaggagctggccactcaacgaaggcattatggccgtcgggatcgtatcgattctgctatcatctctgcttaagaacgatgtgcccctcgccggacctctgatcgctggcggtatgttgatagcatgttacgttattagtgggtccagcgccgacttatctctggagaaagcggctgaggtgagctgggaagaggaagccgagcattccggagcatcacacaatatcctcgtcgaagtgcaggatgacggccccatgaagatcaaagatgaggagcgagacgataccctgactattcttctgaaggccacattgctagctgtaagtggcgtgtatccactgagcatacctgcaaccctcttcgtctggtacttctggcagaagaagaagcagcgctctggggttctgtgggacacgccctccccaccggaagtggagcgggccgtgcttgatgacggaatctatagaattatgcagaggggtttactgggccgttcacaggtcggggtgggagtttttcaagaaaacgtattccatactatgtggcacgtgacccgcggcgcggtcctcatgtaccagggtaaacggttggagcctagttgggctagcgtgaagaaagacctgatctcctacgggggaggctggagactccagggctcttggaatacaggggaggaagttcaggtgattgccgtcgagcccggaaagaaccccaagaatgtgcaaaccgcacccggtacatttaagactcctgaaggcgaggtaggggccatcgctctggatttcaagccaggaacctcgggcagccccatagtcaacagggaaggtaaaatcgtggggctttatggaaatggcgttgtgacgacatcaggcacttacgtctccgccattgcacaggctaaggccagtcaggaggggcctctgccggagatcgaagacgaggtgtttcgaaaacggaacttgaccattatggatctacacccaggatctggtaagacacgcagatatctgcccgcgatcgttagggaagccataaaacggaagctccgaaccttaattctggcacctactagagtggtcgctagcgagatggccgaagctcttaagggcatgccaatccgctaccaaaccacagcagtgaaatccgagcatacggggaaggagatcgtagacctgatgtgccacgccactttcaccatgaggctcttgtcacccgtgcgtgttcctaattataacatgattatcatggatgaagcccattttacagacccgtctagcatagctgcgcggggatacattagtaccagagtcggcatgggtgaggcagccgctatcttcatgactgccacacccccagggtccgtggaagcatttcctcagagcaatgccgtgattcaggatgaggaaagggacatccccgagcgctcttggaactcaggatatgagtggataaccgatttcccaggcaaaacggtctggtttgtaccttccattaagagtggcaatgacatcgctaactgtctgagaaagaatgggaagagagtgatccagctcagccggaagactttcgatacagaataccagaaaaccaagaacaacgactgggactacgttgtgaccactgatatttcggagatgggagcgaatttcagggccgcacgcgtcatcgacccccgtagatgcctgaaaccagtgattcttaaggatggtccggaacgggttatactagctggccctatgcccgtgacagtcgcctctgcagcccagaggcgcgggcgaatcggaagaaaccacaataaagagggcgaccagtatatttacatgggtcagccactgaacaatgatgaggaccatgctcactggaccgaagccaagatgttgttagataacatcaatacacccgaggggatcattcctgcgctgtttgaaccagagcgggaaaagtccgcagccatagacggcgagtataggctccgcggagaggctagaaaaactttcgtggaactgatgaggcggggcgatcttcccgtatggctgagctacaaggtggcctcagaggggtttcaatatagtgaccgtcgctggtgcttcgatggagaacgaaacaatcaggttctcgaggaaaacatggacgtcgagatctggacgaaagagggtgaaagaaagaaattgaggcctcggtggctggatgctcgcacctactctgacccgctagcactgagagagtttaaggagttcgccgctggcaggcggtccgtgagcggggacctcattcttgagatcggaaaactgccacagcacttaacacagcgagcccaaaatgcattggataacctggtgatgctccataattcagaacagggcggtagagcgtatcgccacgccatggaggagctgcccgacactattgaaacccttatgctgctcgctttgatcgccgtcctgacagggggcgttaccttatttttcctaagtggaaggggcctggggaagactagcataggactcctttgtgtgatggcatcctctgtactgttgtggatggctagcgtggagcctcattggatcgccgcatccattatcctggaatttttcctcatggtcctgcttattcccgagccagatcggcagcgtacgcctcaggacaaccaactcgcctacgtggttatcggtctgttgtttatgatactgaccgtggctgcgaatgagatgggcttactagaaacaactaagaaagatctggggattggacacgtcgccgtagagaaccaccatcacgcagctatgctcgacgtggatcttcatcccgcctcagcctggaccctgtacgcagttgctacaaccatcattactccaatgatgagacacacaatcgaaaacacgaccgccaatatatctttgactgcgatcgctaaccaggccgcaattctgatgggcctcgacaagggttggcctatcagtaaaatggatattggggtgccgctgcttgccttaggctgctattcgcaggtcaatcccctgacactcaccgctgcagtgttgatgctggtcgcccattacgcgatcataggaccaggcctacaagctaaggccaccagggaggcacagaaacgcacagccgctgggattatgaagaaccctactgtggacggaatcgttgccatcgatctggaccccgtggtatatgatgcaaagttcgaaaaacagctcggccagattatgcttctgatcttgtgtacgagccaaatactgctcatgcggaccacatgggctctgtgcgagtccattactttagccaccggtccacttacaaccctgtgggaggggtctcctggaaagttttggaatactacgatcgcggtgtcaatggccaacattttccgaggcagctacctcgcaggagctggcctagccttctccctgatgaaaagtctagggggtggcagaagggggacaggagcacagggcgaaaccctgggtgagaagtggaaacgccagctcaatcagctttctaagagcgaatttaacacttataagcggtcagggatcatggaggtcgacagatccgaagctaaagagggactgaagcgtggcgagaccacaaaacacgccgttagtaggggtactgccaagttgcggtggttcgtggaacgcaccctggtcaaacccgagggcaaggtgatagacctcgggtgtggacgaggcgggtggagctactattgcgcgggattaaagaaagtaacagaagtgaagggctacacgaaaggtgggccgggacacgaggaaccaatccctatggctacctacggctggaatctggttaaacttcattctggcaaagatgtgtttttcattcccccagagaagtgtgacactctgctatgcgatatcggggagtcctcacccaaccctacaattgaagagggaagaaccctcagggtcctgaaaatggtggaaccgtggttgcggggtaatcaattttgtatcaagattctgaacccctatatgccaagcgtcgtggagactctcgagcagatgcagcgcaagcacggcgggatgcttgttagaaatcctctgtcgaggaactctacacatgaaatgtactgggtaagttgcggaaccggcaatatcgtgtccgcagtcaacatgacgagccgaatgttactgaatcggttcaccatggcccaccgtaaacccacatatgagagagacgtggatttgggtgctgggactcgccacgttgccgtggaacctgaggtcgcaaacctcgacataattggacagaggatcgaaaacatcaagcatgagcacaaatcaacctggcattacgatgaggacaatccatataagacatgggcctaccacggctcctatgaaggcaaaccctctgggagcgctagttccatgggaaacggtgtggtaaagctgctaactaagccttgggatgtgattccaatggttacccaaatagcgatgacagacaccactccctttggccagcagcgggtcttcaaagagaaggtggatacgagaacaccgaaagccaagcgcgggaccgcacaaatcatggaagtgactgctaaatggctttggggatttctgagcaggaataagaagcctcgaatttgtacccgggaggagttcacaagaaaagtcaggtctaacgccgcaatcggcgccgtttttgtggacgagaatcagtggaactcagctaaggaggccgtagaagacgagcgcttctgggatctcgtgcatcgtgaacgggagctgcacaaacagggtaagtgcgcgacgtgcgtctacaatatgatggggaaaagagaaaagaagttgggagagtttggcaaagcaaagggcagtagggccatttggtacatgtggctgggggctcgcttcctcgagttcgaagcccttggatttatgaacgaggaccactggttctcccgagaaaatagcctgtctggtgtggagggcgaggggttacataaactgggatatatcttgcgggatatatcgaagatcccaggcggtaacatgtacgcagacgataccgctgggtgggacactagaattacagaagatgacctccagaatgaggccaggatcaccgatattatggaacccgagcacgctctgctagccaaatcaatctttaaacttacttatcaaaacaaagttgtgcgcgtccagagacctgcaaagaatggaacagtgatggacgtaataagccggagggatcagcgtggctccggccaggttgggacctacggactgaacacattcactaatatggaagcgcaactcattcgacagatggagagtgagggtatcttttctccaagcgaactggagacccccaacttggccgaacgcgtgttagactggctggagaagtatggcgtcgaaagactcaaacggatggctatctccggggatgactgtgtggtgaagccgattgacgataggttcgccacggcacttaccgctctgaacgacatgggaaaagtccgcaaggatatacctcagtgggagccctcaaaaggctggaatgactggcagcaagttccattttgcagtcatcacttccaccagctaatcatgaaggatggtagagagattgtggtaccttgtcggaaccaggacgaactggtggggagggcccgagtctctcagggagcaggctggagcctccgtgagacagcctgcttgggcaagtcctacgcgcaaatgtggcagctgatgtattttcatagacgcgatcttcggctggctgccaatgcaatctgttcagccgtgcccgttgactggattccaactagcaggaccacatggtctatccacgctcatcaccagtggatgactaccgaagatatgctctccgtgtggaacagagtctggatagaggaaaatccctggatggaggacaaaacgcatatcagtagctggggagatgtgccttacttaggaaagcgcgaggaccaatggtgcggttcgctgattggcttgacagcccgggcaacctgggctactaacatccaggtagccattaatcaggttaggcgactgatcgggaacgaaaattacctcgactatatgacatccatgaaaagattcaagaacgagtctgatccagaaggagcgctttggtga

SEQ ID NO: 13907 - RNA, 9879 nt, synthetic construct
  misc_feature 1..9879: note = derived and/or modified CDS sequence (opt3) from DENV-1__GU131730__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcgcgccgattcaggatgcgtcatcaactggaaaggcagagaactgaagtgtggtagtgggatctttgttacaaatgaggtgcacacttggaccgaacagtataagttccaagcagacagcccgaaaaggctttccgccgctattggaaaggcctgggaggagggcgtgtgcggtatacggtctgcaacgcgcttggaaaacatcatgtggaaacagatttcgaacgagctgaatcatatcctcctggaaaacgacatgaagttaacagtagtcgtgggcgatgttgctgggattctggcccagggaaaaaagatgatcagacctcagcccatggagtacaaatatagctggaagtcctggggcaaggcgaaaataatcggggccgacgtgcaaaataccacttttattatcgatggaccaaacacccctgaatgtcccgacgatcagagggcttggaatatttgggaggtcgaggactacggcttcggtatctttacaactaacatatggcttaagttgcgtgattcatatacccaggtgtgcgaccaccggctcatgagtgcagccattaaagattctaaggctgttcacgccgacatggggtactggatcgaaagcgagaaaaatgaaacatggaagctggcacgagcgtccttcattgaggtgaagacgtgtatctggccaaaatcacataccctatggagcaacggagtactggaatctgagatgataatccccaagatttatggcggtcctatctcccagcacaattacagaccaggctacttcactcaaacagccgggccgtggcatctcggaaaactggagcttgattttgacttgtgcgaaggcaccactgtcgtggtggatgagcactgcgggaacaggggacccagtctgcgcacaaccacggtcactggcaagattatccacgaatggtgttgccggagctgtaccttacctccactcagattcaaaggtgaggacgggtgctggtatggaatggagataaggcccgttaaggaaaaggaggaaaatctggtgaaatctatggtatccgctggctcaggtgaggtggacagttttagccttggcctgttgtgtatttcgatcatgatcgaagaggtcatgcgctcccgatggtctcggaagatgctcatgacagggaccctggccgtgttctttctactgattatgggacagctcacttggaacgatctgatccgtctttgcattatggttggcgcaaatgctagcgacagaatggggatgggaacaacctacttggccctgatggcaacattcaaaatgaggcctatgtttgccgtgggcttactcttccgccggctgacttcaagagaggtccttctgctaaccataggtctcagtctggtggcttccgttgaattgccaaactctctggaggaattaggggatggactcgcgatgggcatcatgattctgaagcttctgacggactttcagagccatcaattgtgggccacactcctgtccctaaccttcatcaggactaccttttcactgcactatgcatggaaaacaatggctatggtgcttagcattgtcagtctcttccccctgtgtttgtctactacctcccagaagacgacatggctgccggtattactcggcagcctggggtgcaagcctcttaccatgtttctgatcgccgagaataaaatatggggacgaaagtcgtggccattgaacgaaggtatcatggccgtgggcattgtttcaatcctcctgtctagtctactgaaaaacgatgtgccccttgctgggcctctcattgcaggaggcatgctgatcgcctgttacgtcatatccggtagctctgcggacttgagcttagagaaggctgccgtggtatcctgggaggaagaggcagaacattcaggggccagtcacaatattctggtggaggtccaggatgacggaactatgaaaatcaaggatgaagagcgcgacgatacactcaccatcctgcttaaagctactctgttggcagttagcggcgtgtatcccctatctattccagccacactgttcgtgtggtacttctggcagaagaagaaacaacggtccggcgtcctctgggacaccccttcacccccagaggtggaaagagcggttctggatgacgggatatataggatcatgcagcgtggacttttaggtcgcagtcaggtaggcgtgggggtctttcaggagaacgtgttccatacgatgtggcacgttactcggggagctgtgctgatgtaccaaggcaagagactcgaaccgagctgggcctccgtcaaaaaggacttgatttcttacggtgggggatggaggctgcagggctcgtggaataccggcgaggaggtgcaggtaatcgcagtcgaacctgggaaaaaccccaagaatgtgcagacagccccaggaacctttaagacaagcgagggtgaagttggcgctattgccctcgatttcaaacccgggacttcaggatcccctatcgtgaaccgagagggcaagatagtcggtctgtatgggaatggagtggttaccacgagtggcacatacgtgtctgcaatcgctcaagccaaagcgagccaggaaggcccacttcccgagattgaggacgaagtctttcggaagcgcaacctgactaccatggatttgcaccctgggtccggaaaaacaagaaggtatctaccggccatcgtgcgggaggcaattaagcgaaagctgagaaccctcatcttagctccaactcgcgtagtggcctcagaaatggctgaggcactgaaaggtatgcccataaggtaccagaccacagccgttaagtctgaacatacgggcaaagagattgtcgaccttatgtgccacgccactttcaccatgcgtctgctcagccctgtgcgggtgccaaattataacatgatcatcatggatgaggctcattttacagaccccagttccattgcggcaagagggtacatcagcaccagggtcggaatgggcgaagccgctgccatattcatgactgcaacacctccgggttctgtagaggcctttccccaatcaaatgctgtgattcaggatgaagagcgcgacatcccagaacgatcctggaacagtgggtatgagtggattaccgatttccctggaaagacggtttggtttgtgcccagcatcaaatcgggcaatgacatagcgaactgtttgagaaagaatggcaagcgggtcattcagctgtctaggaaaactttcgatacagagtaccagaagaccaaaaacaacgactgggactacgtggttaccactgatatctccgaaatgggggccaatttccgcgcagaccgtgtgatcgatccaagacggtgcctcaagcctgtcattctgaaagacggacccgagagggtgatccttgctggtccaatgccggtaacagtggccagcgcagcccaacgccgaggcagaattgggcggaaccctaataaggaaggagatcagtatatatacatgggccagcccctaaacaatgacgaggatcacgctccatggaccgaggccaagatgctgttggacaacatcaatacacccgaaggtattatccctgcgttatttgagccagaaagggagaaatcagcagccatcgatggggaatatcgcctgagaggcgaggctaggaagactttcgttgagctcatgcggcgtggagacctgcccgtctggcttagttacaaagtggcctctgaaggctttcagtattccgatcgccgatggtgcttcgacggggagagaaacaatcaagtgctggaagagaacatggatgtcgaaatttggacgaaggagggagagaggaaaaagctccggcctcgctggttggacgctagaacctacagcgacccgctggcactaagggaatttaaagagttcgccgctggtcggcgatcagttagtggcgatctgatactcgaaatcgggaagcttccacagcatctgacacagagagcccagaatgcattagacaacttggtgatgctgcacaatagcgagcaaggaggccgcgcgtataggcacgccatggaagagctccccgatactattgagaccctgatgcttctggctctcatcgccgtattgacaggtggggtgaccctgtttttcttatccggccggggactaggcaagacttctattgggctgctctgtgtcatggcaagctccgtgcttctgtggatggcttcagttgaacctcattggatcgccgcatctataatcttggagtttttcctgatggtgctcctgattcccgaaccagaccgtcagagaacgcctcaggataaccagcttgcctacgtcgtaatcggactcctgtttatgattttgaccgtggctgcgaatgagatgggtctgttagagacaactaaaaaggacctaggcatcgggcacgttgccgtggaaaaccatcaccacgcagctatgctggatgtcgacctccatcccgccagtgcctggaccctttacgcagtggctacaaccataattactccaatgatgaggcacacaatcgagaacacgaccgccaatatttcgctgactgcgatcgctaaccaagccgcaatattgatgggactggataaaggctggcctatcagcaagatggacattggtgtcccgctcctggcccttgggtgctattcccaggtgaatcccttaacactgaccgctgcagttctcatgttggtggcccattacgcgatcattggcccaggactgcaggctaaagccacccgcgaagcacaaaagcggacagccgctggcatcatgaagaaccctactgtagatgggatagtggccattgacctagatcccgtcgtttatgacgcaaaattcgagaagcagctgggacagatcatgctccttatcctgtgtacgtctcagattttgctgatgcgaaccacatgggctctctgcgaatcaatcactctggccaccggcccattaacaaccctttgggagggtagccctgggaaattttggaatactacgatagcggtgtccatggccaacattttcagaggaagttacctggcaggcgctggtctcgccttctctctaatgaagagcctgggcgggggaaggcgcggcacaggggcacaaggagagaccttgggcgaaaaatggaagcggcagctgaatcagctctcaaagtccgagtttaacacttataaaagaagtggtatcatggaagtcgaccgtagcgaggctaaggaagggcttaaaaggggagagaccacaaagcacgccgtgtctcggggcactgccaaactgcgctggttcgtagagcgaaatttggtgaagcccgaaggtaaggttattgatctgggctgtgggagaggaggctggtcctactattgcgcggggctcaaaaaggtgaccgaggtcaaaggatacacaaagggcggtccggggcatgaagagccaatccctatggctacgtacggatggaacttagtgaaactgcactcaggcaaggacgtctttttcatacccccagaaaaatgtgatacccttctgtgcgacatcggcgagagctcgcccaatcctactattgaggaagggaggacactacgggtgctcaagatggttgagccgtggctgcgcggaaaccagttttgtatcaagattttgaatccctatatgccatctgtagtggaaaccctggagcaaatgcagagaaaacacggtggcatgctcgtcaggaaccctcttagtcgaaattccactcatgagatgtactgggtgagctgcgggacaggaaacatcgtttcagcagtgaatatgacctcccggatgctgttaaaccgtttcacgatggcccacagaaagcccacctatgaacgcgatgtcgacctgggcgctggtacaaggcatgtggccgtagagcctgaagtggcaaacttggatattatcgggcagcggatagagaatattaaacacgaacacaagtctacttggcattacgacgaggataacccatataaaacctgggcctaccacggaagctatgaggttaagcccagtggctccgctagctctatggtcaatggcgtggtgaagctcctgacaaaaccttgggacgtcatcccaatggttactcagatcgcgatgaccgatacaaccccctttgggcaacagagagtgttcaaggaaaaagtagacactcgcacgccgaaggccaaaaggggaacagcacagattatggaggtgaccgctaagtggctatggggttttctttcacgaaacaagaaacctcggatatgtactagagaagagttcaccaggaaggtccgcagtaatgccgcaatcggcgccgtgtttgttgacgaaaaccaatggaattccgctaaagaggccgtggaggatgaacgtttctgggacctggtccatcgggagagagaactccacaagcaggggaaatgcgcgacatgcgtgtacaacatgatgggaaagagggagaagaaactgggcgaatttggtaaggcaaaagggagccgcgccatttggtacatgtggttgggagctcgattcctggagttcgaggccctcggctttatgaatgaagatcattggttctctcgggagaactcgctttcaggcgtagaaggggagggactgcacaagttaggttatatcctgagagacattagcaaaatcccaggcgggaatatgtacgcagatgacacggctggatgggataccaggataactgaggacgatttgcagaacgaagccaagatcacagacattatggagcccgaacacgctctcctggccaaatccatctttaagctaacctatcagaataaggttgtgcgcgtccaaagacctgcaaaaaacggcactgtgatggatgtgattagtcggagggaccagcgtggttctgggcaggtcggaacatacggccttaataccttcacaaacatggaggcgcagctgatccgacaaatggaaagcgagggcatattttccccatcagagctcgaaactcccaacctggccgggcgcgttttggattggttagagaagcatggagtggaaagactgaaacggatggctattagtggtgacgactgtgtagtgaagccgatcgatgacaggttcgccaccgcactcacggctcttaatgatatgggcaaagtccgcaaggacatccctcagtgggagccctctaaggggtggaacgattggcagcaggtgccattttgcagccaccatttccaccaactgattatgaaagacggaagagaaatagttgtgccttgtcggaatcaggatgagctagtcggcagggcccgagtgtcccagggtgcagggtggtcactgcgtgagaccgcctgcctcggaaagagctatgcgcagatgtggcaattgatgtactttcacagacgcgacctgcggcttgctgccaacgcaatctgttctgccgtacccgttgattgggtgccaacatccaggactacctggagtattcatgctcaccatcagtggatgacaactgaagacatgctgagcgtctggaatagagtgtggatcgaggaaaacccctggatggaggataaaacccacatttcgtcctggggcgacgttccttatctcggcaagcgcgaagaccagtggtgcgggtctttaatcggactgacggcccgggcaacatgggctaccaatatacaagtggccatcaaccaggtcaggcgattgctgggtaatgagaactacctcgattacatgacttcaatgaaaagattcaagaatgagagcgacccagaaggcgcgctttggtga

SEQ ID NO: 13908 - RNA, 9879 nt, synthetic construct
  misc_feature 1..9879: note = derived and/or modified CDS sequence (opt3) from DENV-1__GU131731__SS-prME
  source 1..9879: mol_type = other RNA
agcgtgaccatgctgctcatgcttatgcccaccgcactggctttccacttgactacgagaggaggggaacctcatatgatcgtaaccaagcaggaaaggggaaaatccttactgtttaagacatctgccggtgttaacatgtgcactctaattgccatggacctcggcgagctgtgtgaagataccatgacctacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgtcagcttgttccccctgtgtttaagtaccacgtctcagaagacaacctggctcccggtgctgcttggctccctggggtgcaaacctttgactatgtttctcattacagagaataagatctggggaagaaaaagctggccactgaacgaaggtataatggctgttggcgtggtctcgatcctactgtcatctcttctcaagaacgatgtgcccctggccgggcctttgattgccggaggcatgttaatcgcttgttatgtaattagtggttccagcgcagacctgtctctcgagaaagccgcggaggtgagctgggaagaggaagctgagcactccggggcctcacataatatcctggtcgaagttcaggatgacggaaccatgaagataaaagatgaggagagggacgatactcttacaattctgttgaaggcaaccctactggccgtgagtggcgtgtaccccctcagcatcccagctacgctgttcgtctggtatttttggcaaaagaaaaagcagcgatctggcgtgctttgggacactccttcacccccagaagttgagcgcgcagtattagatgacgggatctaccggattatgcagagaggactgctcggtaggagccaggtgggcgtcggggtgttccaagaaaacgttttccacaccatgtggcacgtgacacgtggagccgtcttgatgtatcagggcaaacgcctggagccgagttgggcgagcgtgaagaaagacctcatatcctacggtgggggatggcggctgcagggctcttggaataccggcgaggaagtacaggtcatcgctgtggagcctgggaagaaccccaagaatgttcaaacagccccaggaacttttaaaacccccgaaggtgaggtgggcgcaattgcccttgatttcaagcctgggacgtcgggaagcccaatcgtcaacagagaaggcaaaattgtgggtctgtacgggaatggagttgtgacaacttcaggcacctatgtctccgctatcgcccaggcaaaggctagtcaggagggccccttgcctgagatagaagacgaggtgtttaggaaacgaaacctaacaatcatggatctgcatccggggtctggaaagacccggcgctacctcccagccattgtaagagaagcgatcaagaggaaattacggactctgattcttgcccccacccgagtggttgcaagcgagatggctgaagccctgaagggtatgcctatcagatatcaaacaacggctgtcaaatccgagcacactggcaaggagatagtggacctcatgtgccatgcaaccttcacaatgcgcttgctgtcaccagtgagggtccccaattacaacatgattatcatggatgaagcccactttaccgacccttctagcatcgccgctcgtgggtatattagtactcgggtaggaatgggcgaggcggcagccatcttcatgacagctaccccgcccggttccgtggaagcctttccacagagcaatgcagttatacaggatgaggaaagagacattcctgagaggtcttggaactcagggtacgagtggatcacggatttccccggaaaaactgtgtggtttgtcccatccattaagagtggcaatgacatcgccaactgtctccgcaagaatggcaaacgagtgatacagctgagcagaaagacattcgataccgaatatcagaaaaccaagaacaacgactgggactacgttgtgactacagatatttcggagatgggggctaattttcgggcggacagggtcatcgatcctcgccgttgccttaaacccgtgatcctaaaggacggaccagaaagagtaattctggccggtccgatgcctgtgaccgttgcatctgctgcccagcggaggggccgcatcgggcgaacacataacaaggagggagatcagtacatttccatgggccagcccttgaatactgcagaggaccacgccccatggacggaagctaaaatgttactggataacataaatacccccgagggtatcattcctgccctcttcgaaccagagagagaaaagagcgcggcaatcgacggggagtatcggctgaggggcgaggcccgcaaaacattcgtcgaacttatgagaaggggagatctgcccgtgtggctctcatacaaggtggctagtgagggctttcaatattctgaccggcgttggtgcttcgatggggaacgcaacaatcaggtcttggaggaaaacatggacgttgagatctggactaaagagggagaacgaaagaaactgagacctaggtggctagatgcccggacctactccgacccgctggctctccgcgagtttaaggagttcgcagccggtagaaggagcgtgtcaggcgaccttattctggagatagggaagttaccacagcacttgacacagcgggctcaaaatgccctggataacctcgtaatgctgcataatagtgaacagggaggccgagcatatagacacgcgatggaggagcttcccgacaccatcgaaactctgatgctcttggccctgattgctgtgttaacgggtggggtcaccctatttttcctgagcggccgcggactcggcaaaacatccatcgggcttctgtgtgtgatggcctctagcgttttgctgtggatggcatccgtggagcctcattggattgctgcctcaatcatactcgaatttttcctgatggtccttctcatccccgagccagataggcagcggactcctcaggacaaccaactggcatacgtagtgattggattgctgtttatgatcttaaccgttgccgctaatgagatgggtctactggaaacaaccaagaaagatctcggcattgggcacgtggcggtcgagaaccaccatcacgccactatgcttgacgtggatctgcatcccgcatctgcttggacattgtatgccgtcgccacgaccatcataactccaatgatgcgtcacacaattgaaaataccaccgcaaacatcagtctgacagctattgccaaccaggcggctatcctcatgggactggacaagggctggcctatatcgaaaatggatatcggtgtgccgcttttagccctggggtgctacagccaggttaatcccctcactttgacggcagccgtgctgatgctagtagctcattacgcaattatcggcccaggactgcaagccaaggcgaccagagaggctcagaagaggacagccgcaggcattatgaaaaaccctactgtggacgggatcgtcgccatagatctcgaccccgttgtgtatgatgctaagttcgaaaaacagcttggacagattatgctgttgatcctgtgtacctcccaaatcctcctgatgcgcacaacctgggccttatgcgagtctattactcttgcaacgggcccactgacaaccctctgggagggttcacctgggaagttttggaatactaccatcgctgtcagcatggccaacatattccggggatcctacctagcgggcgccggtctggcatttagtttgatgaaatctctgggcgggggacgaagaggcacaggggctcagggagaaactctcggcgagaagtggaagaggcagcttaatcagctgagcaaatcagagttcaacatttataagcgctccggtatcatggaggtggaccggagtgaagccaaagaggggttgaagagaggagagaccacacgtcacgcagtaagcaggggcacggctaaactgcggtggttcgtggaacgcaatctcgttaagcccgagggtaaggtgattgacttaggctgtgggcgaggaggctggtcttactattgcgccgggctgaaaaaggtcaccgaagtgaaaggatacactaagggcggtccggggcacgaggatccaatccctatggccacatatggatggaaccttgtcaaactgcattccggcaaggacgtgtttttcacacccccagaaaaatgtgatactctactctgcgacataggcgagtcaagccccaatcctacaatcgaggaagggagaaccctgagggttttgaagatggtagagccgtggctgcggggaaaccaattttgtattaagatcctcaatccctacatgccatcggtggtcgaaacgcttgagcagatgcagcgcaaacacggtggcatgctggtgagaaaccctttatctaggaatagtacccatgagatgtactgggtttcctgcgggacaggaaacattgtgagcgcggtcaatatgacttcacgaatgctgttgaaccggttcaccatggctcaccgtaagcccacatatgaaagagatgtggacctcggcgcaggtactcgccacgtagccgtggagcctgaagttgctaatctggatatcattgggcagaggatcgagaacataaaacatgaacacaagtccacctggcattacgacgaggataacccatataaaacatgggcctaccacggatcttatgaggtcaagcccagcggcagtgcatccagcatggtgaatggcgtggtcaagctacttaccaaaccttgggacgttattccaatggtgactcaaatcgccatgacggatacaaccccctttgggcagcagcgggtattcaaggaaaaagtggacactagaaccccgaaggctaaacgcggaacagcgcaaatcatggaggtcacggccaggtggctgtggggttttctctctcgaaacaagaagcctcggatttgtaccagagaagagttcactaggaaagtgcgctcaaatgcagctataggcgccgtttttgtggacgaaaaccagtggaatagtgcaaaggaggccgtcgaggatgaacgtttctgggacctggtgcagaaagagcgggaattgcataagcaggggaaatgcgctacatgcgtatacaacatgatgggaaagagagagaagaaactgggcgaatttggtaaggccaaagggtccagggcgatctggtatatgtggctcggagcacgcttccttgagtttgaggccctgggcttcatgaatgaagatcactggttcagccgagagaactctttatcgggcgttgaaggggagggactgcacaagttgggttacattctccgggacatctcaaaaattccaggcgggaatatgtacgctgatgacaccgccggatgggatactagaatcacagaggacgatctgcaaaacgaagcaaagataaccgacatcatggagcccgaacatgctctacttgccacaagcatttttaaactgacttatcagaataaggtggtcagggtgcagcgccctgctaagaacggcaccgtgatggatgtcatctccagacgggaccagaggggtagtgggcaagttggaacgtacggcctcaataccttcacaaacatggaggcccagctgattcgtcagatggaatctgagggcatctttttgccaagcgagttagaaactcccaatctggcagagcgagtgctcgattggcttgaaaaatatggggtagagcgcctgaagagaatggcgatatccggagacgactgtgtggtcaaaccgattgatgaccggttcgccaccgctctaacagccctgaacgatatgggtaaggtgaggaaagacatccctcagtgggaaccctcaaagggctggaacgattggcaacaggttccattttgcagtcaccatttccaccagctcatcatgaaggacgggcgcgagattgtggtcccttgtagaaatcaggatgagttggtgggacgggcaagggtatctcaaggcgctggttggagcctgcgagaaactgcctgccttgggaaatcctacgcacagatgtggcagctgatgtattttcaccgtagagacctccgcttagccgcgaacgctatatgttcagccgttcccgtggattgggtcccaaccagccggacgacatggtctatccatgcacaccatcaatggatgaccactgaggacatgctgtccgtgtggaatagggtttggattgaagagaacccctggatggaagataagacacacgtgagtagctggggagacgtcccttacttgggcaaaagagaggaccagtggtgcggctcgctgatcgggctcaccgcccgcgctacttgggcctccaatattcaggtggcaatcaaccaggtacggaggcttataggaaatgagaactatctggattacatgacctctatgaagcgattcaaaaatgaaggtgacccagagggcgctctatggtga

SEQ ID NO: 13909 - RNA, 9879 nt, synthetic construct
  misc_feature 1..9879: note = derived and/or modified CDS sequence (opt3) from DENV-1__GU131733__SS-prME
  source 1..9879: mol_type = other RNA
agcgtgaccatgttcctgatgctcatgcccacagcccttgcttttcacctgactacgcggggaggggaacctcatatgatcgtctccaagcaggaaaggggaaaatctttgttattcaagacctcagccggtgttaatatgtgcacactgattgccatggacctaggcgaactctgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctctggcaccccatgtcggccttggtctggagaccagaacagaaacttggatgtcctctgagggggcatggaaacagatccagagggtggaaacctgggccttgcggcaccctggatttacagttattgctctcttcctggcacatgccatcggcacctcgattacgcagaagggcatcatatttatcctgctcatgttagtgactccatcaatggctatgcgctgcgtcgggattggaagcagagatttcgtggagggtctgagtggcgccacatgggtagacgttgtgcttgagcacgggtcctgtgtcaccactatggcgaaggataaacccacattggacatcgaactgctaaagaccgaggtgacgaaccctgcagtgctcaggaaactgtgcattgaagccaagatctctaataccacaactgatagccggtgtccaacccaaggagaggctacacttgtcgaagaacaggacgccaactttgtttgccgccgaactttcgtggatagaggctggggtaatgggtgtggactgtttggcaaaggctccttgataacctgcgcaaagttcaagtgcgtaacaaaactcgaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagttaactgactacggggcgctgacactcgattgtagcccaaggacgggacttgactttaacgaaatggtcctgttgaccatgaaggagaaatcttggctagtgcataagcagtggttcctggatctcccgctgccctggacttccggcgcctcaacaagccaagagacctggaatcggcaggaccttctggtaacatttaaaactgcacacgctaagaagcaggaagttgtggtcttgggtagtcaagagggggccatgcacaccgctctcacgggcgccaccgaaatccagacatctggaactaccacaattttcgcaggccatctgaaatgccgtttaaagatggataaactgactctaaaggggatgtcctatgtgatgtgtaccgggtcgttcaaactcgagaaggaactggccgagacgcagcacggtacagtccttgtgcagataaagtacgagggcaccgacgctccttgcaaaatcccattttcgactcaagatgaaaagggggttacacagaacggacgcttgattaccgcgaatcccatcgtgactgacaaagagaagcctgtaaacatagaagcagagccacccttcggcgagtcttatattgtcatcggtgccggggaaaaagctctgaagctctcctggtttaagaaaggctcaagtatcggaaagatgttcgaggccaccgcaagaggcgccaggcggatggctattctgggggatacagcctgggactttggaagcatcggtggcgtgttcacgtccgttgggaaacttgtgcatcagatttttggaaccgcatacggcgtcctgttctctggtgtgagctggactatgaagatagggatcggcgtattgctcacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatctttgtcaccaatgaggttcacacgtggacagaacaatataagttccaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagtttactgtggtagtcggcgatgtggcagggattctggctcagggcaagaagatgatccgccctcaacccatggagtacaaatattcgtggaaaagctggggcaaggccaagataatcggggcggacgttcagaataccacattcattatcgatggaccaaacactcctgaatgtcccgacgatcagagagcctggaatatttgggaggtggaggactacggctttggtatcttcaccacaaacatatggcttaagttgagggattcctatacgcaggtctgcgaccaccgtctcatgtcagctgcaattaaagatagtaaggccgtgcacgctgacatggggtactggatcgaatctgagaaaaatgaaacctggaagctggcccgggcatccttcattgaggttaagacttgtatctggccaaaatcccatacactatggtcaaacggagtgctggaaagcgagatgataatccccaagatttatggcggtcctatctctcaacacaattaccgaccaggctactttacccagactgcggggccgtggcatctcggaaaactggagcttgatttcgacttgtgcgaaggcacaaccgtagtcgtggatgagcactgcgggaacagaggaccctccctgaggacgactaccgtgacaggcaagattatccacgaatggtgttgccgcagttgtaccttacctccactccggtttagaggtgaggacgggtgctggtatggaatggagataaggcccgtcaaagaaaaggaggaaaatctggttaagagcatggtgtctgccggctccggtgaggtagactcattcagtcttggcctgttgtgtattagcatcatgatcgaagaggtgatgcgctcgcgatggtcccggaaaatgctcatgactgggacactggctgtctttttcctactgattatgggacagctcacctggaacgatctgatccgtctttgcattatggtgggcgccaatgcatctgacagaatggggatgggaacaacttacttggctctgatggccacctttaagatgaggcctatgttcgcagttggcttactctttcgccggctgacgagcagagaggtgcttctgctaacaataggtctctcactggtcgccagtgtggaattgccaaactccctggaggaattaggggatggactcgctatgggcatcatgattctgaaacttctgaccgacttccaatctcatcagttgtgggcgactctcctgagcctaacctttatcaagacaactttctccctgcactatgcctggaaaaccatggcaatggttctttcaattgtgagcctctttcccctgtgtttgagtacgacatctcagaagaccacttggctgccggtcttactcggctccctggggtgcaagcctcttacaatgttcctgatcgctgagaataaaatatggggaaggcgaagctggccattgaacgaaggtatcatggccgtaggcattgtgtcgatcctcctgtcatctctactgaagaacgatgttccccttgccgggcctctcattgctggaggcatgctgatcgcatgttacgtgataagtggttccagcgccgacttgtctttagagaaagcggctgaggtcagctgggaagaggaagccgagcattccggggcatcacacaatattctggtggaagtacaggatgacggaaccatgaagatcaaagatgaggagcgcgacgatactctcacaatcctgcttaaggccaccctgttggctgtgagtggcgtctatcccctaagcattccagcaacgctgttcgtttggtacttttggcagaaaaagaagcagcggtctggcgtgctctgggacactccttcacccccagaagtggagagagccgtcctggatgacgggatatataggatcatgcagcgtggacttttaggtcgcagccaggtgggcgttggggtattccaagaaaacgtgtttcataccatgtggcacgtcacacggggagcggtgctgatgtaccagggcaaaagactcgagccgagttgggctagcgttaagaaagacttgatttcctacggtgggggatggaggctgcagggctcttggaataccggcgaggaagtgcaggtcatcgccgtggagcctgggaagaaccccaaaaatgtacaaacagcaccaggaactttcaagacccccgaaggtgaggtcggcgccattgctctcgattttaagcctgggacgtcgggaagcccaatcgtgaaccgagaaggcaaaatagttggtctgtatgggaatggagtggtcacaacttcaggcacctacgtgtccgccatcgcacaggctcgggccagtcaggagggcccccttcctgagattgaagacgaggttttccgcaagagaaacctgacaatcatggatttgcacccggggtctggaaaaaccaggcggtatctaccagcgattgtgcgagaagccatcaagagaaaactgcgcactctcatattagcacccaccagggtcgtggctagcgagatggccgaagctctgaagggtatgcctattcgttaccaaacaacggcagtaaagtccgagcatactggcaaagagatcgtggaccttatgtgccacgccacctttacaatgcggctgctctcaccagttagagtccccaattataacatgatcattatggatgaagcccatttcaccgacccttctagcatcgctgcgagggggtacataagtactcgcgtgggaatgggcgaggcagccgctatttttatgacagccaccccgcccggttccgtggaagcattcccacagagcaatgccgtcatccaggatgaggaacgagacattcctgagagatcttggaactcagggtatgagtggatcacggattttcccggaaagactgtatggttcgtgccatccataaaaagtggcaatgacattgctaactgtttgcggaagaatggcaaaagggttatccagctgagccgcaagacattcgataccgaataccaaaagaccaaaaacaacgactgggactacgtggtcactacagatatctcggagatgggggcgaattttcgtgccgacagagtgattgatcctcggaggtgcctcaagcccgttatcctgaaagacggaccagaacgcgtgattcttgcaggtccgatgcctgtcaccgtggcttctgccgcacagcgaagaggccggatagggaggaaccacaataaggagggagatcagtatatctacatgggccagcccctaaacaatgacgaggatcatgcccactggacagaagctaaaatgctgttggacaacattaatactccagagggtatcatccccgccttattcgaacctgagcgcgaaaagtccgcggcaattgatggggagtatagactgaggggcgaggcccggaagacgtttgtagaactcatgcgtcgcggagacctgccagtgtggcttagctacaaagttgcttcagagggcttccaatatagtgatcgaagatggtgctttgacggggaaaggaacaatcaggtcctggaggaaaacatggatgtggagatatggaccaaggagggagaacggaaaaagctccgccccagatggttggacgccaggacatactctgaccctctggctctacgggagttcaaagaatttgcagccggtcgaagatccgtgagcggcgatctgatcctcgagattgggaaacttccgcagcacctgactcagcgcgctcaaaatgccttagacaacttggtcatgctgcataattcagaacagggaggcagggcatatcggcacgcgatggaggagctcccagataccatcgaaacactgatgcttctggccctcattgctgttttgaccggtggggtgactctgttctttttaagtggccgtggactaggcaaaacgagcatcgggctgctctgtgtaatggcctcctctgtgcttctgtggatggcaagcgtcgagccccattggatagctgcctccatcattttggagttctttctgatggtgctcctgatccctgagcccgacagacagaggaccccacaggataaccaacttgcatacgttgtgattggactcctgttcatgatcttgacagtcgccgctaatgagatgggtctgttagaaactaccaagaaggacctaggcatagggcacgtagcggtggagaaccaccatcacgccgcaatgctggatgttgacctccatcctgcttcagcctggacactttacgccgtggcaaccactattatcacacccatgatgcgccacacgattgaaaacaccactgctaatatctctctgacagccatagcgaaccaggctgccatcttgatgggactggataaaggctggccaattagtaagatggacatcggtgtccctctcctggcacttgggtgctatagccaggtgaatccgttaaccctgaccgccgctgtcctcatgttggtggcacattacgccattatcggccccggactgcaagcgaaagctacacgggaggcccagaagcgaactgcagccggcataatgaaaaacccaacggttgatgggattgtggctatcgacctagatcctgtagtgtatgacgccaagtttgaaaagcagctgggacagatcatgctccttattctgtgtaccagccaaatcttgctgatgagaacaacttgggcactctgcgagtccataaccctggctacaggccccttaaccactctttgggagggttctccagggaaattctggaatacgacaattgccgtctcaatggcgaacatcttcaggggaagctacctggccggcgcaggtctcgctttttccctaatgaagagtctgggcgggggacgccggggcaccggggcccagggagaaactttgggcgagaaatggaagagacagctgaatcagctctctaaaagcgagttcaacacctataagcgttcaggtattatggaggttgacaggtccgaagcaaaggaggggcttaaacggggagagacaactaagcacgctgtgagtcgcggcaccgccaaactgcgatggtttgtcgaaagaaatttggtgaagcctgagggtaaagtaatcgatctgggctgtgggaggggaggctggagctactattgcgccgggctcaagaaggtgacagaagttaaaggatacacgaagggcggtcccgggcacgaggaaccgataccaatggcgacctacggatggaacttagtgaaactgcattctggcaaggacgtcttctttatccctcccgagaaatgtgatactcttctgtgcgacattggcgagtcctcaccaaatcccacaatcgaagaggggcggaccctacgcgtgctcaagatggtcgaaccttggctgagaggaaaccaattctgtattaaaatcttgaatccgtatatgcccagcgtggttgagactctggagcagatgcagaggaagcacggtggcatgctcgtacgaaacccactttcgagaaattctacacatgaaatgtactgggtgagttgcgggaccggaaacattgtctccgctgtgaatatgacgagccgtatgctgttaaacagatttaccatggcacaccgcaagcctacatatgagagggatgttgacctgggcgccggtactcggcacgtggctgtcgaacccgaggtggccaacatcgatataattgggcagagaatcgaaaatatcaaacatgagcacaagtcaacctggcattacgacgaggataacccttataaaacatgggcataccacggatcctatgaagtaaagccatctggcagcgccagttccatggtgaatggcgttgtcaaattgctcactaagccctgggacgtgattcctatggtgacccaaatagctatgacagataccactccattcgggcagcagcgcgtctttaaggagaaagttgacacgaggacacccaaggcgaaacgaggaaccgcccaaatcatggaagtgactgcaaagtggctgtggggtttcctaagccggaacaaaaagccgagaatttgtaccagggaggaatttacacgcaaggtacgttctaatgctgccatcggcgcagtgttcgtcgacgagaaccagtggaactcagccaaagaggctgtggaagatgagcggttttgggaccttgttcatagagaaagggagctgcacaagcaggggaaatgcgccacgtgcgtgtacaacatgatgggaaagcgcgagaaaaagctcggcgagttcggtaaggcgaaagggagtcgagcaatttggtacatgtggctgggagcccggttcttggagtttgaagctctgggcttcatgaatgaggatcactggttttccagagaaaacagcctctctggcgtcgagggggagggacttcataagctgggttatatcttaagggacatatcgaaaatccctggcgggaatatgtacgccgatgacaccgcaggatgggatactcgcattacagaagacgatctgcagaacgaggctagaatcaccgacattatggaaccagagcacgccttgctcgctaagtcaatcttcaaactgacttatcaaaataaggtggtacgggttcagaggcccgccaaaaacggcacagtgatggatgtcataagccgtcgagaccagcgcggttccggacaggtgggaacctacggcctaaatacatttactaacatggaagcacaacttattagacagatggagagtgagggcatcttctctcctagcgaactggagaccccaaacctcgcggaacgggtgctggattggttggagaagtatggggtcgaaaggttaaagcgcatggccatctccggagacgactgtgttgtgaaacccattgatgacagatttgctacggccctgaccgcactcaatgatatgggtaaggtacggaaagacataccgcagtgggagccttcaaagggctggaacgattggcagcaagtgcccttctgcagtcatcactttcaccagcttatcatgaaagacgggagggagattgtcgtgccatgtcgaaatcaggatgaactggttggacgtgctagagtgtctcagggcgccggttggagcctacgcgagacagcatgcctggggaagtcctacgcccaaatgtggcagctcatgtatttccatcggagggacttgagactggcggctaacgccatctgttcagcagtccctgtggattggattcccactagccgcaccacatggtctatccacgcccatcaccagtggatgactaccgaagacatgctttccgtatggaatcgggtttggatagaggaaaacccatggatggaggataagacgcatatcagtagctggggagacgtgccctacctgggcaaaagggaggaccaatggtgcggctcgctcattgggttaacagctcgagccacctgggcaactaatatccaggtcgctattaaccaggtgagacggctgatcggaaatgaaaactacttggattatatgacatccatgaagaggtttaaaaatgagtctgaccctgaaggtgccctgtggtga

SEQ ID NO: 13910 - RNA, 9879 nt, synthetic construct
  misc_feature 1..9879: note = derived and/or modified CDS sequence (opt3) from DENV-1__GU131734__SS-prME
  source 1..9879: mol_type = other RNA
tccgtgaccatgctgctaatgcttatgcccaccgccctggctttccacttgactacgaggggcggggaacctcatatgatcgtctccaagcaggaaaggggaaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccgatcctgccgtgctcaggaaactgtgcattgaagctaagatctctaacacgaccacagacagccggtgtccaactcaaggagaggccacccttgtcgaagaacaagatgcaaattttgtttgccgccgaacattcgtggacagaggctggggtaacgggtgtggactgtttggcaaaggctccttgatgacttgcgctaagttcaagtgcgtaaccaaactcgaggggaagatagtgcagtacgaaaatctgaaatattcagtcattgtgacagttcacaccggagaccagcatcaagtgggtaacgagagtactgaacacggcacgacagccaccatcactccccaggcgcctagcaccgagattcagttaacagattacggggccctgaccctcgactgttctccaaggactggacttgattttaatgaaatggtcctgttgacaatgaaggagaaatcctggctagtgcataagcagtggttcctggacctcccgctgccctggacgtcaggcgcaagcaccagtcaagagacttggaaccggaaagatcttctggtaacatttaagaccgctcacgccaagaaacaggaagttgtggtcttgggttctcaggagggggctatgcacacagccctcactggcgcaaccgaaatccaaacgtccggaaccacaactatcttcgccggccatctgaagtgccgtttaaaaatggacaagctgaccctaaaagggatgagctatgtgatgtgtacagattcgttcaagctcgagaaggaagtcgctgagactcagcacggaaccgtgctggttcagattaaatacgagggtacggacgcgccttgcaagataccattttctacacaggatgaaaaaggcgtgacccaaaatgggcgccttatcactgcaaaccccattgtaacagacaaggagaaacctgtcaatatcgaagccgagccacccttcggagagtcctatatagtgattggcgctggtgaaaaggccttgaagctgtcatggtttaaaaaggggagtagcatcggcaaaatgttcgaggcaaccgccagaggagctaggcggatggccatcctcggcgatactgcatgggactttgggtccattggaggtgttttcacctctgtgggcaagctggtccatcagatctttgggacagcgtacggagtgcttttcagcggcgtatcatggacgatgaaaattggtataggggtgctgttgacctggctcggcctgaacagtcgatccactagcttatctatgacatgtatcgctgttggactggtcaccctatacctcggcgtgatggtgcaggccgactcagggtgcgtcattaattggaagggacgcgaactgaagtgtggcagtggtatctttgttacaaacgaggtgcacacttggaccgaacagtataaattccaagcagatagcccgaagagactttccgccgctatcgggaaagcctgggaggagggagtgtgcggcattaggtctgcaacgcggttggaaaatataatgtggaagcagatctcgaacgagctgaaccatattctcctggaaaatgacatgaaatttacagtagtcgtgggtgatgttgctggcatcttagcccaggggaagaaaatgattcgccctcagcccatggagtacaagtatagctggaagtcctggggaaaagcgaagatcataggcgccgacgtgcaaaacaccactttcatcattgatgggccaaatacccctgaatgtcccgacgatcagagagcttggaacatctgggaggtcgaggactacggatttggcattttcacaactaatatctggctgaaacttagggattcatatacccaggtgtgcgaccaccgtttgatgagtgcagccataaaggattctaaagctgttcacgccgacatgggttactggattgaaagcgagaagaacgaaacatggaagctcgcacgggcgtccttcatcgaggtgaaaacgtgtatttggccaaagtcacataccctgtggagcaatggggtactagaatctgagatgatcatacccaaaatctatggaggccctatttcccagcacaactaccgaccaggttactttactcaaacagccggcccgtggcatctggggaagctcgagctggatttcgacctttgcgaaggaaccactgtcgtggtggacgagcactgcggcaatagagggcccagtttgaggacaaccacggtcactggaaaaatcattcacgaatggtgttgccgcagctgtaccctgcctccattacggtttaagggcgaggatggttgctggtatgggatggagatcagacccgttaaggaaaaagaggaaaacctcgtgaagtctatggtatccgctggatcaggcgaggtggacagtttcagcctgggtcttctgtgtatatcgattatgatcgaagaggtcatgaggtcccgctggtctcgaaaaatgttgatgacaggcaccctcgccgtgtttttcctgctaatcatggggcagctgacttggaatgatctcattcggctgtgcatcatggttggagcaaacgctagcgaccgtatgggcatggggacaacctaccttgccttgatggcaacatttaagatgagacctatgttcgccgtgggactgttatttaggcgcctcacttcacgggaggtcctgcttctgaccattggcctaagtctcgtggcttccgttgaactgccaaattctttggaggaactgggtgatgggttagcgatgggaataatgatcctcaaactgcttattgacttccagagccatcaactgtgggccacgttgctctccctgacatttatcaagaccactttctcactacactatgcatggaagaccatggctatggtgctgagcattgtcagtctttttcccctctgtctgtctacaacttcccagaaaaccacgtggttgccggtactgttaggcagcctcggctgcaagcctctgacaatgttccttatcgccgagaacaaaatatgggggagaaagtcgtggccactgaatgaaggaatcatggccgtgggtattgtttcaatcttgctctctgctctgctcaagaatgatgtgcccctggcaggccctcttattgccgggggaatgctcatcgcgtgttacgtcataagtggctccagcgctgacctgtctttggagaaggccgcagaggtgagctgggaagaggaagccgagcattccggtgcttcacacaacattttagtagaagtgcaggatgacgggaccatgaaaatcaaggatgaggagagggacgatactctgacaatcctcctgaaggcaacccttctggccgtcagtggagtttatcccttgagcattccagcgactctattcgtgtggtacttttggcagaaaaagaaacaacgatctggcgtgctgtgggacacaccttcacccccagaagtcgagcgcgctgtgctcgacgatggcatatatcggatcatgcagagagggctgcttggaaggagccaggttggtgtaggcgtgttccaggaaaatgtctttcataccatgtggcacgtgacgcgtggggccgttttaatgtaccaaggaaagcgcctggagccgagttgggcaagcgtgaaaaaggacctcatttcctacggcggtgggtggcggttgcagggatcttggaacactggcgaggaagtccaggtgatcgccgtagagcctggcaagaatcccaaaaacgtccagaccgctccagggacattcaagacctcggaaggagaggtgggtgccattgcactggattttaaacccggcacaagcgggtcacctatcgttaatagagaaggaaagatagtgggcctctatggtaacggggtcgtgactacctccggaacgtacgttagtgctatcgcccaagcgaaagcctctcaggagggcccactgcccgagattgaagacgaggtgttcaggaagcgaaatcttacaatcatggatctgcaccctggcagcgggaagactcggcgctatttgccggcaattgtcagagaagctatcaaaaggaagctacggaccctgatactcgccccaacacgagtggtagcttccgagatggcagaagccttaaaaggaatgcccattagataccagaccactgccgtgaagtcagagcataccggtaaagagatcgttgacctgatgtgccacgctacatttacgatgcgccttctgtctcctgtcagggtgccaaactataatatgatcattatggatgaagcgcatttcactgaccccagcagtatcgcagcccgtggctacatatccacccgggtggggatgggagaggctgccgcaatttttatgacagccacccctccgggcagcgtcgaggctttcccccaatctaacgcggtaatccaggatgaggaaagagacattccagagaggtcatggaactccggttatgagtggatcactgattttcctgggaagacagtgtggttcgttcccagtataaagagcggaaacgacattgccaattgtctccgcaaaaacggcaagcgagtgatccagttgtcgagaaaaaccttcgacacggaataccagaagactaaaaataacgattgggactacgtcgtgacaaccgatatctctgagatgggcgcaaactttcgggctgacagggttattgatccacgccgttgcctgaagcctgtgatcctcaaggacgggcccgaaagagtcattctggccggaccaatgccggtgaccgtagcatccgccgctcaacggaggggtcgcataggccgaaatcacaacaaagagggggatcagtatatctacatgggacagcctcttaataacgacgaggatcatgcccactggactgaagcgaagatgctactggacaatattaacacacccgagggcatcatcccagcattgttcgaacccgagagagagaaaagcgccgctattgatggtgagtatcggttaagaggggaagcccgcaagacctttgtggaactgatgagaaggggcgacctccctgtttggctgtcatacaaagtcgctagtgagggattccagtattctgatcggcgttggtgctttgacggcgaacgcaataaccaagtgcttgaggaaaatatggacgtggagatatggacaaaggagggggaaaggaaaaagctgagaccaagatggctcgatgcacggacttactccgaccccttggccctgcgcgagttcaaggaatttgctgccggaagaaggagcgtctcaggtgatctaatcctggagattggcaaactccctcagcaccttacgcagcgggcacagaacgcgctggacaatttagttatgttgcataacagtgaacaagggggacgagcctatagacacgctatggaggagctgccggataccatcgaaacactcatgctgcttgccctgattgcagtgctcactggcggtgtaaccttgttctttctgagcgggcgcggcttaggaaagacatccatcggcctactgtgtgtgatggcttctagcgtcctcctttggatggcctccgtggagccacattggatagcagcctcaatcattctggagttctttttgatggttctgctcatccccgagcctgacaggcagcggacaccccaggataatcagctggcttacgtggtcattgggcttctcttcatgatcctgactgtagcggccaacgagatgggattgctggaaacgaccaaaaaggacttaggtataggccacgtggcagttgagaatcaccatcacgctgccatgctagatgtggacctgcatccagcctctgcatggacactctacgctgtcgccactaccattatcacacctatgatgcgtcacaccattgaaaacactacagcgaacatcagtcttacggctatagccaatcaagcagccatcctgatggggttggataaaggatggcccatttcgaagatggacatcggcgtgccactgctcgctctgggttgctatagccaggtcaaccctcttaccttaactgcagccgtgctgatgctcgttgcgcattacgctattatcgggccgggcttgcaggccaaggcaacaagagaggcccagaaaaggaccgctgccggaataatgaagaatcccaccgtggatggcattgtagcaatcgacctggacccagtggtctatgatgctaaatttgaaaagcagctagggcagatcatgctgctcattctttgtacatcccagatcctgttgatgcgcactacgtgggccctgtgcgagtctataaccctcgcgacaggacctctgactaccttatgggagggctcacccggtaaattctggaacacaaccattgccgttagcatggcaaatatcttccgggggtcctaccttgctggagccggcctggcatttagtctcatgaagtctctaggtggcgggcgaagaggaactggcgctcaaggggaaacgctgggagagaagtggaaaaggcagttgaaccagctgagcaagtcagagttcaatacatataaacgctccggcattatggaggtggaccggagtgaagccaaggagggtctcaaaagaggggagaccactaagcacgccgtcagccgtggaaccgcgaaacttaggtggtttgtggaacggaacctggtaaaaccagagggcaaggtgatcgatttgggttgtggccgcgggggatggtcttactattgcgctggcctgaaaaaggttacagaagtgaaagggtacactaagggaggccctggtcacgaggaacccataccgatggcaacctacgggtggaatctcgtcaaattacattccggaaaggacgtgttctttatcccacctgagaagtgtgatacactgctttgcgacattggcgagtcaagccccaacccaacgatcgaagagggccgaaccctgagagtcctaaaaatggtggaaccctggctcagggggaatcagttctgtattaagatcctgaacccttatatgccgtcggttgtagagactttggagcaaatgcagcggaaacacggaggtatgctggtgcgcaatcccctctctagaaacagtacacatgaaatgtactgggtctcctgcggcaccgggaatattgtgagcgccgttaacatgacttcaaggatgcttctgaatcgatttacaatggctcaccggaagccaacctatgagcgtgatgtggacttaggagccggcacgagacacgtcgcagtggaacctgaggtagccaacctggatatcataggtcagcgcattgaaaacatcaaacatgagcacaagtccacctggcattacgacgaggataatccctataagacatgggcttaccacgggtcttatgaagtgaaacctagcggaagtgcgtccagcatggttaacggcgtcgtgaagttgctcactaaaccatgggacgtgatccccatggtcacccagattgccatgacagacactacccctttcggccaacagagggtttttaaggagaaagtggatacacggaccccaaaggcaaagagagggactgctcagataatggaagtaacggccaaatggctgtggggattcctatctcgcaataagaaacccaggatctgtacacgagaggaatttacccggaaggtgagatcaaacgcagccattggtgctgtcttcgtggacgagaatcaatggaacagtgccaaagaggcggttgaagatgagaggttttgggaccttgtgcatcgcgaacgtgagctgcacaagcagggcaagtgcgcaacttgcgtctacaatatgatggggaaacgggaaaagaaactcggagagttcggcaaggccaaaggttccagagctatctggtacatgtggctgggggccaggttcttggagtttgaagcactgggattcatgaacgaggatcactggtttagccgcgaaaattctctctcgggcgtggagggcgaggggcttcataagctgggatatattttacgagacatctcaaaaataccgggtggcaacatgtacgctgatgacaccgccgggtgggatacacggatcacggaagacgatctgcagaatgaggctaagattaccgacatcatggaacctgagcacgccttgctcgcaaagagcattttcaaactgacttatcagaacaaggtagttagagtgcaaaggccagcgaaaaatggaacagtcatggatgtgatctcccgcagagaccagcggggcagtggtcaggtggggacctacggactaaacacttttacaaatatggaagcccagcttataaggcaaatggagtctgagggcattttcagcccctccgaactggagacccctaacctcgctggccgtgtcctggactggttggaaaagcatggggttgagcgattaaaacgcatggccatctcaggagatgactgtgtggtaaagccaatcgatgacagatttgcagctgccctgacagcactcaacgatatgggtaaggtgcggaaagacattccccagtgggaaccgagtaagggctggaatgattggcagcaggtccctttctgctctcaccactttcatcaacttataatgaaagacgggagggagatcgtggttccctgtcgcaaccaggatgagctggtgggacgagcacgggtcagccagggcgcgggttggtccctaagggaaactgcttgcctggggaagtcatatgcccagatgtggcaactcatgtacttccaccgacgtgacttgagactggcagccaatgctatttgtagcgccgtgccagtagattgggttcctacctctcgcacgacctggtccatccatgcacaccatcagtggatgacaactgaggacatgcttagtgtgtggaaccgggtctggattgaagagaatccctggatggaagacaaaacccacatcagctcgtggggagatgtgccatatctgggcaagagggaggaccagtggtgcggctccctcatagggttaacagctagagccacttgggcgaccaacatccaagttgctattaatcaggtgcgccggctgatcggaaacgagaattacttggattacatgacgtctatgaagaggtttaaaaacgaatcagaccccgagggtgccctgtggtga

SEQ ID NO: 13911 - RNA, 9879 nt, synthetic construct
  misc_feature 1..9879: note = derived and/or modified CDS sequence (opt3) from DENV-1__GU131738__SS-prME
  source 1..9879: mol_type = other RNA
agcgtgaccatgctgctcatgcttatgcccaccgccctggctttccacttgactacgaggggcggggagcctcatatgatcgtaaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagggattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgctggggaaaaagccctgaagctctcctggttcaagaaaggctcaagtattggaaagatgtttgaggcaaccgccagaggcgctaggcggatggccatcctgggggatactgcatgggacttcggaagcgtgggtggcgtttttacctccgtggggaaacttgtccatcagattttcggaacagcgtacggcgtgctgttttctggtgtaagctggacgatgaagatagggatcggcgtgttgctcacctggctgggattaaattcacgaagtacttccctgagcatgacatgtattgctgttggcctagtcaccctctacctgggggtgatggtgcaggccgattctggatgcgtcatcaactggaaaggccgcgaacttaagtgtggttcagggatcttcgttacaaatgaggtgcacacttggaccgaacaatataagtttcaggcagacagtccgaaaagattgagcgccgctattggaaaggcctgggaggagggcgtgtgcggtataaggtccgcaacgcggctggaaaacatcatgtggaaacagatttctaacgagctcaatcatatcctgttagaaaacgacatgaagttcacagtagtcgtgggcgatgttgtggggattctggctcagggcaaaaagatgatccgccctcaacccatggagcacaaatactcgtggaaaagctggggcaaggccaagataatcggggcggacgtccagaataccacttttattatcgatggaccaaacacccctgaatgtcccgacgatcagagagcctggaatatttgggaggtggaggactatggcttcggtatctttacaactaacatatggcttaagttgagggattcctacacccaggtttgcgaccaccgtctcatgtcagctgcaattaaagatagtaaggccgtgcatgctgacatggggtattggatcgaatctgagaaaaatgaaacatggaagctggcccgggcatccttcattgaggtaaagacgtgtatctggccaaaatcccacaccctatggtcaaacggagtcctggaaagcgagatgataatccccaagatttacggcggtcctatctctcaacataattatcgaccaggctacttcactcagacagcggggccgtggcacctcggaaaactggagcttgattttgacttgtgcgaaggcaccactgtggtggtcgatgagcactgcgggaacagaggaccctccctgaggacaaccacggttactggcaagattatccatgaatggtgttgccgcagttgtaccttacctccactccggttcaaaggtgaggacgggtgctggtacggaatggagataagacccgtgaaggaaaaggaggaaaatctggtaaaaagcatggtgtctgccggctccggtgaggtcgactcatttagtcttggcctgttgtgtattagcatcatgatcgaagaggtgatgaggtcgcgctggtcccgaaagatgctcatgacagggaccctggctgttttcctactgctcattatgggacagctgacttggaacgatcttatccggttgtgcattatggtgggcgccaatgcatctgaccgtatggggatgggaacaacctatctggctttaatggccacatttaaaatgagacctatgttcgcagtcggcctcctgtttaggcgccttactagccgggaggtgctgctactcaccataggtctgtcattggttgccagtgtggaactgccaaactccttagaggaactcggggatggactggctatgggcatcatgattcttaagctgttgacggacttccaatctcaccagctctgggcgacactgctaagcctgacctttatcaaaactaccctttccctccattacgcctggaagacaatggcaatggtcctgtcaattgtcagcttgttccccctgtgtttaagtactacctctcagaagacgacatggctcccggtgctgcttggctccctggggtgcaaacctttgaccatgtttctcatcactgagaataagatatggggaagaaaaagctggccactgaacgaaggtatcatggctgttggcgtggtctcgattctactgtcatctcttctcaagaacgatgtgcccctggccgggcctttgatcgccggaggcatgttaattgcttgttatgtaatcagtggttccagcgcagacctgtctctcgagaaagccgcggaggtgagctgggaagaggaagctgagcactccggggcctcacataatatactggtcgaagttcaggatgacggaacaatgaagattaaagatgaggagagggacgatacccttactatcctgttgaaggcaacactactggccgtgagtggcgtgtaccccctcagcatcccagctaccctgttcgtctggtatttttggcaaaagaaaaagcagcgatctggcgtgctttgggacacgccttcacccccagaagttgagcgcgcagtattagatgacgggatttaccggataatgcagagaggactgctcggtaggagccaggtgggcgtcggggtgttccaagaaaacgttttccacactatgtggcacgtgacccgtggagccgtcttgatgtatcagggcaaacgcctggagccgagttgggcgagcgtgaagaaagacctcatctcctacggtgggggatggcggctgcagggctcttggaatacaggcgaggaagtacaggtcattgctgtggagcctgggaagaaccccaagaatgttcaaaccgccccaggaacatttaaaactcccgaaggtgaggtgggcgcaatcgcccttgatttcaagcctgggacctcgggaagcccaattgtcaacagagaaggcaaaatcgtgggtctgtacgggaatggagttgtgacgacatcaggcacttatgtctccgctatagcccaggcaaaggctagtcaggagggccccttgcctgagatcgaagacgaggtgtttaggaaacgaaacctaaccattatggatctgcatccggggtctggaaagacacggcgctacctcccagccatcgtaagagaagcgattaagaggaaattacggaccctgatccttgcccccactcgagtggttgcaagcgagatggctgaagccctgaagggtatgcctataagatatcaaaccacagctgtcaaatccgagcacacgggcaaggagattgtggacctcatgtgccatgcaactttcaccatgcgcttgctgtcaccagtgagggtccccaattacaacatgatcatcatggatgaagcccactttacagacccttctagcattgccgctcgtgggtatatcagtacccgggtaggaatgggcgaggcggcagccatattcatgactgctacaccgcccggttccgtggaagcctttccacagagcaatgcagttattcaggatgaggaaagagacatccctgggaggtcttggaactcaggatacgagtggattaccgatttccccggcaaaacggtgtggtttggcccaactatcaagtccgggaatgacatagccaactgtctccgcaagaatggaaaacgagtcattcagctgagtagaaagacattcgataccgagtatcagaaaaccaagaacaacgactgggactacgtgggtactacagatatcagcgaaatgggcgctaattttcgggcggacagggttatcgatcctcgccgttgccttaaacccgtgattctaaaggacgggccagagagagtcatcctggccggaccgatgcctgtgaccgtagcatcggctgcccagcggaggggccgcattggtcgaaaccataataaggaaggggatcagtacatatatatgggccagcccttgaacaatgacgaggatcacgcacactggacagaggccaaaatgttactggacaacatcaatactccagaaggaattatccccgctctcttcgagcctgaaagagagaagtctgccgcgatcgatggcgaataccggctgagaggggaagcacgcaaaacgttcgtggagcttatgagaaggggagacctgccagtttggctctcctataaggtcgccagcgaaggttttcaatactcagatcggcgttggtgcttcgacggcgagcgcaacaatcaggtgttggaagagaacatggatgtggaaatttggaccaaagagggggagcgaaagaaactgagacccaggtggctagacgctcggacatatagtgaccctctggccctccgcgaatttaaggagttcgctgcaggaagaaggtctgtctccggcgatcttatactggaaatcggtaagttaccgcagcatttgactcagcgggcccaaaatgctctggacaacctcgttatgctgcacaatagcgagcagggaggacgagcctacagacatgcaatggaggagcttccagataccattgagacactgatgctcttggcgctgatcgccgtgttaaccggaggcgtaactctatttttcctgtcagggcgcggactcggtaaaacgagtattggccttctgtgtgtgatggctagctccgtcttgctgtggatggcctctgtggaaccccactggatcgcagctagcataatcctcgagtttttcctgatggttcttctcattcctgaacccgacaggcagcggaccccacaggataaccaactggcctatgtggtcatcgggttgctgtttatgattttaacagtagcagccaatgagatgggactactggagactaccaagaaagacctcggcatcggtcacgtggctgttgaaaaccatcaccatgcgacaatgcttgatgtggacctgcaccctgcctccgcatggaccttgtacgctgtcgccactacaataattacgcccatgatgcgtcataccatcgagaacactacagccaatatttcactgaccgcaatcgctaaccaggccgcgatactcatggggctggataagggctggccaatctctaaaatggacattggagtgcctcttttagctctgggctgctacagtcaggtcaatccgctcaccttgacagccgcagtgctgatgctagttgcccactatgctatcattgggcccggactgcaagcaaaggccactagagaagcgcagaagaggacggctgccggcatcatgaaaaacccaaccgtggatggtatagtagcaattgacctcgatcctgtggtctacgacgccaagttcgagaaacagcttgggcagatcatgctgttgatcctgtgtacatcgcaaattctcctgatgcgcactacctgggctttatgcgaaagcatcacacttgccaccggacccctgactacgctctgggagggctccccaggtaagttttggaatacaaccatagcagtttctatggctaacattttccggggctcatatctagccggggcgggactggcctttagcttgatgaaatccctgggcgggggacgaagaggcactggtgcacagggggagaccctcggagaaaagtggaagaggcagcttaatcagctgagtaaatctgagttcaacatctacaagcgcagcggcattatggaagtggaccggtcagaggctaaagaaggtttgaagagaggcgagacaactcgtcacgccgtctccagggggaccgcaaaactgcggtggttcgtggagcgcaatctcgtaaagcctgaaggaaaggtgatcgatttaggctgtgggcgaggaggctggagttattactgcgctggtctgaaaaaggttacagaggtgaaagggtatacgaagggaggccccggccatgaggagccgataccaatggccacctacgggtggaaccttgtcaaactgcacagcggaaaggacgtgtttttcactcctcccgaaaaatgtgatacactactctgcgacatcggtgagtcttccccaaatcccaccattgaggaaggcagaactctgagggtcttgaagatggtggagccttggctgcgggggaaccaattttgtatcaagattctcaatccgtacatgccctcagttgtagaaacacttgagcagatgcagcgcaaacatggaggcatgctggtgagaaacccattaagcagaaattcgacccacgagatgtattgggtctcttgcggtacggggaacatcgtgagtgccgttaatatgacctcccgaatgctgttgaaccggttcacaatggcgcaccgtaagcctacttacgaaagagatgtggacctcggagctggcacccgccatgtcgcagtggagcccgaagtagccaacctggatattatcggccagaggatagagaatattaaacacgaacataagagcacatggcactatgacgaggataacccttacaaaacttgggcttatcatgggtcatacgaggtgaagccatccggatctgccagcagtatggttaatggtgtcgtgaagctacttaccaaaccctgggacgtgatccctatggtcacacaaatcgcaatgaccgatactacgccatttggccagcagcgggttttcaaggaaaaagtggacacaagaacccccaaggccaaacgcgggactgctcaaattatggaggtaaccgcgaggtggctgtggggatttctctcccgaaacaagaagccgcggatatgtacaagagaagagttcacgaggaaagtgcgcagcaatgccgcaatcggcgctgtctttgtggacgaaaaccagtggaactctgccaaggaggcagttgaggatgaacgtttctgggacctgggtcagaaagagcgggaattgcacaagcaggggaaatgcgcaacctgcgtgtataacatgatgggaaagagagagaagaaactgggcgaatttggcaaggctaaagggtcaagggccatttggtacatgtggctcggagcgcgcttccttgagtttgaggcactgggtttcatgaatgaagatcactggttcagtcgagagaactccttaagcggcgtcgaaggggagggactgcataagttgggctacatcctccgggacatttctaaaatccctggtgggaatatgtatgccgatgacactgctggatgggatacaagaataaccgaggacgatctgcaaaacgaagccaagatcactgacattatggagccagaacacgcactacttgctacatcgatctttaaactgacctaccagaataaggtggtaagggttcagcgccccgccaagaacggcacagtgatggatgtcatttcaagacgggaccagaggggcagcgggcaagtgggaacttatggtctcaataccttcacgaacatggaggctcagctgatccgtcagatggaatccgagggcatatttttgcctagtgagttagaaaccccaaacctggccgagcgagtgctcgattggcttgaaaaatacggggtcgagcgcctgaagagaatggcaatttctggagacgactgtgttgtgaaacccatcgatgaccggttcgcgacagccctaactgctctgaatgatatgggcaaggtaaggaaagacatcccgcagtgggaacctagcaagggttggaacgattggcaacaggtgcccttttgctcccatcacttccaccagctcattatgaaggacgggcgcgagatagtcgtgccatgtagaaatcaggatgagttggttggacgggccagggtgtcacaaggcgcaggctggagtctgcgagaaaccgcttgccttgggaaatcttatgcccagatgtggcagctgatgtactttcatcgtagagacctccgcttagcagccaacgcgatctgtagcgctgtccctgtggattgggtacccacatcccggactacctggtcaattcacgcccatcaccaatggatgacgacagaggacatgctgagcgtttggaatagggtgtggatcgaagagaacccatggatggaagataagacccatgtctcttcctggggagacgtgccctatttgggtaaaagagaggaccagtggtgcggcagtctgattgggctcactgcacgcgccacatgggctagcaatatccaggttgccataaaccaggtgcggaggcttatcggaaatgagaactacctggattacatgacctcgatgaagcgattcaaaaatgaaggcgaccctgagggtgcactatggtga

SEQ ID NO: 13912 - RNA, 9879 nt, synthetic construct
  misc_feature 1..9879: note = derived and/or modified CDS sequence (opt3) from DENV-1__JF937604__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaacatgtgcacactaattgccatggacctcggcgaactgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagaccttcggaactgcatacggcgtgctgttttctggtgtaagctggacaatgaagattgggataggcgtgttgctcacctggctgggattaaattcacgaagtacatccctgagcatgacttgtatcgcggttggcctagtcaccctctacctgggggtgatggtgcaggctgattctggatgcgtcattaactggaaaggccgcgaacttaagtgtggttcagggatcttcgttacgaatgaggtgcacacatggaccgaacaatataagtttcaggccgacagtccgaaaagattgagcgcagccatcggaaaggcttgggaggagggcgtgtgcggtattaggtccgccactcggctggaaaacataatgtggaaacagatctctaacgagctcaatcatattctgttagaaaacgacatgaagttcaccgtagtcgtgggcgatgttgcagggatcctggctcagggcaaaaagatgattcgccctcaacccatggagtacaaatattcgtggaaaagctggggcaaggccaagatcataggggcggacgtgcagaatacaacttttatcattgatggaccaaacacccctgaatgtcccgacgatcagagagcctggaatatctgggaggtcgaggactacggcttcggtatttttacaacgaacatctggcttaagttgagggattcctatacccaggtgtgcgaccaccgtctcatgtcagctgcaataaaagatagtaaggccgttcacgctgacatggggtactggattgaatctgagaaaaatgaaacttggaagctggcccgggcatccttcatcgaggtgaagacatgtatttggccaaaatcccataccctatggtcaaacggagtactggaaagcgagatgatcatacccaagatctatggcggtcctatttctcaacacaattaccgaccaggctacttcactcagacagcggggccgtggcatctcggaaaactggagcttgattttgacttgtgcgaaggcaccacggtcgtggtggatgagcactgcgggaacagaggaccctccctgaggactaccacagtcaccggcaagatcattcacgaatggtgttgccgcagttgtactttacctccactccggttcagaggtgaggacgggtgctggtatggaatggagatcaggcccgttaaagaaaaggaggaaaatctggtaaagagcatggtatctgccggctccggtgaggtggactcatttagtcttggcctgttgtgtataagcattatgatcgaagaggtcatgcgctcgcgatggtcccggaaaatgctcatgacagggaccctggctgtgttctttctactgatcatgggacagctcacatggaacgatctgattcgtctttgcatcatggttggcgccaatgcatctgacagaatggggatgggaactacctacttggctctgatggccacgttcaagatgaggcctatgtttgcagtgggcttactcttccgccggctgacaagcagagaggtccttctgctaaccattggtctctcactggtggccagtgttgaattgccaaactccctggaggaattaggggatggactcgctatgggcataatgatcctgaaacttctgactgactttcaatcttatcagttgtgggcgaccctcctgagcctaacattcattaagactaccttttccctgcattacgcctggaaaacgatggcaatggtgctttcaatcgtcagcctcttccccctgtgtttgagtacaacctctcagaagactacatggctgccggtattactcggctccctggggtgcaagcctcttaccatgtttctgattgctgagaataaaatctggggaaggcgaagctggccattgaacgaaggtataatggccgtgggcatcgtttcgattctcctgtcatctctactgaagaacgatgtgccccttgccgggcctctcatcgctggaggcatgctgattgcatgttatgtcatcagtggttccagcgccgacttgtctttagagaaagcggctgaggtgagctgggaagaggaagccgagcactccggggcatcacataatatactggtagaagtgcaggatgacggaactatgaagattaaagatgaggagcgcgacgatacactcaccatcctgcttaaggccacgctgttggctgtcagtggcgtttaccccctaagcatcccagcaactctgttcgtgtggtatttctggcagaaaaagaagcagcggtctggcgtgctctgggacaccccttcacccccagaagtcgagagagccgtgctggatgacgggatttacaggataatgcagcgtggacttttaggtcgcagccaggttggcgtaggggtgtttcaagaaaacgtcttccacacaatgtggcatgtgacccggggagcggttctgatgtaccagggcaaaagactcgagccgagttgggctagcgtgaagaaagacttgatctcctatggtgggggatggaggctgcagggcttttggaatacaggcgaggaagtccaggtgattgccgtagagcctgggaagaaccccaaaaatgtccaaactgcaccaggaaccttcaagacgcccgaaggtgaggtgggcgccatcgctctcgattttaagcctgggacatctggatcgccaattgttaaccgagaaggcaaaatcgtgggtctgtacgggaatggagtcgtgactaccagcggcacatatgtttcagccatagcacaggctaaggcctcccaggagggcccccttcctgagatcgaagacgaggtgttccggaaacgcaacctgaccattatggatttgcacccggggagtggaaagactagaaggtacctaccagcgatcgtccgggaagccattaaacgaaagctgagaaccctcatcttagcacccacacgcgtggtagcttctgagatggccgaagctctgaagggtatgcctataaggtatcaaacgactgcagtgaaaagcgagcacaccggcaaggagattgttgaccttatgtgccatgccacatttaccatgcgtctgctctccccagtccgggtgcccaattacaacatgatcatcatggatgaagcccacttcactgacccttcatctattgctgcgagagggtatatcagcacaagggtgggaatgggcgaggcagccgctatatttatgaccgccacgccgcccggtagtgtcgaagcattcccacagtccaatgccgtaattcaggatgaggaacgcgacatccctgagcgaagctggaactctgggtacgagtggattactgattttcccggaaaaacagtgtggttcgttccatcaatcaagtccggcaatgacatagctaactgtttgaggaaaaatggcaagcgggtgattcagctgagtaggaagaccttcgataccgaataccagaaaactaagaacaacgactgggactatgtcgtgacaaccgatatcagcgagatgggggcgaattttcgcgccgaccgtgttatcgatcctagacggtgcctcaaacccgtgattctgaaggacggaccagaaagggtcatccttgcaggtccgatgcctgtgacagtagcttcggccgcacagcgccgaggcagaattgggcggaaccataataaagagggagatcagtacatatatatgggccagcccctaaacaatgacgaggatcacgcccattggactgaagctaagatgctgttggacaacatcaatacgccagagggtattatccccgccttattcgaacctgagagggaaaagtctgcggcaatcgatggggagtaccgcctgagaggcgaggccaggaaaacctttgtggaactcatgcggcgtggagacctgccagtttggctttcctataaggtcgctagcgagggcttccaatactcagatcgccgatggtgctttgacggggaaagaaacaatcaggtgctggaggaaaacatggatgtggagatttggacaaaagagggagaaaggaagaaactccggccccgctggttggacgccagaacttatgctgaccctctggcactaagggagttcaaggaatttgccgctggtcggcgaagtgtctctggcgatctgatactcgagatcgggaaacttccgcagcacctgacccagagagcccaaaatgcattagacaacttggttatgctgcacaattccgaacagggaggccgcgcgtacaggcatgccatggaggagctcccagatacaattgaaaccctgatgcttctggctctcatcgccgtgttgactggtggggtaacgctgttctttttaagcggccggggactaggcaagacctcaattgggctgctctgtgtgatggcaagtagcgtccttctgtggatggcttccgtggagccccactggatcgccgcatctataatcttggagttctttctgatggttctcctgattcctgagcccgaccgtcagagaacaccacaggataaccaacttgcctacgtggtcatcggactcctgttcatgattttgactgtagctgcgaatgagatgggtctgttagaaaccacaaagaaagacctaggcatcgggcatgtggccgttgagaaccaccaccatgcagctatgctggatgtggacctccaccctgccagcgcctggaccctttatgcagtcgctactacaataattacgcccatgatgaggcataccatcgaaaacactacagccaatatttccctgaccgcgatcgctaaccaggccgcaatattgatgggactggataagggctggccaatctcaaaaatggacattggtgtgcctctcctggcccttgggtgctactctcaggtcaatccgttaaccctgacagctgcagtgctcatgttggttgcccactatgcgatcattggccccggactgcaagctaaggccactcgcgaggcacagaaacggacggccgctggcatcatgaagaacccaaccgtggatgggatagtagccattgacctagatcctgtggtctacgacgcaaagtttgaaaaacagctgggacagatcatgctccttatcctgtgtacaagtcaaattttgctgatgcgaactacctgggctctctgcgagtcgatcacactggccaccggccccttaactacgctttgggagggtagcccagggaagttctggaatacaaccatagcggtttccatggccaacattttcagaggatcttatctggcaggcgctggtctcgccttttcactaatgaaaagcctgggcgggggaaggcgcggcactggggcacagggagaaaccttgggcgagaagtggaaacggcagctgaatcagctctccaagagtgagttcaacacatacaagaaatctggtatcatggaggtggacagaagcgaagctaaggaggggcttaaacgtggagagactaccaagcatgccgtctcaaggggcacagccaaactgcggtggtttgtggaacgcaatttggtaaagcctgagggtaaggtgattgatctgggctgtgggcgaggaggctggtcctattactgcgcggggctcaaaaaggttacggaagtgaaaggatacaccaagggcggtcccgggcacgaggaaccgatcccaatggctacttatggatggaacttagtcaaactgcacagtggcaaggacgtgttctttatacctcccgagaaatgtgatacacttctgtgcgacatcggcgagagctctccaaatcccaccattgaagaggggagaactctaagggtcctcaagatggtggaaccttggctgcggggaaaccaattctgtatcaagattttgaatccgtacatgccctccgttgtagagacactggagcagatgcagcgcaaacatggtggcatgctcgtgagaaacccactttcaaggaatagcacccacgaaatgtattgggtctcgtgcgggacgggaaacatcgtgtctgcagttaatatgaccagtcgaatgctgttaaaccggtttacaatggcccatcgtaagcctacttacgagagagatgtggacctgggcgctggtacccgccacgtcgccgtggaacccgaggtagcaaacttggatattatcgggcagaggatagaaaatattaaacacgagcataagtccacatggcactatgacgaggataacccttacaaaacttgggcctatcatggaagctacgaagtgaagccatcaggctccgcttctagcatggttaatggcgtcgtgaagctcctgaccaaaccctgggacgtgatccctatggtcacacaaatcgcgatgaccgatactacgccattcgggcagcagcgggtttttaaggagaaagtggacacaagaacccccaaggccaaacaaggaactgcacagattatggaagtaaccgctaagtggctatggggtttccttagtcgcaacaagaaaccgaggatatgtacacgagaggaatttacgcggaaggtgagatccaatgccgcaatcggcgccgtcttcgtggacgagaaccagtggaatagcgctaaagaggccgttgaagatgagaggttttgggacctggtgcaccgcgaacgtgagctccataagcaggggaaatgcgcgacctgcgtctacaacatgatgggaaagcgggaaaagaaactgggcgagttcggtaaggcaaaagggtctagagccatttggtatatgtggttgggagctaggttcctggagtttgaagccctcggcttcatgaatgaggatcactggttttcacgcgaaaacagtctttccggcgtggagggggagggactgcacaagttaggttacatcctgcgagacattagccaaatccctggcgggaatatgtatgcagatgacactgctggatgggatacacggataaccgaagacgatttgcagaacgaggccagaatcactgacattatggaaccagagcatgctctcctggccaaatctatcttcaagctaacataccagaataaagtagttagggtgcagcgccccgcaaagaacggcaccgtcatggatgtgatttcgagacgggaccaaaggggttcaggacaggtgggaacatatggccttaatacttttaccaacatggaagcgcagctgatccgtcagatggagagcgagggcatattctcccctagtgaactcgagacgccaaacctggccgaacgagtcttggattggttagagaagtacggggttgaacgcctgaaaagaatggctatttctggagacgactgtgtggtaaagcccatcgatgaccggtttgccaccgcactcacagctcttaatgatatgggtaaagtgaggaaggacatcccgcaatgggagcctagcaaaggctggaacgattggcagcaggtccccttctgctcccaccattttcaccagctgattatgaaggacgggcgcgagatagtggttccatgtagaaatcaagatgagctagtgggacgggccagggtctcacagggcgcaggttggagtctgcgagagactgcctgcctcgggaagtcttatgcgcagatgtggcaattgatgtacttccaccgtagagacctgcgccttgctgccaacgcaatctgtagcgccgtgcctgtagattggattcccacctcccggacaacttggtcaatccatgctcaccatcagtggatgaccacggaagacatgctgagcgtttggaatagggtgtggattgaggaaaacccatggatggaggataaaacacacatctcttcctggggagacgtcccctacctcggcaagagagaggaccagtggtgcggcagtttaatagggctgaccgcccgcgcaacttgggctacaaatatccaggtggccattaaccaagttcggaggttgatcggaaatgaaaactatctggattacatgaccagcatgaaacgatttaagaatgagtcggaccctgaaggtgcgctctggtga

SEQ ID NO: 13913 - RNA, 9879 nt, synthetic construct
  misc_feature 1..9879: note = derived and/or modified CDS sequence (opt3) from DENV-1__JF937605__SS-prME
  source 1..9879: mol_type = other RNA
agcgtgaccatgctgctcatgcttatgcccacggccctggctttccacttgactacgagaggaggggagcctcatatgatcgtctccaagcaggaaagggggaaatctttactgtttaagacctcagccggtgttaacatgtgcacactaattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacactgcaagagacctggaatcggcaggacttgctcgtaacattcaaaactgcacacgctaagaagcaggaagttgtggtcctgggtagccaagagggggccatgcacaccgctttaacgggcgccaccgaaatccagacaagtggaactaccacaatttttgcaggccatctgaaatgccgtctaaagatggataaactcactctgaaggggatgtcttatgtgatgtgtaccggatccttcaaacttgagaaggaagtcgccgagacgcagcacggtacagtgttggttcagataaagtacgagggcaccgacgctccttgcaaaatcccattcagcactcaagatgaaaagggggtgacacagaacggacgcctgattaccgcgaatcccatcgtaactgacaaagagaagcctgtcaacatagaagcagagccaccctttggcgagtcgtatattgtgatcggtgccggggaaaaagctctcaagctgtcttggttcaagaaaggctcctcaatcggaaagatgtttgaggccaccgcaagaggcgccaggcggatggctattcttggggatacagcctgggacttcggaagtatcggtggcgtttttacgagcgtggggaaactggtccatcagattttcggaaccgcatacggcgtgttgttttccggtgtatcttggactatgaagatagggatcggcgtgctcctgacatggttaggactgaatagccgatcaaccagtctatccatgacatgtattgcggttggcctcgtcactctgtaccttggggtgatggtgcaggctgatagcggatgcgtcatcaactggaaaggccgcgaattgaagtgtggttctgggatcttcgttaccaatgaggtgcacacgtggacagaacaatataagtttcaggccgactcaccgaaaagactgagtgcagccattggaaaggcttgggaggagggcgtgtgcggtataaggagcgccacccggctcgaaaacatcatgtggaaacagatttccaacgagctgaatcatatcttactggaaaacgacatgaagttcactgtagtcgtgggcgatgttgcagggattcttgctcagggcaagaaaatgatccgccctcaacccatggagtacaaatattcttggaagtcgtggggcaaggccaaaataatcggggcggacgtgcagaataccacatttattatcgatggaccaaacactcctgaatgtcccgacgatcagagagcctggaatatttgggaggtcgaggactacggcttcggtatctttaccacaaacatatggttgaagctcagggatagctatacacaggtgtgcgaccaccgtctgatgtccgctgcaattaaagattcaaaggccgttcacgctgacatggggtactggatcgaaagtgagaaaaatgaaacctggaagctagcccgggcatctttcattgaggtgaagacttgtatctggccaaaaagccatacactgtggtccaacggagtactcgaatcagagatgataatccccaagatttatggcggtcctatcagccaacacaattaccgaccaggctacttcacccaggcggccgggccgtggcatctgggaaaacttgagttggattttgacctgtgcgaaggcactacagtcgtggtggatgagcactgcgggaacagaggaccctctttaaggaccacgactgtcaccggcaagattatccacgaatggtgttgccgctcctgtacactccctccactgcggttcagaggtgaggacgggtgctggtatggaatggagataaggcccgttaaagaaaaggaggaaaatcttgtgaagagtatggtaagcgctggctctggtgaggtggactccttttcactgggcttgctctgtattagtatcatgatcgaagaggtcatgcgcagccgatggtcgcggcgtatgctgatgaccgggactctagccgtgttctttctgctcattatgggacagctgacatggaacgatcttatcagattgtgcattatggttggcgcaaatgcttccgacaggatggggatgggaaccacatacctggccttaatggcaactttcaaaatgcgccctatgtttgccgtgggcctcctgttccggagacttacctctagggaggtcctgctactcacgataggtctgagcttggtggcttcagttgaactgccaaacagtttagaggaactcggggatggactggcgatgggcatcatgattcttaagctgttgacagactttcaatcccatcagctctgggccaccctgctatctctgactttcatcaaaaccacatttagccttcactatgcatggaagactatggctatggtgctctccattgtctcactgttccccttgtgtctgagcaccacgagtcagaaaacaacctggttaccggtactcctgggctctcttgggtgcaagcctctgactatgtttttgatcgccgagaataagatatggggacgacgctcctggccactcaacgaaggtatcatggccgtgggcattgttagcatcctgctatcgtcactgcttaaaaacgatgtgcccctcgctgggcctctgattgcaggaggcatgttgatcgcctgttacgtcatatctggtagttccgcggacttaagcctggagaaggctgccaaagtgtcttgggaggaagaggcagaacatagcggggcctcccacaatattctcgtagaggtgcaggatgacggaacaatgaagatcaaagatgaggaacgggacgataccctgactatccttctgaaggctacattgctagcagtctcaggcgtttatcccctgagtattccagccaccctcttcgtgtggtacttctggcagaagaagaagcagagaagcggcgtgctgtgggacacgccttctcccccagaggtcgaaagggcggtgcttgatgacgggatatatcgtatcatgcagcgcggattactgggtcggtcccaggttggcgtaggggtgtttcaagagaacgtcttccatactatgtggcacgtgaccagaggagctgttctcatgtaccagggcaaaaggttggaaccgtcatgggccaatgtgaagaaagacctgattagttacggtgggggatggcgactccagggcagctggaacacaggcgaggaggtccaggtgatcgcagtagaacctgggaagaatcccaaaaacgtccaaaccgccccaggaacatttaagactcccgagggtgaagtgggcgctattgccctggatttcaagcctgggacctccggatctccaatcgttaatcgggagggcaaaatagtgggtctttatgggaacggagtcgtgacgacatcgggcacttacgttagcgcaatcgctcaggccaaggcgtcacaggaaggccccctgcctgagattgaggacgaagtgtttcgcaaaagaaatttgaccatcatggatctacacccggggtccggaaagacaaggcggtatctgccagccattgtccgagaggcaatcaaaagaaagctccgcaccttaatactggctcccactagggtggtagccagtgaaatggctgaggcacttaagggtatgcctattcgttaccaaaccacagccgtgaaatctgaacatacgggcaaggagatcgttgacctgatgtgccacgccactttcaccatgcggctcttgagcccagtcagagtgcccaactataatatgatcattatggatgaggctcattttacagacccttcctcaatcgcggcaagggggtacatatctacccgcgtgggaatgggcgaagccgctgccattttcatgactgcaacaccgcccggtagcgtcgaggcctttccacagagtaacgctgtaatccaggatgaggaacgagacattcctgaaagatcctggaatagcgggtatgagtggatcaccgatttccccggaaaaacggtgtggtttgttccatctataaagtcaggcaacgacattgcgaattgtctgcggaaaaacggcaagagggtgatccagctctcccgcaagactttcgatacagagtaccagaaaaccaagaacaatgactgggactacgtcgtgaccactgatatcagtgaaatgggggccaacttccgtgcagacagagttattgatcctcggaggtgcctgaaacccgtgatccttaaggacggaccagagcgcgtcattctagctggtccgatgcctgtgacagtagccagcgcagcccagcgaagaggccggatagggaggaatcacaacaaagaaggagatcagtatatctacatgggccagcccctgaataacgacgaggatcatgctcactggaccgaggccaagatgttgttagacaatattaacacaccagaaggtatcatccccgcgctgtttgagcctgaacgcgagaagtcggcagccattgatggggaatatagactcaggggcgaggctcggaaaactttcgtggagctgatgcgtcgcggagaccttccagtttggctgtcttacaaggtcgcctccgaaggctttcaatatagcgatcgaagatggtgcttcgacggggagaggaataaccaggtgctcgaagagaatatggatgtggaaatatggacgaaagagggagagcggaagaaattgcgccccagatggctggacgctaggacctactcagaccctctagcactgcgggaatttaaggagttcgccgctggtcgaagaagtgtctctggcgatctcatccttgaaattgggaaactgccgcagcacttaacacagcgcgcccaaaacgcattggacaatctggttatgctccataactccgagcagggaggcagggcgtatcggcacgccatggaggaactgccagatactatcgagacccttatgctgctcgctttgattgccgtgctgacaggtggggtaaccttatttttcctaagcggccgtggactgggcaagacttcaatcgggctcctttgtgtgatggcaagtagcgtcctgttgtggatggcttccgtggaaccccattggatagccgcatctatcattctggagtttttcctcatggttctgcttatccctgaacccgacagacagaggacgccacaggataatcaactcgcctacgtggtcattggactgttgtttatgatcctgaccgtagctgcgaacgagatgggtttactagagacaactaagaaagacctgggcatagggcacgtggccgttgaaaaccaccatcacgcagctatgctcgatgtggaccttcatcctgccagcgcctggaccctgtacgcagtcgctacaaccattatcactcccatgatgcgccacacaattgagaatacgaccgccaacatctccttgactgcgatagctaatcaggccgcaatcctgatgggactcgataagggctggccaatttcaaaaatggacatcggtgtgcctctgcttgccttagggtgctattctcaggtcaacccgctgacactcaccgctgcagtgttgatgctggttgcccattacgcgattatcggccccggactacaagctaaggccacccgggaagcacagaaacgaacagccgctggcataatgaagaatccaactgtggatgggattgtagccatcgacctggatcctgtggtctatgacgcaaagttcgagaaacagctcggacagatcatgcttctgattttgtgtacgagtcaaatcctgctcatgagaaccacatgggctctgtgcgaatcgataactttagccaccggcccccttacaaccctgtgggagggtagcccagggaagttttggaacactacgattgcggtttccatggccaatatcttcaggggatcttacctcgcaggcgctggtctagccttctcactgatgaagtccttgggcgggggacgccggggcacaggggcacagggagagaccctgggcgaaaagtggaaaagacagctcaaccagcttagcaagagtgagtttaatacttataagcgttctggtattatggaagtggacaggagcgaggctaaagaagggctgaagcggggagagaccacaaaacacgccgtctcacgcggcactgccaagttgcgatggttcgtggagagaaacctggtaaaacctgaaggtaaggtgatcgatctcggctgtgggaggggaggctggtcctactattgcgcggggttaaagaaagttaccgaggtgaagggatacacaaaaggcggtcccgggcacgaggagccgataccaatggctacgtacggatggaatctggtcaaacttcatagtggcaaagacgtgtttttcatccctcccgaaaagtgtgataccctgctatgcgacattggcgagagctctccaaaccccactatcgaggaagggcggacactccgcgtcctgaaaatggtggagccttggttgagaggaaatcaattttgtattaagatcctgaacccgtatatgccctccgttgtagaaaccctcgagcagatgcagaggaagcacggtggcatgcttgtgcgaaatccactgtcacggaacagcactcatgagatgtactgggtctcgtgcgggacaggaaatattgtgtctgcagttaacatgaccagtcgtatgttactgaacagattcacgatggcccaccgcaaacctacctatgaaagggatgtggacttgggcgctggtacacggcacgtcgccgtggagcccgaagtagcaaatctcgatatcatagggcagagaattgagaacatcaagcatgaacacaaatccacttggcattacgacgaggataatccttataagacctgggcctaccacggaagctatgaggtgaaaccatcaggctccgcttctagcatggttaacggcgtcgtgaagctgctaacaaagccctgggacgtgatccctatggtcactcaaattgcgatgaccgatacaaccccatttgggcagcagcgcgttttcaaagaaaaggtggacactaggacgcccaaagccaagcgaggaacagcacaaataatggaggtaaccgctaaatggctttggggttttctgagtcggaataagaagccgagaatctgtactagggaagagttcacccgcaaagtgcgttccaacgccgcaattggcgccgtctttgtggacgaaaatcagtggaacagcgctaaggaggccgttgaggatgaacggttctgggacctcgtgcatagagagagggaactgcacaaacaggggaagtgcgcgacatgcgtctacaatatgatgggaaaacgcgagaagaagttgggcgaatttggtaaagcaaaggggtctcgagccatctggtacatgtggctgggagctcggttcctcgagttcgaggcccttggctttatgaacgaagatcactggttctcaagagagaatagtctgtccggcgtggaaggggagggattacataaactgggttatattttgagggacatcagcaagatacctggcgggaacatgtacgcagatgacacggctggatgggatacccgcatcactgaggacgatctccagaatgaagccagaattacagacatcatggagccagaacacgctctgctagccaaatctatttttaaacttacctatcaaaacaaagtagttcgggtgcagaggcccgcaaagaatggcactgtcatggatgtgatctcgcgtcgagaccagcgcggttcaggacaggtgggaacatacggcctgaacaccttcacaaacatggaggcgcaactcataagacagatggaaagcgagggcatattttcccctagtgagctggaaactccaaatttggccgagcgggtcttagattggctggaaaagtatggggttgagaggctcaaacgcatggctatctctggagacgactgtgtggtaaagcccatcgatgacagattcgccaccgcacttacggctctgaacgatatgggtaaagtgcggaaggacattccgcagtgggaacctagcaaaggctggaatgattggcagcaagtccccttttgctcccatcacttccaccagctaataatgaaggacgggagggagatcgtggttccatgtcgaaaccaggatgagctggtgggacgtgccagagtctcacagggcgcaggttggagtctccgcgaaaccgcctgcttggggaagtcttacgcgcaaatgtggcagctgatgtattttcatcggagggaccttagactggctgccaatgcaatttgtagcgccgtgcctgtagattggatccccacatcccgcactacctggtcaattcacgctcatcaccagtggatgacaactgaggacatgctcagcgtttggaaccgggtgtggatcgaagagaatccatggatggaagataaaacccatatatcttcctggggagacgtcccctacttaggcaagagggaggaccaatggtgcggcagtctgatcgggttgacggcccgagcaacatgggctaccaacattcaggtggccatcaatcaggttagacggctgattggaaacgagaattacctcgattatatgactagcatgaaaaggttcaagaacgaatcggaccctgagggtgcgctttggtga

SEQ ID NO: 13914 - RNA, 9879 nt, synthetic construct
  misc_feature 1..9879: note = derived and/or modified CDS sequence (opt3) from DENV-1__JF937608__SS-prME
  source 1..9879: mol_type = other RNA
agcgtgaccatgctgctcatgcttatgcccacagcactggctttccacttgactacgaggggcggggagcctcatatgatcgtctccaagcaggaaaggggaaaatctttactgtttaagacctcagccggtgttaatatgtgcacattaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagaaggtggaaacctgggccctcaggcaccctggattcacagttattgctctgtttctggcacatgccatcggcacctcgattacgcagaagggcatcatattcatcctcttaatgctggtgactccatcaatggctatgcggtgcgtcgggattggaagccgcgattttgtggagggtcttagtggcgccacatgggtagacgttgtgttggagcacgggtcctgtgtcaccactatggcgaaagataagcccacactggacatcgaattgctcaaaaccgaggtgacgaaccctgcaattctgagaaaactttgcatcgaagccaaaatatctaataccacaactgattcgagatgtccaacccaaggagaggctacactggtggaagaacaggacgccaacttcgtctgccggcgcacttttgttgatcgaggctggggtaatgggtgtggattgttcggcaagggctccctcattacctgcgcaaagtttaaatgcgtgacaaagctggaggggaaaatcgtacagtacgaaaacttaaagtattcagtgattgtcaccgtgcacactggagaccagcatcaagttggtaatgagagtacggaacacggcacaaccgctactatcacaccccaggcccctacaaccgagatccagctgactgactacggggcgctcacacttgattgtagcccaagaacgggactggacttcaacgaaatggtgttgctaaccatgaaagagaagtcttggctggtccataaacagtggtttctcgatctgccgcttccctggacttccggcgcctcaacaagccaagagacctggaataggcaggacctgttggtgacattcaagactgcacacgctaagaaacaggaagtagttgtgctcggtagtcaagagggggccatgcacaccgctctgacgggcgccaccgaaattcagacatctggaactaccacaatatttgcaggccatttaaagtgccggctgaaaatggataagctaactctcaaagggatgtcctatgtcatgtgtaccggatccttcaagctggagaaggaagtggccgagacgcagcacggtacagtccttgtgcagatcaaatacgagggcaccgacgctccttgcaagattccattctcgactcaagatgaaaaaggggttacacagaacggacgtttgatcaccgcgaatcccatagtgactgacaaggagaaacctgtaaacattgaagcagagccaccctttggcgagtcttatatcgtcatcggtgccggggaaaaggctctgaagctctcctggttcaaaaagggctcaagtattggaaaaatgtttgaggccaccgcacgcggcgccagaaggatggctatcctgggggatacagcctgggacttcggaagcattggtggcgtgtttacgtccgttgggaaacttgtgcatcagatattcggaaccgcatacggcgtcctgttttctggtgtgagctggactatgaaaatcgggattggcgtattgctcacatggctgggattaaattcacggagtacctccctgagcatgacatgtatcgcggtgggcctagttactctctacctgggggtcatggtgcaggctgattctggatgcgtgatcaactggaagggccgagaacttaagtgtggttcagggattttcgtcaccaatgaggttcacacgtggacagaacaatataaatttcaggccgacagtccgaagcgcttgagcgcagccataggaaaggcttgggaggagggcgtgtgcggtatcagatccgccaccaggctggaaaacattatgtggaagcagatctctaacgagctcaatcatattctgttagaaaacgacatgaaattcactgtggtagtcggcgatgtggcagggatcctggctcagggaaagaaaatgatacggcctcaacccatggagtacaagtattcgtggaaaagctggggcaaagccaagatcattggggcggacgttcagaataccacatttatcattgatggaccaaacactcctgaatgtcccgacgatcagcgcgcctggaatatctgggaggtggaggactacggcttcggtatatttaccacaaacatttggcttaaattgagagattcctatacgcaggtctgcgaccacaggctcatgtcagctgcaatcaaggatagtaaagccgtgcacgctgacatggggtactggattgaatctgagaagaatgaaacctggaagctggcccgtgccagcttcatcgaggttaaaacttgtatatggccaaagtcccatacactatggtcaaacggagtgctggaaagcgagatgatcattcccaaaatctatggcggtcctatttctcaacacaattaccggccaggctacttcacccagactgcggggccgtggcatctcggaaagctggagcttgattttgacttgtgcgaaggcacaaccgtagtcgtggatgagcactgcgggaaccgaggaccctccctgagaacgactaccgtgacaggcaaaatcatacacgaatggtgttgcaggagttgtaccttacctccactccgcttccggggtgaggacgggtgctggtatggaatggagattagacccgtcaaggaaaaggaggaaaatctggttaaaagcatggtgtctgccggctccggtgaggtagactcatttagtcttggcctgttgtgtatcagcatcatgattgaagaggtgatgaggtcgcgctggtcccgaaagatgctcatgactgggacactggctgtcttcctactgctcatcatgggacagctgacctggaacgatcttattcggttgtgcataatggtgggcgccaatgcatctgaccgtatggggatgggaacaacttacctggctttaatggccacctttaaaatgagacctatgttcgcagttggcctcctgtttaggcgccttacgagccgggaggtgctgctactcacaatcggtctgtcattggtcgccagtgtggaactgccaaactccttagaggaactcggggatggactggctatgggcattatgatccttaagctgttgaccgacttccaatctcatcagctctgggcgactctgctaagcctgacctttattaaaacaactttctcccttcactatgcctggaagaccatggcaatggttctctcaatcgtgagcctgtttcccttgtgtctgagtacgacatctcagaagaccacttggttaccggtcctcctgggctcccttgggtgcaaacctctgacaatgttcttgatagctgagaataagatctggggaagaaggagctggccactcaacgaaggtattatggccgtaggcatcgtgtcgattctgctatcatctctgcttaaaaacgatgttcccctcgccgggcctctgatcgctggaggcatgttgatagcatgttacgtgattagtggttccagcgccgacttatctctggagaaggcggctgaggtcagctgggaagaggaagccgagcattccggggcatcacacaatatcctcgtggaagtacaggatgacggaaccatgaaaatcaaggatgaggagcgagacgatactctgacaattcttctgaaagccaccttgctagctgtgagtggcgtctatcccctgagcataccagcaacgctctttgtttggtacttctggcaaaagaagaaacagcgctctggcgtgctgtgggacactccttcacccccagaagtggagcgggccgtccttgatgacgggatctatagaattatgcagaggggattactgggtcgtagccaggtgggcgttggggtattccaagaaaacgtgtttcataccatgtggcacgtcacacgcggagcggtgctcatgtaccagggcaagcggttggagccgagttgggctagcgttaaaaaggacctgatctcctacggtgggggatggagactccagggctcttggaataccggcgaggaagtgcaggtcattgccgtggagcctgggaaaaaccccaagaatgtacaaacaactccaggaaccttcaagacgcccgaaggtgaggtcggcgcaatcgccctggattttaaacctgggacatcgggaagcccaatagtgaacagggaaggcaagatcgttggtctttatgggaatggagtggtcactacctcaggcacatacgtgtccgctattgcccaggcaaaagctagtcaggagggccccctgcctgagatcgaagacgaggttttccgaaagcggaacttgaccattatggatctacacccggggtctggaaaaactcgcagatatctgccagccatcgtgagggaagcgataaagcggaagctccgaaccttaattctggcccccacaagagtcgtggcaagcgagatggctgaagcccttaaaggtatgcctatccgctaccaaacgactgctgtaaagtccgagcataccggcaaagagatcgtggacctgatgtgccacgcaacatttaccatgaggctcttgtcaccagttcgtgtccccaattataacatgattatcatggatgaagcccatttcactgacccttctagcatagccgctcgggggtacattagtacaagagtgggaatgggcgaggcggcagccatctttatgaccgctacgccgcccggttccgtggaagccttcccacagagcaatgcagtcattcaggatgaggaaagggacatccctgagcgctcttggaactcagggtatgagtggataactgattttcccggaaagacagtatggttcgtgccatccattaaaagtggcaatgacatcgccaactgtctgcgaaagaatggcaagagagttatccagctcagccggaaaacctttgataccgaataccaaaagactaaaaacaacgactgggactacgtggtcacaaccgatatttcggagatgggggctaatttcagggcggaccgcgtgatcgatcctcgtagatgcctgaagcccgttattcttaaagacggaccagaacgggtgatactagccggtccgatgcctgtcacagtggcatctgctgcccagaggcgcggccgaatcgggagaaaccacaataaggagggagatcagtatatttacatgggccagcccctgaacaatgacgaggatcatgcacactggactgaagccaagatgttgttagacaacatcaatacgccagagggtatcattcccgctctgttcgaacctgagcgggaaaaatccgccgcgatagatggggagtataggctccgcggcgaggcaagaaagacctttgtagaactgatgaggcggggagaccttccagtgtggctgagctacaaagttgcctcagagggcttccaatatagtgatcgtcgctggtgctttgacggggaacgaaacaatcaggtcctcgaggaaaacatggatgtggagatctggacaaaggagggagaaaggaagaagttgaggccccggtggctggacgctcgcacttactctgaccctctagccctgagagagttcaaagaatttgctgcaggtaggcggtccgtgagcggcgatctcattcttgagatcgggaagctgccgcagcacttaacccagcgagcccaaaatgctttggacaacctggtcatgctccataattcagaacagggaggcagagcctatcgccacgcaatggaggagctgccagatacaattgaaacccttatgctgctcgcgttgatcgccgttctgactggtggggtgacgttattctttctaagtggcaggggactgggcaagaccagcatagggctcctttgtgtaatggcttcctctgtgctgttgtggatggccagcgtcgagccccattggatcgcagcttccattatcctggagttctttctcatggtgctgcttattcctgagcccgaccggcagcgtacaccacaggataaccaactcgcctacgttgtgatcggactgttgttcatgatactgactgtcgcagccaatgagatgggtttactagaaaccaccaaaaaggacctgggcattgggcacgtagctgtgggaaaccaccatcacgcggccatgctcgatgttgaccttcatcctgcatcagcttggaccctgtacgccgtggccactacaatcattacgcccatgatgagacacaccatcgagaacactacagcaaatatatctttgaccgctatcgccaaccaggcggctattctgatgggcctcgataaaggttggccaatcagtaagatggacattggggtccctctgcttgccttaggctgctatagccaggtgaatccgctgaccctcacagcagccgtcttgatgctggtggctcattacgcaatcataggacccggcctacaagccaaagcgactagggaagctcagaagcgcacggccgcagggattatgaagaacccaaccgttgatggaatcgtggccatcgacctggatcctgtagtgtatgacgctaaatttgagaagcagctcggccagattatgcttctgatcttgtgtacaagccaaatactgctcatgcggactacctgggccctgtgcgaatccattacattagcaaccggtccccttactacgctgtgggaggggtctccaggaaaattctggaatacaaccatcgctgtctcaatggccaacatttttcgaggcagctacctcgcgggtgccggcctagcattctccctgatgaagagtctagggggaggcagaagggggactggagctcagggcgagaccctgggtgaaaaatggaagcgccagctcaatcagctttctaagagcgagttcaacacatataaacggtcagggatcatggaagttgacagatccgaggccaaggaaggactgaaacgtggcgagactaccaagcacgcagtgagtaggggtacagctaaattgcggtggtttgtcgagcgcaatctggtgaagcctgaaggcaaggtaatagatctcgggtgtggacgaggcgggtggagctactattgcgccggactaaagaaggtgacggaggttaaaggctacaccaagggtgggcccggacacgaagaaccgatcccaatggccacttacggctggaacctggtgaaacttcattctggcaaggacgtcttctttattcctcccgaaaaatgtgatacactgctatgcgacatcggggagtcctcaccaaatcccaccattgaggaaggaagaactctcagggtgctgaagatggtcgagccttggttgcggggtaaccaattctgtatcaagattctgaatccgtatatgcccagcgtggttgaaacactcgagcagatgcagcgcaaacacggcgggatgcttgtaagaaacccactgtcgagaaattctacccatgagatgtactgggtgagttgcggaacgggcaacatcgtctccgcggtgaatatgaccagccgaatgttactgaaccggtttacaatggctcaccgtaagcctacttatgaaagagatgttgacttgggtgcagggacccgccacgtggccgtcgagcccgaagtggctaacctcgatataattggacagaggatcgagaatatcaaacatgaacacaagtcaacatggcattacgacgaggataacccttataaaacttgggcctaccacggctcctatgaggtaaagccatctggcagcgcaagttccatggtgaatggggttgtcaagctgctaaccaaaccctgggacgtgattcctatggtgacacaaatagccatgaccgatactacgccattcggacagcagcgggtctttaaggaaaaagttgacacaagaacccccaaggctaaacgcggtactgcgcaaatcatggaggtgaccgccaagtggctttggggcttcctgagcaggaacaagaaaccgcgaatttgtacacgggaagagtttacgagaaaggtaaggtctaatgcagctatcggggccgtgttcgtcgacgaaaaccagtggaactcagcaaaagaggccgtggaggatgaacgcttttgggacctcgttcatcgtgagcgggaactgcacaagcagggaaaatgcgctacctgcgtgtacaacatgatgggcaagagagagaagaaattgggtgagttcgggaaggccaaaggaagtagggcgatttggtacatgtggctgggcgcacgctttctcgagttcgaggcccttggcttcatgaatgaagatcactggttttcccgagagaacagcctgtctggggtcgaaggagagggtttacataagctgggctatatcttgcgggacatatcgaaaatccctgggggaaatatgtacgctgatgacactgccggctgggatacaagaattaccgaggacgatctccagaacgaagcaaggatcactgacattatggagccagaacacgctctgctagccaagtcaatcttcaaacttacatatcaaaataaggtggtacgcgttcagagacccgctaagaacggtaccgtgatggatgtcataagccggagggaccagcgtgggtccggacaggtgggcacatacggcctgaatacttttaccaacatggaggcccaactcattcgacagatggaaagtgaggggatcttctctcctagcgagctggaaacgccaaacttggcagagcgcgtgttagattggctggaaaaatatggagtcgagagactcaagcggatggcgatctccggtgacgactgtgttgtgaaacccattgatgacaggtttgccaccgctcttacagccctgaatgatatgggcaaggtacgcaaagacataccgcagtgggaaccttcaaaggggtggaacgattggcagcaagtgcccttctgcagtcatcactttcaccagctaatcatgaaggacggaagagagattgtcgtgccatgtcggaatcaggatgagctggttggcagggcacgagtgtctcagggtgctgggtggagcctccgtgaaactgcctgcttgggaaaatcctacgcacaaatgtggcagctgatgtatttccatagacgcgaccttcggctggccgcgaacgctatctgttcagccgtccctgtggattggattcccaccagcaggacaacttggtctatccacgcacatcaccagtggatgaccacggaggacatgctctccgtatggaatagagtttggatagaagagaacccatggatggaagataagacacatatcagtagctggggcgacgtgccctacttaggcaaacgcgaggaccaatggtgcgggtcgctgattggattgaccgcccgggctacttgggccacaaatatccaggtcgcaattaaccaggtgaggcgactgatcggtaatgagaactacctcgattatatgacctccatgaagagatttaaaaatgaatctgaccctgagggcgctctttggtga

SEQ ID NO: 13915 - RNA, 9879 nt, synthetic construct
  misc_feature 1..9879: note = derived and/or modified CDS sequence (opt3) from DENV-1__GU131739__SS-prME
  source 1..9879: mol_type = other RNA
agcgtgaccatgctgctcatgcttatgcccacagcactggctttccacttgactacgagaggaggggaacctcatatgatcgtctccaagcaggaaagagggaaatctttactgtttaagacctcagccggtgttaatatgtgcaccctaattgccatggacctcggagaactgtgtgaagatactatgacctacaaatgcccacggatcacagagaccgaaccggacgatgtggactgttggtgcaatgcgactgatacatgggtaacctatgggacgtgtagtcaaactggagagcaccgccgagacaagcgtagcgtggctcttgcaccacatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcattttcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggctcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaaaaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggccagcttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatggttctctcaattgtgagcctgttccccttgtgtctgagtacgacatctcagaagaccacttggttaccggtcctcctgggctcccttgggtgcaagcctctgacaatgtttttgatcgctgagaataaaatatggggaaggcgaagctggccactcaacgaaggtatcatggccgtaggcattgtgtcgatcctgctatcatctctgcttaagaacgatgttcccctcgccgggcctctgattgctggaggcatgttgatcgcatgttacgtgataagtggttccagcgccgacttatctctggagaaagcggctgaggtcagctgggaagaggaagccgagcattccggggcatcacacaatattctcgtggaagtacaggatgacggaaccatgaagatcaaagatgaggagcgcgacgatactcccacaatcctgcttaaggccaccctgttggctgtgagtggcgtctatccactaagcattcctgcaacgctgttcgtttggtacttctggcagaaaaagaagcagcggtctggcgtgctctgggacactccctccccaccggaagtggagagagccgtcctggatgacgggatatataggatcatgcagcgtggacttttaggtcgctcacaggtgggcgttggggtatttcaagaaaacgtgttccataccatgtggcacgtcacacggggagcggtgctgatgtaccagggcaaaagactcgagcctagttgggctagcgttaagaaagacttgatttcctacggtgggggatggaggctgcagggctcttggaataccggcgaggaagtgcaggtcatcgccgtggagcccgggaagaaccccaaaaatgtacaaacagcacccggaacttttaagacccctgaaggtgaggtcggcgccattgctctcgatttcaagccagggacgtcgggaagccccatcgtgaaccgagaaggcaaaatagttggtctgtatgggaatggagtggtcacaacttcaggcacctacgtgtccgccatcgcacaggctaaggccagtcaggagggccctcttccggagattgaagacgaggtttttcggaaacgcaacctgacaatcatggatttgcacccagggtctggaaagaccagaaggtatctacccgcgattgtgcgggaagccatcaaacgaaagctgagaactctcatattagcacctacccgcgtcgtggctagcgagatggccgaagctctgaagggtatgccaattaggtaccaaacaacggcagtaaaatccgagcatactggcaaggagatcgtggaccttatgtgccacgccaccttcacaatgcgtctgctctcacccgttcgggtccctaattataacatgatcattatggatgaagcccattttaccgacccgtctagcatcgctgcgagagggtacataagtactagggtgggaatgggcgaggcagccgctattttcatgacagccacacccccaggttccgtggaagcatttcctcagagcaatgccgtcatccaggatgaggaacgcgacattcccgagcgatcttggaactcagggtatgagtggatcacggatttcccaggaaaaactgtatggtttgtgccttccataaagagtggcaatgacattgctaactgtttgaggaaaaatggcaagcgggttatccagctgagcaggaagacattcgataccgaataccagaaaaccaagaacaacgactgggactacgtggtcactacagatatctcggagatgggggcgaatttccgcgccgaccgtgtgattgatcccagacggtgcctcaaaccagttatcctgaaggacggaccggaaagggtgattcttgcaggtcctatgcccgtcaccgtggcttctgccgcacagcgccgaggcagaatagggcggaaccacaataaagagggagatcagtatatctacatgggccagccactaaacaatgacgaggatcatgcccactggacagaagctaagatgctgttggacaacattaatactcccgagggtatcatccctgccttatttgaaccagagagggaaaagtccgcggcaattgatggggagtatcgcctgagaggcgaggccaggaaaacgttcgtagaactcatgcggcgtggagacctgcccgtgtggcttagctacaaggttgcttcagagggctttcaatatagtgatcgccgatggtgcttcgacggggaaagaaacaatcaggtcctggaggaaaacatggatgtggagatatggaccaaagagggagaaaggaagaaactccggcctcgctggttggacgccagaacatactctgacccgctggctctaagggagtttaaggagttcgcagccggtcggcgatccgtgagcggcgatctgatcctcgagattgggaaacttccacagcacctgactcagagagctcaaaatgccttagacaacttggtcatgctgcataattcagaacagggaggccgcgcatataggcacgcgatggaggagctccccgataccatcgaaacactgatgcttctggccctcattgctgttttgaccggtggggtgactctgtttttcttaagtggccggggactaggcaagacgagcatcgggctgctctgtgtaatggcctcctctgtgcttctgtggatggcaagcgtcgagcctcattggatagctgcctccatcattttggaatttttcctgatggtgctcctgatccccgagccagaccgtcagagaacccctcaggataaccaacttgcatacgttgtgattggactcctgtttatgatcttgacagtcgccgctaatgagatgggtctgttagaaactaccaagaaagacctaggcatagggcacgtagcggtggagaaccaccatcacgccgcaatgctggatgttgacctccatcccgcttcagcctggacactttacgccgtggcaaccactattatcacaccaatgatgaggcacacgattgaaaacaccactgctaatatctctctgacagccatagcgaaccaggctgccatcttgatgggactggataagggctggcctattagtaaaatggacatcggtgtcccgctcctggcacttgggtgctatagccaggtgaatcccttaaccctgaccgccgctgtcctcatgttggtggcacattacgccattatcggcccaggactgcaagcgaaggctacacgcgaggcccagaaacggactgcagccggcataatgaagaaccctacggttgatgggattgtggctatcgacctagatcccgtagtgtatgacgccaagttcgaaaaacagctgggacagatcatgctccttattctgtgtaccagccaaatcttgctgatgcgaacaacttgggcactctgcgagtccataaccctggctacaggcccattaaccactctttgggagggttctcctgggaagttttggaatacgacaattgccgtctcaatggcgaacatcttcagaggaagctacctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctataagagatcaggtattatggaggttgaccgttccgaagcaaaagaggggcttaagaggggagagacaactaaacacgctgtgagtcggggcaccgccaagctgcgctggttcgtcgaacgaaatttggtgaaacccgagggtaaggtaatcgatctgggctgtgggagaggaggctggagctactattgcgccgggctcaagaaagtgacagaagttaagggatacacgaaaggcggtccggggcacgaggaaccaatacctatggcgacctacggatggaacttagtgaagctgcattctggcaaagacgtctttttcatacccccagagaagtgtgatactcttctgtgcgacattggcgagtcctcacccaatcctacaatcgaagaggggaggaccctacgggtgctcaaaatggtcgaaccgtggctgcgcggaaaccaattttgtattaagatcttgaatccctatatgccaagcgtggttgagactctggagcagatgcagagaaagcacggtggcatgctcgtaaggaaccctctttcgcgaaattctacacatgaaatgtactgggtgagttgcgggaccggaaacattgtctccgctgtgaatatgacgagccggatgctgttaaaccgtttcaccatggcacacagaaaacccacatatgagcgcgatgttgacctgggcgccggtactaggcacgtggctgtcgaacctgaggtggccaacttggatatcatagggcagcggattgaaaatatcaagcatgagcacaaatcaacctggcattacgacgaggataacccatataagacatgggcataccacggatcctatgaagtaaaaccctctggcagcgccagttccatggtgaatggcgttgtcaagctcctgactaagccttgggacgtgatcccaatggtgacccaaattgctatgacagataccactccctttgggcagcagagagtcttcaaagagaaggttgacacgcgcacaccgaaagcgaagaggggaaccgcccaaataatggaagtgactgcaaaatggctatggggttttcttagccgaaacaagaagcctcggatctgtaccagagaggagttcacaaggaaagtacgctctaatgctgccattggcgcagtgtttgtcgacgagaaccagtggaactcagccaaggaggctgtggaagatgagcgtttctgggacctggttcatcgggaaagagagctccacaaacaggggaagtgcgccacgtgcgtgtacaacatgatgggaaaaagggaaaagaagctgggcgagtttggtaaagcgaaggggagtcgcgcaatctggtacatgtggttgggagcccgattcctggagttcgaagctctcggctttatgaatgaggatcactggttctcccgggaaaacagcctttctggcgtcgagggggagggactgcataaattaggttatattctgagagacatctcgaagataccaggcgggaatatgtacgccgatgacaccgcaggatgggatactaggatcacagaagacgatttgcagaacgaggctcgcattaccgacatcatggaacccgagcacgccctcctggctaaatcaatttttaagctaacttatcaaaataaagtggtaagagttcagcggcctgccaagaacggcacagtgatggatgtcatcagcaggcgtgaccagcgaggttccggacaggtgggaacctacggccttaatacattcactaacatggaagcacaactgatacgccagatggagagtgagggcatattttctccaagcgaactcgagacccccaacctggcggaaagagtgttggattggttagagaagtatggggtcgaacggctgaaaaggatggccatctccggagacgactgtgttgtgaagccgatcgatgaccgcttcgctacggccctcaccgcacttaatgatatgggtaaagtaagaaaggacattcctcagtgggagccctcaaaaggctggaacgattggcagcaagtgccattttgcagtcatcacttccaccagctgataatgaaggacgggcgggagatcgtcgtgccttgtaggaatcaggatgagctggttggacgagctcgtgtgtctcagggcgccggttggagcctgagagagacagcatgcctcgggaagtcctacgcccaaatgtggcagttgatgtattttcatcgccgggacctgaggcttgcggctaacgccatttgttcagcagtccccgtggattggatcccaactagcagaaccacatggtctattcacgcccatcaccagtggatgactaccgaagacatgctgtccgtatggaatcgcgtttggatcgaggaaaacccctggatggaggataaaacgcatataagtagctggggagacgtgccttacctcggcaagcgggaggaccaatggtgcggctcgttaatcgggctgacagctagggccacctgggcaactaatattcaggtcgctatcaaccaggtgcgaagattgattggaaatgaaaactacctggattatatgacatccatgaaacggttcaagaatgagtctgacccagaaggtgccctctggtga

SEQ ID NO: 13916 - RNA, 9879 nt, synthetic construct
  misc_feature 1..9879: note = derived and/or modified CDS sequence (opt3) from DENV-1__GU131740__SS-prME
  source 1..9879: mol_type = other RNA
agcgtgaccatgctgctcatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgtgccttgcaagataccattttctacccaggatgaaaaaggggtaactcaaaacggacgccttatcacagcgaatcccattgtcaccgacaaggagaaacctgtgaacatcgaagcagagccacccttcggcgagtcctatatagttattggtgccggggaaaaggctttgaagctgtcatggtttaaaaagggcagtagcatcggaaaaatgttcgaggccactgcaagaggcgccaggcggatggctatcctcggggataccgcctgggactttggatccattggtggcgtgttcacatctgtcgggaagctggtgcatcagatctttggaacggcatacggcgtacttttcagcggtgtgtcatggaccatgaaaattgggataggcgttctgttgacttggctcggactgaatagtcgatccactagcttatctatgacctgtatcgcggtcggcctggtgacactatacctcggggtgatggtccaggctgattcaggatgcgttattaactggaagggccgcgaactgaagtgtggtagtgggatctttgtgactaatgaggtgcacacctggacggaacagtataaattccaagccgacagcccgaagagactttccgcagccatcggaaaggcttgggaggagggcgtatgcggtattaggtctgccacacggttggaaaacataatgtggaagcagatctcgaacgagctgaatcatattctcctggaaaacgacatgaaatttaccgtcgtggttggcgatgtggcagggatcttagctcagggaaagaaaatgattcgccctcagcccatggagtacaagtatagctggaagtcctggggcaaagccaagatcataggggcggacgtccaaaatactaccttcatcattgatggaccaaacacacctgaatgtcccgacgatcagagagcctggaatatctgggaggtggaggactacggctttggtattttcactaccaacatctggctgaaacttagggattcatatacacaggtttgcgaccaccgtttgatgagtgctgcaataaaggattctaaagccgtgcacgctgacatggggtactggattgaaagcgagaagaatgaaacgtggaagctcgcccgggcatccttcatcgaggtaaaaacctgtatttggccaaagtcacatactctgtggagcaacggagtcctagaatctgagatgatcatacccaaaatctatggcggtcctatttcccagcacaattaccgaccaggctactttacacaaaccgcggggccgtggcatctgggaaagctcgagctggatttcgacctttgcgaaggcactacagtggtggtcgatgagcactgcgggaacagaggacccagtttgaggaccacgactgttaccggcaaaatcattcacgaatggtgttgccgcagctgtacactgcctccattacggtttaagggtgaggacgggtgctggtatggaatggagatcagacccgtgaaggaaaaagaggaaaatctcgtaaagtctatggtgtccgccggctcaggtgaggtcgacagtttcagcctgggccttctgtgtatatcgattatgatcgaagaggtgatgaggtcccgctggtctcgaaaaatgttgatgaccgggactctcgctgtatttttcctgctaatcatgggacagctgacatggaacgatctcattcggctgtgcatcatggtgggcgccaatgcaagcgaccgtatggggatgggaaccacataccttgctttgatggccacttttaagatgagacctatgttcgcagtcggcctgttatttaggcgcctcacctcacgggaggtgctgcttctgacgattggtctaagtctcgttgcctccgtggaactgccaaactctttggaggaactgggggatggattagctatgggcataatgatcctcaaactgcttacagacttccagagccatcaactgtgggcgaccttgctctcctttactttcattaagaccacattttcactgcactatgcctggaagactatggcaatggtcctaagcatcgtaagtctgttccccctttgtctctctaccacgtcccagaaaacaacctggctgccggtgttgctgggcagcttagggtgcaagcctctcactatgttcctgattgctgagaataaagtttggggaagaaagtcgtggccacttaacgaaggtatcatggccgtgggcatagtctcaatcctgttgtctagtctcctgaaaaacgatgtgcccctagccgggcctctgattgctggaggcatgcttatcgcatgttacgtaatttccggtagctctgccgacctcagcctggagaaggcggctgaggtgtcctgggaagaggaagccgagcattcaggggcaagtcacaatatcttggtcgaagttcaggatgacggaacaatgaaaataaaggatgaggagagggacgataccttaactattctgctcaaggccacactgcttgctgtgagcggcgtgtatcccctgtctatcccagcaaccttgtttgtctggtacttctggcagaaaaagaaacaacgatccggcgtgctatgggacacgccttcacccccagaagttgagcgcgccgtactggatgacgggatctatcggattatgcagagaggactcctgggtaggagtcaggtgggcgtcggggtgtttcaggaaaacgttttccatactatgtggcacgtgacccgtggagcggtccttatgtaccaaggcaagcgcttagagccgagctgggcttccgtgaaaaaggacctgatatcttacggtgggggatggcggctccagggctcgtggaatacaggcgaggaagtacaggtcatcgccgtggagcctgggaagaaccccaaaaatgttcagaccgcaccaggaacatttaagactagcgaaggtgaggtgggcgccattgctttggatttcaaacccgggacctcaggatcccctatcgtcaacagagaaggcaagattgtgggtctgtatgggaatggagttgtgacgacaagtggcacttacgtctctgccatcgcacaagctaaagccagccaggagggcccactccccgagatagaagacgaggtgtttaggaagcgaaacctgaccatcatggatcttcaccctgggtccggaaagacacggcgctatctgccggcgattgtaagagaagccatcaaaaggaagttgcggaccctaattctggcaccaactcgagtggttgcttcagagatggccgaagctctcaaaggtatgcccatcagataccagaccacagcagtcaagtctgagcatacgggcaaagagatagtggacttaatgtgccacgccactttcaccatgcgcctgcttagccctgtgagggtcccaaattataacatgattatcatggatgaagcccattttacagaccccagttccatcgctgcgcgtgggtacattagcacccgggtaggaatgggcgaggcagccgctatcttcatgactgccacacctccgggttctatggaagcatttccccaatcaaatgccgtgatacaggatgaggaaagagacattccagagaggtcctggaacagtgggtatgagtggatcaccgatttccctggaaagacggtttggttcgtgcccagcattaagtcgggcaatgacatcgctaactgtctgcgcaaaaatggcaagcgagtcatacagctctctagaaaaacttttgatacagaataccagaagaccaaaaacaacgactgggactacgtggttaccactgatatttccgagatgggggcgaatttccgggccgacagggtgatcgatccacgccgttgcttgaagcctgtcatcctgaaggacggacccgaaagagtgattctcgcaggtccaatgccggtaacagtggctagcgccgcacaacggaggggccgcatcgggcgaaaccacaataaagagggagatcagtatatttacatgggccagcctctgaacaatgacgaggatcatgcccactggaccgaagctaagatgcttctagacaacataaatacacccgagggtatcattccagccctgtttgaacccgagagagaaaaatcagcggcaatcgatggggagtatcggttgaggggcgaggcccgcaagactttcgttgaattaatgagaaggggagacctgcctgtctggctcagttacaaagtggcttctgagggctttcagtattccgatcggcgttggtgcttcgacggggaacgcaacaatcaagtgctggaggaaaacatggatgtcgagatctggacgaaggagggagaacgaaagaaacttagaccaaggtggctggacgcccggacctacagcgaccccctcgctttgcgcgagtttaaagagttcgcagccggtagaaggtcagttagtggcgatctgattctagagatagggaaactgcctcagcacctcacacagcgggctcagaatgcccttgacaacctggtgatgttacataatagcgaacaaggaggccgagcatatagacacgcgatggaggagttgccggatactatcgaaaccctgatgctcctggcccttattgctgtactgacaggtggggtgaccctctttttcttgtccggccgcggactgggcaagacttctatcgggttactatgtgtcatggccagctccgtgctgctctggatggcatcagttgagccacattggattgctgcctctatcatacttgaatttttcctgatggtgttgctgatccccgagcctgacaggcagcggacgccccaggataaccagctcgcatacgtcgtaattggactgctttttatgatcctcaccgtggccgctaatgagatgggtctgttggaaacaactaaaaaggacctgggcattgggcacgcggccgttgagaaccaccatcacgcagctatgttagatgtggacctacatccagccagtgcctggaccctgtacgcagtcgctacaaccatcataactcctatgatgcgtcacacaattgaaaacacgaccgccaatatctcgctcactgcgattgctaaccaagccgcaatccttatgggactggataaaggctggcccataagcaagatggacatcggtgtgccattgctggccctcgggtgctattcccaggtcaatcctctgacacttaccgctgcagtgttaatgctggttgcccattacgcgattatcggcccgggactccaggctaaggccaccagagaggcacagaagaggacagccgctggcattatgaagaaccccactgtggatgggatcgtagccatagacttggatccagtggtctatgacgcaaaattcgaaaagcagctgggacagattatgctactgatcctctgtacgtctcagatccttctgatgcgcaccacatgggctttgtgcgagtcaattactctggccaccggccctctcacaaccctgtgggagggtagccccgggaaattctggaatactacgatcgcggtttccatggccaacatatttcggggaagttacttagcaggcgctggtcttgccttctctctgatgaaaagcctcggcgggggacgaagaggcacaggggcacaaggagaaaccctaggcgagaagtggaaaaggcagctgaatcagttgtcaaagtccgaatttaacacttataaacgcagtggtattatggaggtggaccggagcgaagctaaggaggggctgaaaagaggagagaccacaaagcacgccgtctctcgtggcactgccaagctcaggtggttcgtggaacggaatcttgtaaaaccagagggtaaggtgatcgatctgggctgtgggcgcggaggctggtcctactattgcgcggggttgaaaaaggttaccgaagtgaaaggatacacaaagggcggtcctgggcacgaggaacccattccgatggctacgtacggatggaacctggtcaaactccattcaggcaaggacgtgtttttcatcccacctgagaagtgtgataccttactgtgcgacataggcgagagctcgcccaatccaactatcgaagaggggcgaacacttagagtcctgaaaatggtggaaccctggctaaggggaaaccagttttgtattaagatcctcaatccttatatgccgtctgttgtagagaccctggagcaaatgcagcggaaacacggtggcatgttggtgcgcaaccccctgagtagaaattccactcatgaaatgtactgggtcagctgcgggacaggaaacattgtgtcagcagttaatatgacctccaggatgctccttaaccgattcacgatggcccaccggaagccaacctatgagcgtgatgtggacctgggcgctggtacaagacacgtcgccgtggaacctgaggtagcaaacttagatatcattgggcagcgcatcgaaaatataaaacatgagcacaagtctacttggcattacgacgaggataacccctataagacctgggcctaccacggaagctatgaagtgaaacctagtggctccgctagctctatggttaatggcgtcgtgaagctgttgacaaaaccatgggacgtgattcccatggtcactcagatcgcgatgaccgatacaaccccttttgggcaacagagggttttcaaggagaaagtggacactcggacgccaaaggccaagagaggaacagcacagatcatggaagtaaccgctaaatggctctggggttttctgtcacgcaacaagaaacccaggatttgtactcgagaggagttcacccggaaggtgagaagtaatgccgcaataggcgccgtctttgtggacgagaaccaatggaactccgctaaagaggccgttgaagatgagaggttctgggacctagtgcatcgcgaacgtgagcttcacaagcaggggaagtgcgcgacatgcgtctacaacatgatgggaaaacgggaaaagaaactgggcgagttcggtaaggcaaaagggagcagagccatctggtacatgtggctcggagctaggtttctggagttcgaagccttgggctttatgaatgaggatcactggttctctcgcgaaaactcgctgtcaggcgtggagggggagggactccataaacttggttatattctgcgagacatcagcaaaattccgggcgggaatatgtacgcagatgacacggctggatgggatacccggatcactgaagacgatttacagaacgaggccaagataacagacatcatggaacctgagcacgctctgttggccaagtccatttttaaactcacctatcagaataaggtagttagagtgcaaaggccagccaagaatggcactgtcatggatgtgatcagtcgcagagaccagcggggttctggacaggtgggaacatacggcctgaataccttcacaaacatggaagcgcagctaattaggcaaatggagagcgagggcatcttttccccctcagaacttgagactcctaacctggccgggcgtgtcctcgattggctggaaaagcatggagttgagcgattgaaacgcatggctataagtggtgacgactgtgtggtaaagccaattgatgacagattcgccaccgcattaacggctctgaatgatatgggcaaggtgcggaaagacatcccccagtgggaaccgtctaaggggtggaacgattggcagcaggtccctttttgcagccaccacttccatcaactcatcatgaaagacggaagggagattgtggttccctgtcgcaatcaggatgagcttgtgggcagagcccgggtctcccagggtgcagggtggtcactgagggaaaccgcctgcctaggaaagagctatgcgcagatgtggcaactgatgtactttcaccgacgtgacctcagattggctgccaacgcaatatgttctgccgtgccagtagattgggttcctacatcccgcactacctggagtatccatgctcaccatcagtggatgacaactgaggacatgctgagcgtgtggaatcgggtctggattgaagagaacccctggatggaagataaaacccacatctcgtcctggggcgacgtgccatatcttggcaagagggaggaccagtggtgcgggtctctgattggactcacggccagagcaacatgggctaccaatatccaagttgccataaaccaggtgcgccggttaatcggtaatgagaactacctggattacatgacttcaatgaagaggttcaaaaatgaaagcgaccccgagggcgcgttgtggtga

SEQ ID NO: 13917 - RNA, 9879 nt, synthetic construct
  misc_feature 1..9879: note = derived and/or modified CDS sequence (opt3) from DENV-1__GU131741__SS-prME
  source 1..9879: mol_type = other RNA
agcgtgacaatgctgctaatgcttatgcccacagccctggctttccacttgactacgcgaggcggggaacctcatatgatcgtctccaagcaggaaaggggaaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgtaagcaccagtcaagagacttggaatcggaaagaccttctggttacatttaagaccgcacacgctaagaaacaggaagtggtcgtgttgggttctcaggagggggccatgcacacagctctcactggcgccaccgaaatccaaacgtccggaaccacaactattttcgcaggccatctgaagtgccgtttaaaaatggataagctgaccctaaaagggatgagctatgtcatgtgtacaggatcgttcaagctcgagaaggaagtggccgagactcagcacggtaccgttctggtgcagataaaatacgagggcacggacgctccttgcaagatcccattttctacacaggatgaaaaaggggtaacccaaaacggacgccttattactgcgaatcccatcgtcacagacaaggagaaacctgtgaacatagaagcagagccacccttcggcgagtcctatattgttatcggtgccggggaaaaggctttgaagctgtcatggtttaaaaagggcagtagcatcggaaaaatgttcgaggccaccgcaagaggcgccaggcggatggctattctcggggatactgcctgggactttggatccatcggtggcgtgttcacctctgtcgggaagctggtgcatcagatttttggaacagcatacggcgtacttttcagcggtgtgtcatggacgatgaaaatagggatcggcgttctgttgacctggctcggactgaatagtcgatccactagcttatctatgacatgtattgcggtcggcctggtgaccctatacctcggggtgatggtccaggctgattcaggatgcgttatcaactggaagggccgcgaactgaagtgtggtagtgggatctttgtgacaaatgaggtgcacacttggaccgaacagtataaattccaagccgacagcccgaagagactttccgcagccattggaaaggcttgggaggagggcgtatgcggtataaggtctgccacgcggttggaaaacatcatgtggaagcagatttcgaacgagctgaatcatatcctcctggaaaacgacatgaaatttacagtcgtggttggcgatgtggcagggattttagctcagggaaagaaaatgatccgccctcagcccatggagtacaagtatagctggaagtcctggggcaaagccaagataatcggggcggacgtccaaaataccactttcattatcgatggaccaaacacccctgaatgtcccgacgatcagagagcctggaatatttgggaggtggaggactacggctttggtatcttcacaactaacatatggctgaaacttagggattcatatacccaggtttgcgaccaccgtttgatgagtgctgcaattaaggattctaaagccgtgcacgctgacatggggtactggatcgaaagcgagaagaatgaaacatggaagctcgcccgggcatccttcattgaggtaaaaacgtgtatctggccaaagtcacataccctgtggagcaacggagtcctagaatctgagatgataatccccaaaatttatggcggtcctatctcccagcacaattaccgaccaggctactttactcaaacagcggggccgtggcatctgggaaagctcgagctggatttcgacctttgcgaaggcaccactgtggtggtcgatgagcactgcgggaacagaggacccagtttgaggacaaccacggttactggcaaaattatccacgaatggtgttgccgcagctgtaccctgcctccattacggtttaagggtgaggacgggtgctggtatggaatggagataagacccgtgaaggaaaaagaggaaaatctcgtaaagtctatggtgtccgccggctcaggtgaggtcgacagtttcagcctgggccttctgtgtatttcgatcatgatcgaagaggtgatgaggtcccgctggtctcgaaaaatgttgatgacagggaccctcgctgtatttttcctgctaattatgggacagctgacttggaacgatctcatccggctgtgcattatggtgggcgccaatgcaagcgaccgtatggggatgggaacaacctaccttgctttgatggccacatttaagatgagacctatgttcgcagtcggcctgttatttaggcgcctcacttcacgggaggtgctgcttctgaccataggtctaagtctcgttgcctccgtggaactgccaaactctttggaggaactgggggatggattagctatgggcatcatgattctcaaactgcttacggacttccagagccatcaactgtgggcgacattgctctccctgacctttatcaagactaccttctcactacactatgcctggaagacaatggcaatggtcctgagcattgtaagtctttttcccctctgtctgtctactacctcccagaaaacgacatggttgccggtgctgttaggcagcctcgggtgcaagcctctgaccatgttccttatcgctgagaataaaatatggggaagaaagtcgtggccactgaacgaaggtatcatggccgttggcattgtgtcaatcttgctctctagtctgctcaagaatgatgtccccctggccgggcctcttattgctggaggcatgctcatcgcatgttacgtgatatccggtagctctgccgacctgagcttggagaaggcggctgaggtatcctgggaagaggaagccgagcattcaggggcaagtcacaatattttagtggaagtccaggatgacggaactatgaaaatcaaggatgaggagagggacgatacactgaccatcctcctgaaggccactcttctggctgttagcggcgtgtatcccttgtctattccagcaacactattcgtgtggtacttttggcagaaaaagaaacaacgatccggcgtcctgtgggacaccccttcacccccagaagtggagcgcgccgttctcgatgacgggatatatcggatcatgcagagaggactgcttggtaggagtcaggtaggcgtgggggtcttccaggaaaacgtgtttcatacgatgtggcacgttactcgtggagcggtgttaatgtaccaaggcaagcgcctggagccgagctgggcttccgtcaaaaaggacctcatttcttacggtgggggatggcggttgcagggctcgtggaataccggcgaggaagtgcaggtaatcgccgtcgagcctgggaagaaccccaaaaatgtgcagacagcaccaggaaccttcaagacaagcgaaggtgaggttggcgccattgctctggattttaaacccgggacttcaggatcccctatcgtgaacagagaaggcaagatagtcggtctctatgggaatggagtggttaccacgagtggcacatacgtgtctgccatcgcacaagctaaagccagccaggagggcccactgcccgagattgaagacgaggtcttcaggaagcgaaaccttactatcatggatctgcaccctgggtccggaaagacccggcgctatttgccggcgattgtgagagaagccatcaaaaggaagctacggacactgatactcgcaccaacccgagtagtggcttcagagatggccgaggctttaaaaggtatgcccattagataccagactaccgcagttaagtctgagcatacaggcaaagagatcgtcgacctgatgtgccacgccacgtttactatgcgccttctgagccctgtgagggtgccaaattataacatgatcattatggatgaagcccatttcaccgaccccagttccatcgctgcgcgtgggtacataagcacacgggtcggaatgggcgaggcagccgctatttttatgaccgccactcctccgggttctgtagaagcattcccccaatcaaatgccgtgatccaggatgaggaaagagacattccagagaggtcctggaacagtgggtatgagtggatcacagattttcctggaaagaccgtttggttcgtgcccagcataaagtcgggcaatgacattgctaactgtctccgcaaaaatggcaagcgagtcatccagttgtctagaaaaacgttcgatactgaataccagaagaccaagaacaacgactgggactacgtggttaccaccgatatctccgagatgggggcgaattttcgggccgacagggtgattgatccacgccgttgcctgaagcctgtcatcctcaaggacggacccgaaagagtgattctggcaggtccaatgccggtaactgtggctagcgccgcacaacggaggggccgcatagggcgaaaccacaataaagagggagatcagtatatctacatgggccagcctcttaacaatgacgaggatcatgcccactggacagaagctaagatgctactggacaacattaatacccccgagggtatcatcccagccttgttcgaacccgagagagaaaaatcagcggcaattgatggggagtatcggttaaggggcgaggcccgcaagacatttgttgaactgatgagaaggggagacctccctgtctggctgagttacaaagtggcttctgagggcttccagtattccgatcggcgttggtgctttgacggggaacgcaacaatcaagtgcttgaggaaaacatggatgtcgagatatggactaaggagggagaaagaaagaaactgagaccaaggtggctcgacgcccggacgtacagcgaccccttggctctgcgcgagttcaaagaatttgcagccggtagaaggtcagttagtggcgatctaatcctggagattgggaaactccctcagcaccttacccagcgggctcagaatgccctggacaacttagtgatgttgcataatagcgaacaaggaggccgagcatatagacacgcgatggaggagctgccggatacaatcgaaactctcatgctgcttgccctgattgctgtactcaccggtggggtgacattgttctttctgtccggccgcggattaggcaagacctctatcgggctactgtgtgtcatggccagctccgtgctcctttggatggcatcagttgagccacattggatagctgcctctatcattctggagttctttttgatggtgctgctcatccccgagcctgacaggcagcggactccccaggataaccagctggcatacgtcgtaattggacttctcttcatgatcctgacggtggccgctaatgagatgggtttgctggaaaccaccaaaaaggacttaggcatagggcacgttgcggtggagaaccaccatcacgccgcaatgctagatgtcgacctgcatccagctagtgcctggactctctacgccgtggcaaccacaattatcacccctatgatgcgtcacactattgaaaacacaacggctaatatctcgcttaccgccatagcgaaccaagctgccatcctgatgggattggataaaggctggcccattagcaagatggacatcggtgtcccactgctcgcactggggtgctattcccaggtgaatcctcttactttaacagccgctgttctgatgctcgtggcacattacgccattatcggcccgggattgcaggcgaaggctaccagagaggcccagaaaaggaccgcagccggcataatgaagaaccccacagtagatgggattgtggctatcgacctggatccagtcgtttatgacgccaaatttgaaaagcagctaggacagatcatgctgctcattctttgtacttctcagatcctgttgatgcgcacgacctgggcactgtgcgagtcaataacactcgctactggccctctgaccacattatgggagggtagccccgggaaattctggaataccactattgccgtgtccatggcgaacatcttccggggaagttaccttgccggcgcaggtctggctttttctctcatgaaaagcctaggcgggggacgaagaggcacgggggcccaaggagaaacactgggcgagaagtggaaaaggcagttgaatcagctgtcaaagtccgagttcaacacctataaacgcagtggtattatggaggtcgaccggagcgaagcaaaggaggggctcaaaagaggagagactaccaagcacgctgtgtctcgtggcacagccaaacttaggtggtttgtagaacggaatctggtgaaaccagagggtaaggttatcgatttgggctgtgggcgcggaggctggtcctactattgcgccgggctgaaaaaggtgactgaagtcaaaggatacaccaagggcggtcctgggcacgaggaacccataccgatggcgacatacggatggaacctcgtgaaattacattcaggcaaggacgtcttctttatcccacctgagaagtgtgatacgctgctttgcgacattggcgagagctcgcccaatccaaccatcgaagaggggcgaactctgagagtgctaaaaatggttgaaccctggctcaggggaaaccagttctgtattaagatcctgaatccttatatgccgtctgtagtggagacattggagcaaatgcagcggaaacacggtggcatgctggtccgcaaccccctcagtagaaattccacccatgaaatgtactgggtgagctgcgggactggaaacattgtttcagctgtgaatatgacatccaggatgcttctgaaccgatttaccatggcacaccggaagccaacgtatgagcgtgatgtcgacttaggcgccggtaccagacacgtggctgtagaacctgaggtggccaacctggatatcatagggcagcgcattgaaaatatcaaacatgagcacaagtctacatggcattacgacgaggataacccctataagacttgggcataccacggaagctatgaagttaaacctagtggctccgccagctctatggtcaatggcgtggtgaagttgctcaccaaaccatgggacgtcatccccatggttacacagattgctatgactgataccacacctttcgggcaacagagggtgtttaaggagaaagtagacacccggactccaaaggcgaagagaggaacggcccagataatggaagtgacagcaaaatggctgtggggtttcctatcacgcaacaagaaacccaggatctgtacccgagaggaatttactcggaaggtcagaagtaatgctgccattggcgcagtgttcgttgacgagaaccaatggaactccgccaaagaggctgtggaagatgagaggttttgggaccttgtccatcgcgaacgtgagctgcacaagcaggggaagtgcgcaacatgcgtgtacaacatgatgggaaaacgggaaaagaaactcggcgagttcggtaaggcgaaagggagcagagcaatctggtacatgtggctgggagccaggttcttggagtttgaagctctgggcttcatgaatgaggatcactggttttctcgcgaaaactcgctctcaggcgtagagggggagggacttcataagctgggttatattttacgagacatcagcaaaataccgggcgggaatatgtacgccgatgacacagcaggatgggatacgcggatcaccgaagacgatctgcagaacgaggctaagattactgacatcatggaacctgagcacgccttgctcgctaagtccattttcaaactgacatatcagaataaggttgtgagagtccaaaggccagccaaaaacggcaccgtgatggatgtgatcagtcgcagagaccagcggggttctgggcaggtcggaacttacggcctaaatacatttaccaacatggaagcacagcttataaggcaaatggagagcgagggcattttctccccctcagaactggagacacctaacctcgcggggcgtgttctggattggttggaaaagcatggagtggagcgattaaaacgcatggccatcagtggtgacgactgtgtagtgaagccaatcgatgacagatttgctactgccctgaccgcactcaatgatatgggcaaggtccggaaagacattccccagtgggaaccgtctaaggggtggaacgattggcaacaggtgcctttctgcagccaccactttcatcaacttataatgaaagacggaagggagatcgttgtgccctgtcgcaatcaggatgagctggtcggcagagctcgggtgtcccagggtgccgggtggtcactaagggaaacggcatgcctgggaaagagctatgcccagatgtggcaactcatgtacttccaccgacgtgacttgagactggcggctaacgccatttgttctgcagtaccagttgattgggtgcctacctcccgcacaacttggagtatccatgcccaccatcagtggatgaccacagaggacatgcttagcgtctggaatcgggtgtggattgaagagaacccctggatggaagataaaactcacatctcgtcctggggcgacgttccatatctgggcaagagggaggaccagtggtgcgggtctctcataggattaaccgctagagccacgtgggcaacaaatatccaagtggctattaaccaggtccgccggctgatcggtaatgagaactacttggattacatgacctcaatgaagaggtttaaaaatgaaagcgaccccgagggcgccctgtggtga

SEQ ID NO: 13918 - RNA, 9879 nt, synthetic construct
  misc_feature 1..9879: note = derived and/or modified CDS sequence (opt3) from DENV-1__GU131743__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacgctaattgccatggacctcggcgaactgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagacccttctagcatcgcggcaagggggtacataagtacccgcgtgggaatgggcgaggccgctgccattttcatgactgcaacaccgcccggttccgtcgaagcctttccacagagcaatgctgtaatccaggatgaggaacgagacattcctgagagatcttggaactcagggtatgagtggatcaccgatttccccggaaagacggtgtggtttgttccatccataaaaagtggcaatgacattgcgaactgtttgcggaagaatggcaaaagggtgatccagctgagccgcaagactttcgatacagaataccaaaagaccaaaaacaacgactgggactacgtcgtgaccactgatatctcggagatgggggccaatttccgtgcagacagagttattgatcctcggaggtgcctcaagcccgtgatcctgaaagacggaccagaacgcgtcattcttgctggtccgatgcctgtgacagtagcctctgcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttatttgaacctgagcgcgaaaagtccgcagccattgatggggagtatagactgaggggcgaggctcggaagactttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatatggacgaaggagggagaacggaaaaagctccgccccagatggttggacgctaggacctactctgaccctctggcactacgggagtttaaagagttcgccgctggtcgaagatccgtcagcggcgatctgatcctcgagattgggaaacttccgcagcacctgacacagcgcgcccaaaatgcattagacaacttggttatgctgcataattcagaacagggaggcagggcgtatcggcacgccatggaggagctcccagatactatcgaaaccctgatgcttctggctctcattgccgtgttgacaggtggggtaaccctgtttttcttaagtggccgtggactaggcaaaactagcatcgggctgctctgtgtgatggcatcctctgtccttctgtggatggctagcgtggagccccattggatagccgcatccatcattttggaatttttcctgatggttctcctgatccctgagcccgacagacagaggacgccacaggataaccaacttgcctacgtggtcattggactcctgtttatgatcttgaccgtagctgcgaatgagatgggtctgttagaaacaactaagaaggacctaggcatagggcacgtggccgttgagaaccaccatcacgcagctatgctggatgtggacctccatcctgcctcagcctggaccctttacgcagtcgctacaaccattatcactcccatgatgcgccacacaattgaaaacacgaccgccaatatctctctgactgcgatagctaaccaggccgcaatcttgatgggactggataaaggctggccaattagtaagatggacatcggtgtgcctctcctggcccttgggtgctattcgcaggtcaatccgttaacactgaccgctgcagtgctcatgttggttgcccattacgcgattatcggccccggactgcaagctaaagccacccgggaggcacagaagcgaacagccgctggcataatgaaaaacccaactgtggatgggattgtagccatcgacctagatcctgtggtctatgacgcaaagttcgaaaagcagctgggacagatcatgctccttattctgtgtacgagccaaatcttgctgatgagaaccacatgggctctctgcgagtccataactctggccaccggccccttaacaaccctttgggagggttctccagggaaattttggaatactacgattgcggtttcaatggccaacatcttcaggggaagctacctggcaggcgctggtctcgccttctccctaatgaagagtctgggcgggggacgccggggcacaggggcacagggagaaaccttgggcgagaaatggaagagacagctgaatcagctctctaaaagcgaatttaacacttataagcgttcaggtattatggaggtggacaggtccgaagctaaggaggggcttaaacggggagagaccacaaagcacgccgtcagtcgcggcactgccaaactgcgatggttcgtggaaagaaatttggtaaagcctgagggtaaagtgatcgatctgggctgtgggaggggaggctggagctactattgcgcggggctcaagaaggttaccgaagtgaaaggatacacaaagggcggtcccgggcacgaggaaccgataccaatggctacgtacggatggaacttagtcaaactgcattctggcaaggacgtgtttttcatccctcccgagaaatgtgatacccttctgtgcgacattggcgagtcctcaccaaatcccactatcgaagaggggcggacactacgcgtcctcaagatggtggaaccttggctgagaggaaaccaattttgtattaaaatcttgaatccgtatatgcccagcgttgtagagaccctggagcagatgcagaggaagcacggtggcatgctcgtgcgaaacccactttcgagaaattctactcatgaaatgtactgggtcagttgcgggacaggaaacattgtgtccgcagttaatatgaccagccgtatgctgttaaacagattcacgatggcccaccgcaagcctacctatgagagggatgtggacctgggcgctggtacacggcacgtcgccgtggaacccgaggtagcaaacttggatgtgatcgggcagagaatagaaaatattaaacatgagcacaagtcaacttggcattacgacgaggataacccttataaaacctgggcctaccacggatcctatgaagttaagccatctggcagcgctagttccatggtcaatggcgtggtgaaactcctgacaaagccctgggacgtcatccctatggttactcaaatcgcgatgaccgatacaaccccatttgggcagcagcgcgtgttcaaggagaaagtagacactaggacgcccaaggccaaacgaggaacagcacaaattatggaagtgaccgctaagtggctatggggttttcttagccggaacaaaaagccgagaatatgtactagggaggagttcacccgcaaggtccgttctaatgccgcaatcggcgccgtgtttgttgacgagaaccagtggaactcagctaaagaggccgtggaagatgagcggttctgggacctggtccatagagaaagggagctccacaagcaggggaaatgcgcgacatgcgtgtacaacatgatgggaaagcgcgagaagaagctgggcgagtttggtaaggcaaaagggagtcgagccatttggtacatgtggttgggagctcggttcctggagttcgaagccctcggctttatgaatgaggatcactggttctccagagaaaacagcctttctggcgtagagggggagggactgcataagttaggttatatcctgagggacatttcgaaaatccctggcgggaatatgtacgcagatgacacggctggatgggatacccgcataactgaagacgatttgcagaacgaggccagaatcacagacattatggaaccagagcacgctctcctggccaagtcaatctttaaactaacctatcaaaataaggttgtgcgggtccagaggcccgccaaaaatggcactgtgatggatgtgattagccgtcgagaccagcgcggttccgggcaggtcggaacatacggccttaataccttcacaaacatggaagcgcaactgatcagacagatggagagtgagggcatattttctcctagcgaactcgagactccaaacctggccgaacgggttttggattggttagggaagtatggagtggagaggctgaagcgcatggctatttccggtgacgactgtgtagtgaaacccatcgatgacagattcgccaccgcactcacggctcttaatgatatgggcaaggtccggaaagacatcccgcagtgggaaccttcaaaggggtggaacgattggcagcaagtgcccttttgcagtcatcacttccaccagctgattatgaaagacggaagggagatagttgtgccatgtcgaaatcaggatgagctagtcggccgtgccagagtgtctcagggtgcagggtggagcctgcgcgaaaccgcctgcctcggaaagtcctacgcgcaaatgtggcagttgatgtattttcatcggagggacctgagacttgctgccaacgcaatctgttcagccgtacctgttgattggattcccacaagccgcactacctggtctatccacgctcatcaccagtggatgacaactgaggacatgctgtccgtgtggaatcgggtctggattgaagagaacccatggatggaagataagacccatatcagtagctggggcgacgtgccctacctcggcaaaagggaggaccaatggtgcgggtcgttaataggactgacggcccgagcaacatgggctaccaatatccaggttgccattaaccaggtgagacggttgatcggtaatgagaactacctggattatatgacttccatgaagaggttcaaaaatgaatctgaccctgagggcgcgctctggtga

SEQ ID NO: 13919 - RNA, 9879 nt, synthetic construct
  misc_feature 1..9879: note = derived and/or modified CDS sequence (opt3) from DENV-1__JN093516__SS-prME
  source 1..9879: mol_type = other RNA
agcgtgaccatgctgctcatgcttatgcccactgccctggctttccacttgactacgagaggaggggaacctcatatgatcgtctccaagcaggaaagggggaaatctttactgtttaagacctcagccggtgttaatatgtgcactctaattgccatggacctcggcgagttctgtgaagatactatgacctacaaatgcccacggataaccgaagcggaaccggacgatgtggactgttggtgcaatgctaccgatacttgggtaacctatgggacctgtagtcagacgggagaacaccgccgagacaagcgtagcgtggccctggcaccccatgtcggccttggtctggagactagaaccgaaacatggatgtcctctgagggggcctggaaacagatccagaaggtggaaacttgggctttgaggcaccctggatttaccgttattgcactcttcctggcccatgctatcggcacgtcgattacccagaagggcatcatatttatcctgctcatgttagtgacgccatcaatggccatgcggtgcgtcgggattggaagccgcgatttcgtggagggtctgagtggcgcgacttgggtagacgttgtgcttgagcacgggtcctgtgtcacaaccatggcaaaagataagcccactttggacatcgaactgctaaaaacagaggtgaccaaccctgccgtgctcagaaagctgtgcattgaagctaaaatctctaatacgaccacagatagtaggtgtccaactcaaggagaggccacccttgtcgaagaacaggacgcaaactttgtttgccggcgcacattcgtggatcgaggctggggtaatgggtgtggactgtttggcaagggctccttgataacttgcgctaagttcaaatgcgtaaccaagctcgaggggaaaacagtgcagcacgaaaacctgaagtactcagtcattgtgaccgttcatactggagaccagcaccaagtgggtaatgagagtacggaacatggcacaaccgccactatcacaccccaggcgcctagcacagagattcagttaaccgactatggggccctgactctcgattgttctccaagaacaggacttgactttaacgaaatggtcctgttgacgatgaaagagaagtcctggctagtgcacaaacagtggttcctggatctcccgctgccctggacctcaggcgcaagcacaagccaagagacatggaataggaaggaccttctggtaacctttaagacagctcacgccaaaaagcaggaagttgtggtcttgggttctcaggagggggctatgcatactgccctcaccggcgcaacggaaatccaaacctccggaacaactaccatcttcgccggccacctgaaatgccggttaaagatggataaactgacactaaaggggatgagctacgtgatgtgtactggatcgttcaagctcgagaaagaagtcgctgagacccagcatggtacggtgctggttcagattaagtatgagggcacagacgcgccttgcaaaataccattttctacccaggatgaaaagggggtgactcaaaacggacgtcttatcacagcaaatcccattgtaaccgacaaagagaagcctgtcaacatcgaagccgagccacccttcggcgagtcctacatagtgattggtgctggggaaaaggccttgaaactgtcatggtttaagaaaggcagtagcatcggaaagatgttcgaggcaactacccgcggcgccagaaggatggctatcctcggggatacagcctgggactttggatccattggtggcgttttcacgtctgtggggaaactggtccaccagatctttggaaccgcatatggcgtgcttttcagcggtgtatcatggactatgaagattgggataggcgtgctgttgacatggctcggactgaatagtcggtccaccagcttatctatgacatgtatcgcggttggcctggtcactctatacctcggggtgatggtgcaggctgattcaggatgcgtcattaactggaagggccgagaactgaaatgtggtagtgggatctttgttaccaatgaggtgcatacgtggacagaacagtacaagttccaagccgacagcccgaaacgcctttccgcagccatcggaaaggcttgggaggagggcgtgtgcggtattagatctgccaccaggttggaaaacataatgtggaaacagatctcgaacgagctgaatcacattctcctggaaaacgacatgaagtttactgtagtcgtgggcgatgttgcagggatcttagctcagggcaagaagatgattcggcctcagcccatggagtataagtacagctggaaatcctggggcaaggccaaaatcataggggcggacgtgcaaaataccacattcatcattgatggaccaaacactcctgaatgtcccgacgatcagcgcgcctggaatatctgggaggtcgaggactatggctttggtattttcaccacaaacatctggctgaaacttagagattcatacacacaggtgtgcgaccacaggttgatgagtgctgcaataaaagattctaaggccgttcatgctgacatggggtattggattgaaagcgagaagaatgaaacctggaaactcgcccgtgcatccttcatcgaggtgaagacttgtatttggccaaaatcacacacactgtggagcaacggagtactagaatctgagatgatcatacccaagatctacggcggtcctatttcccagcataattatcggccaggctactttacccaaactgcggggccgtggcacctgggaaaactcgagctggatttcgacctttgcgaaggcacaaccgtcgtggtggatgagcactgcgggaaccgaggacccagtttgagaacgactaccgtcacaggcaagatcattcatgaatggtgttgcaggagctgtaccctgcctccattacgctttaagggtgaggacgggtgctggtacggaatggagatccggcccgttaaagaaaaggaggaaaatctcgtgaaatctatggtatccgccggctcaggtgaggtggacagtttcagcctgggccttctgtgtatatcgattatgatcgaagaggtcatgagatccaggtggtctcgcaagatgttgatgactgggacactcgctgtgtttttcctgctaatcatgggacagctgacctggaacgatctcattcgactgtgcatcatggttggcgccaatgcaagcgaccggatggggatgggaacaacttatcttgctttgatggccacctttaaaatgcgtcctatgttcgcagtgggcctgttatttagaaggctcacgtcacgcgaggtcctgcttctgacaattggtctaagtctcgtggcctccgttgaactgccaaactctttggaggaactgggggatggattagctatgggcataatgatcctcaagctgcttaccgacttccagagccaccaactgtgggcgactttgctctccctgacctttattaagacaactttctcactacattacgcctggaaaaccatggcaatggtgctgagcatcgtcagtctttttcccctctgtctgtctacgacatcccagaagaccacttggttgccggtactgttaggcagcctcgggtgcaaacctctgacaatgttccttattgctgagaataagatctggggacggaaatcgtggccactgaacgaaggtataatggccgtgggcatcgtttcaattttgctctctagtctgctaaagaacgatgtgcccctggccgggcctcttatcgctggaggcatgctcattgcatgttatgtcatctccggtagctctgccgacctgagcttggagaaagcggctgaggtgtcctgggaagaggaagccgagcactcaggggcaagtcataatatattagtagaagtgcaggatgacggaaccatgaagattaaggatgaggagagagacgatactctgacaatcctcctgaaagccacccttctggctgtcagcggcgtttaccccttgtctatcccagcaacgctattcgtgtggtatttttggcagaagaaaaagcaaaggtccggcgtgctgtgggacactccttcacccccagaagtcgagcgagccgtgctcgatgacgggatttaccgcataatgcagcggggactgcttggtagaagtcaggttggcgtaggggtgttccaggaaaacgtctttcacaccatgtggcacgtgacaaggggagcggttttaatgtatcaaggcaaacgtctggagccgagctgggcttccgtgaagaaggacctcatctcttacggtgggggatggcgcttgcagggctcgtggaataccggcgaggaagtccaggtgattgccgtagagcctgggaaaaaccccaagaatgtccagacagcaccaggaactttcaaaaccagcgaaggtgaggtgggcgccatcgctctggattttaagcccgggacgtcaggatcccctattgttaaccgggaaggcaaaatcgtgggtctctacgggaatggagtcgtgacaacaagtggcacctatgtttctgccatagcacaagctaaggccagccaggagggcccactgcccgagatcgaagacgaggtgttcagaaagaggaaccttacaattatggatctgcatcctgggtccggaaaaacccgacggtacttgccggcgatcgtccgcgaagccattaagagaaaactaaggactctgatcctcgcaccaacccgggtggtagcttcagagatggccgaggctttaaagggtatgcccatacgatatcagacaacggcagtgaaatctgagcacactggcaaggagattgttgacctgatgtgccatgccacctttacaatgagacttctgagccctgtccgcgtgccaaattacaacatgatcatcatggatgaagcccacttcaccgaccccagttccattgctgcgagggggtatatcagcactcgtgtgggaatgggcgaggcagccgctatatttatgacagccacccctccgggttctgtcgaagcattcccccaatcaaatgccgtaattcaggatgaggaacgggacatcccagagagatcctggaacagtgggtacgagtggattacggattttcctggaaagactgtgtggttcgttcccagcatcaaatcgggcaatgacatagctaactgtctcaggaagaatggcaaacgcgtgattcagttgtctcgaaagacattcgataccgaatatcagaaaaccaagaacaacgactgggactacgtcgtgactacagatatctccgagatgggggcgaattttagagccgaccgggttatcgatccaaggcgctgcctgaagcctgtgattctcaaagacggacccgaacgtgtcatcctggcaggtccaatgccggtgaccgtagctagcgccgcacaaagacggggcaggattgggcgcaaccataataaggagggagatcagtacatatatatgggccagcctcttaacaatgacgaggatcacgcccactggacagaagctaaaatgctactggacaacatcaatactcccgagggtattatcccagccttgttcgaacccgagcgagaaaagtcagcggcaatcgatggggagtacagattacggggcgaggccaggaaaacgtttgtggaactgatgcgcagaggagacctccctgtttggctgagttataaggtcgcttctgagggcttccagtactccgataggcggtggtgctttgacggggaacgtaacaatcaagtgcttgaggaaaacatggatgtggagatttggaccaaagagggagaacgcaagaagctgcgaccaagatggctcgacgccaggacatatagcgaccccttggctctgcgggagttcaaagaatttgcagccggtcgcagatcagtcagtggcgatctaatactggagatcgggaagctccctcagcatcttactcagagggctcagaatgccctggacaacttagttatgttgcacaatagcgaacaaggaggccgggcataccgacatgcgatggaggagctgccggataccattgaaacactcatgctgcttgccctgatcgctgtgctcaccggtggggtaactttgttctttctgtccggcagaggattaggcaaaacgtctattgggctactgtgtgtgatggccagctccgcactcctttggatggcttcagtcgagccacactggatcgccgcatctataatcctggagttctttttgatggtgctgctcattcccgagcctgaccgccagaggacaccccaggataaccagctggcctatgttgtgatcggacttctcttcatgattctgacagtcgctgcgaatgagatgggtttgctggaaactaccaagaaagacttaggcatcgggcacgtagccgtggagaaccatcaccatgcaacaatgctagatgttgacctgcacccagctagtgcctggaccctctacgccgtggcaactacaataattacgcctatgatgcggcataccatcgaaaacactacagctaatatttcgcttaccgccatcgcgaaccaagctgccatactgatgggattggataagggctggcccatcagcaagatggacattggtgtcccactgctcgcactggggtgctactcccaggtgaatcctcttaccttaacagccgctgtcctgatgctcgtggcacactatgccatcattggcccgggattgcaggcgaaagctactcgtgaggcccaaaagagaacggcagccggcatcatgaaaaaccccaccgttgatgggatagtggctattgacctggatccagtagtgtacgacgccaagtttgaaaaacagctaggacagatcatgctgctcatcctttgtacatctcagattctgttgatgaggactacctgggcactgtgcgagtcaatcacactcgctaccggccctctgactacgttatgggagggtagccccgggaagttctggaatacaaccatagccgtctccatggcgaacattttccgcggaagttatcttgccggcgcaggtctggctttttctctcatgaaaagcctaggcgggggacggcgaggcactggggcccaaggagaaaccctgggcgagaaatggaagagacagttgaatcagctgtcaaaatccgagttcaacacatacaagaggagtggtatcatggaggttgaccgcagcgaagcaaaagaggggctcaagcggggagagactaccaagcacgctgtgtctagaggcacagccaaacttcgttggtttgtcgaaaggaatctggtgaagccagagggtaaagtaattgatttgggctgtgggcggggaggctggtcctattactgcgccgggctgaagaaagtgacggaagttaagggatataccaaaggcggtcctgggcatgaggaacccatcccgatggcgacttacggatggaacctcgtgaagttacactcaggcaaggacgtcttctttataccacctgagaaatgtgatacactgctttgcgacatcggcgagagctcgcccaatccaaccattgaagaggggcgcactctgcgagtgctaaagatggtcgaaccctggctcagaggaaaccagttctgtatcaaaattctgaatccttacatgccgtctgtggttgagacattggagcaaatgcagaggaagcatggtggcatgctggtacggaaccccctcagtcgcaattccacccacgaaatgtattgggtgagctgcgggacgggaaacatcgtctcagctgtgaatatgacctccagaatgcttctgaacaggtttacaatggcacaccgaaaaccaacttacgagcgggatgttgacttaggcgccggtacccgtcatgtggctgtcgaacctgaggtggccaacctggatattatcgggcagagaatagaaaatattaagcacgagcataagtctacatggcactatgacgaggataacccctacaaaacttgggcatatcatggaagctacgaagtaaagcctagtggctccgccagctctatggtgaatggcgttgtcaaattgctcaccaagccatgggacgtgatccccatggtgacacagatcgctatgaccgatactacgcctttcgggcaacagcgcgtctttaaagagaaggttgacacaaggaccccaaaggcgaaacggggaactgcccagattatggaagtgaccgcaaagtggctgtggggtttcctatcaagaaacaaaaagccccgcatatgtacaagggaggaatttacgcgaaaagtacggagtaatgctgccatcggcgcagtgttcgtcgacgagaaccaatggaactccgccaaggaggctgtggaagatgagagattttgggaccttgttcacagggaacgcgagctgcacaagcaggggaaatgcgcaacctgcgtgtataacatgatgggaaagcgtgagaagaagctcggcgagttcggtaaagcgaaggggagccgggcaatttggtacatgtggctgggagccagattcttggagtttgaagctctgggcttcatgaatgaggatcattggttttctagggaaaactcgctctcaggcgtcgagggggagggacttcacaaactgggttacatcttacgcgacattagcaagatcccgggcgggaatatgtatgccgatgacactgcaggatgggatacacgaataaccgaagacgatctgcagaacgaggctaagatcactgacattatggaacctgagcatgccttgctcgctaaatccatcttcaagctgacataccagaataaagtggtacgggttcaaagaccagccaagaacggcaccgtgatggatgtcattagtaggcgcgaccagagaggttctggacaggtgggaacatatggcctaaatacttttaccaacatggaagcacagcttatccggcaaatggagagcgagggcatattctccccctcagaactggagacgcctaacctcgcggggagggtgctggattggttggaaaaacacggagtcgagcgtttaaagcgaatggccattagtggtgacgactgtgttgtgaagccaatcgatgaccgctttgctaccgccctgacagcactcaatgatatgggcaaagtaagaaaggacatcccccagtgggaaccgtctaaagggtggaacgattggcaacaggtgcctttctgcagccaccattttcaccaacttattatgaaggacggacgggagatagtcgtgccctgtaggaatcaggatgagctggttggccgcgctagagtgtcccagggtgccgggtggtcactacgggaaactgcatgcctgggaaaaagctacgcccagatgtggcaactcatgtatttccataggcgagacttgcgtctggcggctaacgccatctgttctgcagtcccagtggagtgggtacctacctccagaacaacttggagtattcacgcccatcaccagtggatgaccacggaagatatgcttagcgtttggaatcgcgtgtggatcgaggaaaacccctggatggaggacaagacacacatttcgtcctggggcgatgtcccatacctgggcaagcgggaggaccagtggtgcgggtctctcatcggattaaccgctagggccacttgggcaacaaatatacaagtggctatcaaccaggttagacgcctgattggtaatgaaaactatttggactacatgacctcaatgaaacggtttaagaatgagagcgatcccgaaggcgccctgtggtga

SEQ ID NO: 13920 - RNA, 9879 nt, synthetic construct
  misc_feature 1..9879: note = derived and/or modified CDS sequence (opt3) from DENV-1__GU131746__SS-prME
  source 1..9879: mol_type = other RNA
agcgtgaccatgctgctcatgcttatgcccacggccctggctttccacttgactacgagaggaggggaacctcatatgatcgtctccaagcaggaaaggggaaaatctttactgtttaagacctcagccggtgttaatatgtgcacattaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactgctcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaaaaagatgatccgccctcaacccatggagtacaaatattcgtggaaaagctggggcaaggccaaaataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatgattctctcaatcgttagcctgttccccttgtgtctgagtacgacatctcagaagaccacttggttaccggtgctcctgggctcccttgggtgcaagcctctgacaatgtttttgatagctgagaataaaatctggggaaggcgaagctggccactcaacgaaggtattatggccgtcggcatcgtatcgattctgctatcatctctgcttaagaacgatgtgcccctcgccgggcctctgatcgctggaggcatgttgatagcatgttacgttattagtggttccagcgccgacttatctctggagaaagcggctgaggtgagctgggaagaggaagccgagcattccggggcatcacacaatatcctcgtcgaagtgcaggatgacggaaccatgaagatcaaagatgaggagcgcgacgatactctgacaattcttctgaaggccaccttgctagctgtaagtggcgtgtatcccctgagcataccagcaacactcttcgtctggtacttctggcagaaaaagaagcagcggtctggcgttctgtgggacactccttcacccccagaagtggagagagccgtgcttgatgacgggatctataggattatgcagcgtggattactgggtcgcagccaggtcggcgtgggggtttttcaagaaaacgtattccataccatgtggcacgtgacacggggagcggtcctcatgtaccagggcaaaagattggagccgagttgggctagcgtgaagaaagacctgatctcctacggtgggggatggaggctccagggctcttggaataccggcgaggaagttcaggtgattgccgtcgagcctgggaagaaccccaaaaatgtgcaaacagcaccaggaacttttaagacccccgaaggtgaggtaggcgccatcgctctggatttcaagcctgggacgtcgggaagcccaatagtcaaccgagaaggcaaaatcgtgggtctttatgggaatggagttgtgacaacttcaggcacctacgtctccgccattgcacaggctaaggccagtcaggagggccccctgcctgagatcgaagacgaggtgtttcggaaacgcaacttgacaattatggatctacacccggggtctggaaagaccagaaggtatctgccagcgatcgttcgggaagccataaaacgaaagctcagaactttaattctggcacccacccgcgtggtcgctagcgagatggccgaagctcttaagggtatgcctatcaggtaccaaacaacggcagtgaaatccgagcatactggcaaggagatcgtagacctgatgtgccacgccaccttcacaatgcgtctcttgtcaccagtgcgggttcccaattataacatgattatcatggatgaagcccattttaccgacccttctagcatagctgcgagagggtacattagtactagggtcggaatgggcgaggcagccgctatcttcatgacagccaccccgcccggttccgtggaagcatttccacagagcaatgccgtgattcaggatgaggaacgcgacatccctgagcgatcttggaactcagggtatgagtggataacggatttccccggaaaaactgtctggtttgtaccatccattaagagtggcaatgacatcgctaactgtctgaggaaaaatggcaagcgggtgatccagctcagcaggaagacattcgataccgaataccagaaaaccaagaacaacgactgggactacgttgtgactacagatatttcggagatgggggcgaatttccgcgccgaccgtgtcatcgatcctagacggtgcctgaaacccgtgattcttaaggacggaccagaaagggttatactagcaggtccgatgcctgtgaccgtcgcttctgccgcacagcgccgaggcagaatcgggcggaaccacaataaagagggagatcagtatatttacatgggccagcccctgaacaatgacgaggatcatgcccactggacagaagctaagatgttgttagacaacatcaatactccagagggtatcattcccgccctgtttgaacctgagagggaaaagtccgcggcaatagatggggagtatcgcctcagaggcgaggccaggaaaacgttcgtggaactgatgcggcgtggagaccttccagtatggctgagctacaaggtggcttcagagggctttcaatatagtgatcgccgatggtgcttcgacggggaaagaaacaatcaggttctcgaggaaaacatggatgtcgagatctggaccaaagagggagaaaggaagaaattgcggccccgctggctggacgccagaacatactctgaccctctagctctgagggagtttaaggagttcgcagccggtcggcgatccgtgagcggcgatctcattcttgagatcgggaaactgccgcagcacttaactcagaaggctcaaaatgccttggacaacctggtgatgctccataattcagaacagggaggcagagcatatcgccacgcgatggaggagctgccagataccattgaaacacttatgctgctcgccttgatcgctgtcctgaccggtggggttactttatttttcctaagtggcaggggactgggcaagacgagcatagggctcctttgtgtgatggcctcctctgtactgttgtggatggcaagcgtggagccccattggatcgctgcctccattatcctggaatttttcctcatggtcctgcttattcctgagcccgaccggcagcgtaccccacaggataaccaactcgcatacgtggttatcggactgttgtttatgatactgacagtggccgctaatgagatgggtttactagaaactaccaaaaaggacctgggcattgggcacgtcgcggtagagaaccaccatcacgccgcaatgctcgatgtggaccttcatcctgcttcagcctggacactgtacgccgttgcaaccactatcattacacccatgatgagacacacgatcgaaaacaccactgctaatatatctttgacagccatcgcgaaccaggctgccattctgatgggactcgataaaggctggccaatcagtaagatggacattggtgtgcctctgcttgcattagggtgctattcgcaggtcaatccgctgaccctcaccgccgctgtgttgatgctggtcgcacattacgccatcataggccccggactacaagcgaaagctacaagggaggcccagaagcgcactgcagccggcattatgaagaacccaacggtggatgggatcgttgctatcgacctggatcctgtggtatatgacgccaaattcgaaaagcagctcggacagattatgcttctgatcttgtgtaccagccaaatactgctcatgcggacaacttgggcactgtgcgagtccattaccttagctacaggcccccttaccactctgtgggagggttctccagggaaattttggaatacgacaatcgccgtgtcaatggcgaacattttccgaggaagctacctcgccggcgcaggtctagctttctccctgatgaagagtttgggcgggggaagaaggggcaccggggcccagggagaaactctgggcgagaaatggaagcgccagctcaatcagctttctaagagcgaatttaacacctataaacggtcaggtatcatggaggtcgacagatccgaagcaaaggaggggctgaaacgtggagagacaactaagcacgctgttagtaggggcaccgccaaattgcggtggttcgtggaacgcaatctggtcaagcctgagggtaaggtgatagatctcggctgtgggcgaggaggctggagctactattgcgccgggctaaagaaggtaacagaagtgaaaggatacacgaagggcggtcccgggcacgaggaaccgatcccaatggcgacctacggatggaacctggttaaacttcattctggcaaggacgtgtttttcattcctcccgagaaatgtgatactctgctatgcgacatcggcgagtcctcaccaaatcccacaattgaagaggggagaaccctcagggtcctgaagatggtggaaccttggttgcggggaaaccaattttgtatcaagattctgaatccgtatatgcccagcgtcgtggagactctcgagcagatgcagcgcaaacacggtggcatgcttgttagaaacccactgtcgagaaattctacacatgaaatgtactgggtaagttgcgggaccggaaacatcgtgtccgctgtcaatatgacgagccgaatgttactgaaccggttcaccatggcacaccgtaagcctacatatgagagagatgtggacttgggcgccggtactcgccacgttgctgtggaacccgaggtcgccaacctcgatataattgggcagaggatcgaaaatatcaaacatgagcacaagtcaacctggcattacgacgaggataacccttataaaacatgggcataccacggatcctatgaagtgaagccatctggcagcgccagttccatggtaaatggcgtggttaagctgctaactaaaccctgggacgtcattcctatggtgacccaaatagctatgacagataccactccatttgggcagcagcgggtgttcaaggagaaagtcgacacgagaacacccaaggcgaaacgcggaaccgcccaaatcatggaagttactgcaaagtggctttggggttttctgagcaggaacaagaaaccgcgaatttgtacccgggaggagttcacaagaaaggtgaggtctaatgctgccatcggcgcagtatttgtggacgagaaccagtggaactcagccaaagaggctgtcgaagatgagcgcttctgggacctcgtgcatcgtgaacgggagctgcacaagcaggggaaatgcgccacgtgcgtttacaacatgatgggaaagagagaaaagaaattgggcgagtttggtaaggcgaaagggagtagggcaatttggtacatgtggctgggagcccgcttcctcgagttcgaagctcttggctttatgaatgaggatcactggttctcccgagaaaacagcctgtctggcgtggagggggagggattacataagctgggttatatcttgcgggacatatcgaaaatccctggcgggaatatgtacgccgatgacaccgcaggatgggatactagaattacagaagacgatctccagaacgaggctaggatcaccgacattatggaaccagagcacgccctgctagctaagtcaatctttaaacttacttatcaaaataaggtcgtgcgcgtacagagacccgccaagaacggcacagttatggatgtgataagccggagggaccagcgtggttccgggcaggtcggaacctacggcctgaatacattcactaacatggaagcacaactcattcgacagatggagagtgagggcatcttttctcctagcgaactggagaccccaaacttggcggaacgcgtgttagattggctggagaaatatggggtggaaagactcaagcggatggccatctccggagacgactgtgtcgttaaacccattgatgacaggttcgctacggcccttaccgcactgaatgatatgggtaaggtgcgcaaagacataccgcagtgggagccttcaaagggctggaacgattggcagcaagtacccttttgcagtcatcacttccaccagctaatcatgaaggacgggagagagattgtggtcccatgtcggaatcaggatgaactggtgggaagggctcgagtttctcagggcgccggttggagcctccgtgagacagcatgcttggggaaatcctacgcccaaatgtggcagctgatgtattttcatagacgcgaccttcggctggcggctaacgccatctgttcagcagtgcctgtcgattggattcccactagcaggaccacatggtctatccacgcccatcaccagtggatgactaccgaagacatgctctccgtgtggaatagagtatggatagaggaaaacccatggatggaggataagacgcatatcagtagctggggagacgttccctacttaggcaaacgcgaggaccaatggtgcggctcgctgattgggttgacagctcgggccacctgggcaactaatatccaggtggctattaaccaggtcaggcgactgatcggaaatgaaaactacctcgattatatgacatccatgaagagattcaaaaatgagtctgaccctgaaggtgccctttggtga

SEQ ID NO: 13921 - RNA, 9879 nt, synthetic construct
  misc_feature 1..9879: note = derived and/or modified CDS sequence (opt3) from DENV-1__JF937609__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaagacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaagcccctaccaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggatcgttcaaactggagaaggaagtggccgagacgcagcacggtacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgccagtgtggaactgccaaactccttagaggaactcggggatggactggctatgggcattatgatccttaaactgttgaccgacttccaatctcatcagctctgggcgactctgctaagcctgacctttattaagacaactttctcccttcactatgcctggaaaaccatggcaatggttctctcaatcgtgagcctgtttcccttgtgtctgagtacgacatctcagaagaccacttggttaccggtcctcctgggctcccttgggtgcaagcctctgacaatgttcttgatagctgagaataaaatctggggaaggcgaagctggccactcaacgaaggtattatggccgtaggcatcgtgtcgattctgctatcatctctgcttaagaacgatgttcccctcgccgggcctctgatcgctggaggcatgttgatagcatgttacgtgattagtggttccagcgccgacttatctctggagaaagcggctgaggtcagctgggaagaggaagccgagcattccggggcatcacacaatatcctcgtggaagtacaggatgacggaaccatgaagatcaaagatgaggagcgcgacgatactctgacaattcttctgaaggccaccttgctagctgtgagtggcgtctatcccctgagcataccagcaacgctctttgtttggtacttctggcagaaaaagaagcagcggtctggcgtgctgtgggacactccttcacccccagaagtggagagagccgtccttgatgacgggatctataggattatgcagcgtggattactgggtcgcagccaggtgggcgttggggtattccaagaaaacgtgtttcataccatgtggcacgtcacacggggagcggtgctcatgtaccagggcaaaagattggagccgagttgggctagcgttaagaaagacctgatctcctacggtgggggatggaggctccagggctcttggaataccggcgaggaagtgcaggtcattgccgtggagcctgggaagaaccccaaaaatgtacaaacaactccaggaaccttcaagacgcccgaaggtgaggtcggcgcaatcgccctggattttaagcctgggacatcgggaagcccaatagtgaaccgagaaggcaaaatcgttggtctttatgggaatggagtggtcactacctcaggcacatacgtgtccgctattgcccaggcaaaggctagtcaggagggccccctgcctgagatcgaagacgaggttttccggaaacgcaacttgaccattatggatctacacccggggtctggaaagactagaaggtatctgccagccatcgtgcgggaagcgataaaacgaaagctcagaaccttaattctggcccccacacgcgtcgtggcaagcgagatggctgaagcccttaagggtatgcctatcaggtaccaaacgactgctgtaaaatccgagcataccggcaaggagatcgtggacctgatgtgccacgcaacatttaccatgcgtctcttgtcaccagttcgggtccccaattataacatgattatcatggatgaagcccatttcactgacccttctagcatagccgctagagggtacattagtacaagggtgggaatgggcgaggcggcagccatctttatgaccgctacgccgcccggttccgtggaagccttcccacagagcaatgcagtcattcaggatgaggaacgcgacatccctgagcgatcttggaactcagggtatgagtggataactgattttcccggaaaaacagtatggttcgtgccatccattaagagtggcaatgacatcgccaactgtctgaggaaaaatggcaagcgggttatccagctcagcaggaagacctttgataccgaataccagaaaactaagaacaacgactgggactacgtggtcacaaccgatatttcggagatgggggctaatttccgcgcggaccgtgtgatcgatcctagacggtgcctgaaacccgttattcttaaggacggaccagaaagggtgatactagccggtccgatgcctgtcacagtggcatctgctgcccagcgccgaggcagaatcgggcggaaccacaataaagagggagatcagtatatttacatgggccagcccctgaacaatgacgaggatcatgcacactggactgaagccaagatgttgttagacaacatcaatacgccagagggtatcattcccgctctgttcgaacctgagagggaaaagtccgccgcgatagatggggagtatcgcctcagaggcgaggcaaggaaaacctttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacaaaagagggagaaaggaagaaattgcggccccgctggctggacgctagaacttactctgaccctctagccctgagggagttcaaggaatttgctgcaggtcggcgatccgtgagcggcgatctcattcttgagatcgggaaactgccgcagcacttaacccagagagcccaaaatgctttggacaacctggtcatgctccataattcagaacagggaggccgcgcctataggcacgcaatggaggagctgccagatacaattgaaacccttatgctgctcgcgttgatcgccgttctgactggtggggtgacgttattctttctaagtggccggggactgggcaagaccagcatagggctcctttgtgtaatggcttcctctgtgctgttgtggatggccagcgtcgagccccattggatcgcagcttccattatcctggagttctttctcatggtgctgcttattcctgagcccgaccgtcagagaacaccacaggataaccaactcgcctacgttgtgatcggactgttgttcatgatactgactgtcgcagccaatgagatgggtttactagaaaccacaaagaaagacctgggcattgggcacgtagctgtgggaaaccaccatcacgcggccatgctcgatgttgaccttcatcctgcatcagcttggaccctgtacgccgtggccactacaatcattacgcccatgatgaggcacaccatcgagaacactacagcaaatatatctttgaccgctatcgccaaccaggcggctattctgatgggcctcgataagggttggccaatcagtaaaatggacattggggtccctctgcttgccttaggctgctatagccaggtgaatccgctgaccctcacagcagccgtcttgatgctggtggctcattacgcaatcataggacccggcctacaagccaaggcgactcgcgaagctcagaaacggacggccgcagggattatgaagaacccaaccgttgatggaatcgtggccatcgacctggatcctgtagtgtatgacgctaagtttgagaaacagctcggccagattatgcttctgatcttgtgtacaagccaaatactgctcatgcgaactacctgggccctgtgcgaatccattacattagcaaccggtccccttactacgctgtgggaggggtctccaggaaagttctggaatacaaccatcgctgtctcaatggccaacatttttagaggcagctacctcgcgggtgccggcctagcattctccctgatgaaaagtctagggggaggcaggcgcgggactggagctcagggcgagaccctgggtgaaaagtggaaacggcagctcaatcagctttctaagagcgagttcaacacatataagagatcagggatcatggaagttgaccgttccgaggccaaagaaggactgaagaggggcgagactaccaaacacgcagtgagtcggggtacagctaagttgcgctggtttgtcgagcgaaatctggtgaaacctgaaggcaaggtaatagatctcgggtgtggaagaggcgggtggagctactattgcgccggattaaagaaagtgacggaggttaagggctacaccaaaggtgggcccggacacgaagaaccgatcccaatggccacttacggctggaacctggtgaaacttcattctggcaaagacgtcttctttattcctcccgaaaagtgtgatacactgctatgcgacatcggggagtcctcaccaaatcccaccattgaggaaggaaggactctccgggtgctgaaaatggtcgagccttggttgcgcggtaaccaattctgtatcaagattctgaatccgtatatgcccagcgtggttgaaacactcgagcagatgcagagaaagcacggcgggatgcttgtaaggaacccactgtcgcgaaattctacccatgagatgtactgggtgagttgcggaacgggcaacatcgtctccgcggtgaatatgaccagccggatgttactgaaccgttttacaatggctcacagaaaacctacttatgaacgcgatgttgacttgggtgcagggaccaggcacgtggccgtcgagcccgaagtggctaacctcgatataattggacagcggatcgagaatatcaagcatgaacacaaatcaacatggcattacgacgaggataacccttataagacttgggcctaccacggctcctatgaggtaaaaccatctggcagcgcaagttccatggtgaatggggttgtcaagctgctaaccaagccctgggacgtgattcctatggtgacacaaatagccatgaccgatactacgccattcggacagcagagagtctttaaagaaaaggttgacacacgcacccccaaagctaagaggggtactgcgcaaatcatggaggtgaccgccaaatggctttggggcttcctgagccgaaacaagaagccgcggatttgtacaagagaagagtttacgaggaaagtacgctctaatgcagctatcggggccgtgttcgtcgacgaaaaccagtggaactcagcaaaggaggccgtggaggatgaacgtttttgggacctcgttcatcgggagagagaactgcacaaacagggaaagtgcgctacctgcgtgtacaacatgatgggcaaaagggagaagaagttgggtgagttcgggaaagccaagggaagtcgcgcgatttggtacatgtggctgggcgcacgatttctcgagttcgaggcccttggcttcatgaatgaagatcactggttttcccgggagaacagcctgtctggggtcgaaggagagggtttacataaactgggctatatcttgagagacatatcgaagatccctgggggaaatatgtacgctgatgacactgccggctgggatacaaggattaccgaggacgatctccagaacgaagcacgcatcactgacattatggagccagaacacgctctgctagccagatcaatcttcaaacttacatatcaaaataaggtggtacgggttcagaggcccgctaaaaacggtaccgtgatggatgtcataagccgtcgagaccagcgcgggtccggacaggtgggcacatacggcctgaatacttttaccaacatggaggcccaactcattagacagatggaaagtgaggggatcttctctcctagcgagctggaaacgccaaacttggcagagcgggtgttagattggctggaaaagtatggagtcgagaggctcaagcgcatggcgatctccggtgacgactgtgttgtgaaacccattgatgacagatttgccaccgctcttacagccctgaatgatatgggcaaggtacggaaagacataccgcagtgggaaccttcaaaggggtggaacgattggcagcaagtgcccttctgcagtcatcactttcaccagctaatcatgaaagacggaagggagattgtcgtgccatgtcgaaatcaggatgagctggttggccgtgcaagagtgtctcagggtgctgggtggagcctccgcgaaactgcctgcttgggaaagtcctacgcacaaatgtggcagctgatgtatttccatcggagggaccttagactggccgcgaacgctatctgttcagccgtccctgtggattggattcccaccagccgcacaacttggtctatccacgcacatcaccagtggatgaccacggaggacatgctctccgtatggaatcgggtttggatagaagagaacccatggatggaagataagacacatatcagtagctggggcgacgtgccctacttaggcaaaagggaggaccaatggtgcgggtcgctgattggattgaccgcccgagctacttgggccacaaatatccaggtcgcaattaaccaggtgagacggctgatcggtaatgagaactacctcgattatatgacctccatgaagaggtttaaaaatgaatctgaccctgagggcgctctttggtga

SEQ ID NO: 13922 - RNA, 9879 nt, synthetic construct
  misc_feature 1..9879: note = derived and/or modified CDS sequence (opt3) from DENV-1__KF921949__SS-prME
  source 1..9879: mol_type = other RNA
agcgtgaccatgctgctcatgcttatgcccaccgccctggctttccacttgactacgcggggcggggaacctcatatgatcgtctccaagcaggaaaggggaaagtctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcagaaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttaccgggattctggcacagggaaagaaaatgatcagacctcaacccatggagtacaagtattcgtggaaaagctggggcaaggctaagataatcggggccgacgtgcagaatacaacttttattatcgatggaccaaacacccctgaatgtcccgacgatcagagggcgtggaatatttgggaggtcgaggactacggcttcggtatctttacaacgaacatatggcttaaattgcgtgattcctatacccaggtgtgcgaccaccggctcatgtcagccgctattaaggatagtaaagcagttcacgccgacatggggtactggatcgaatctgagaagaatgaaacttggaaactggctcgagccagcttcattgaggtgaagacatgtatctggccaaagtcccataccctatggtcaaacggagtactggaaagcgagatgataatccccaaaatttatggcggtcctatctctcaacacaattacagaccaggctacttcactcagacagcagggccgtggcatctcggaaagctggagcttgattttgacttgtgcgaaggcaccacggtcgtggtggatgagcactgcgggaacaggggaccctccctgcgcactaccacagtcaccggcaaaattatccacgaatggtgttgccggagttgtactttacctccactcagattcaggggtgaggacgggtgctggtatggaatggagatacgccccgttaaggaaaaagaggaaaatctggtgaagtccatggtatctgcgggctccggtgaggtggactcatttagtcttggcctgttgtgtattagcatcatgatcgaagaggtcatgcgatcgcggtggtcccgtaagatgctcatgacagggaccctggccgtgttcctactgctcattatgggacagctgacatggaacgatcttatcagattgtgcattatggttggcgctaatgcctctgacaggatggggatgggaactacctacctggcattaatggctacgtttaaaatgcgccctatgttcgccgtgggcctcctgtttcggagacttacaagcagggaggtcctgctactcaccataggtctgtcattggtggcaagtgttgaactgccaaactccttagaggaactcggggatggactggccatgggcatcatgattcttaagctgttgactgacttccaatctcatcagctctgggctaccctgctaagcctgacatttatcaaaactaccttctcccttcactatgcgtggaagacgatggccatggtgctctcaattgtcagcctgtttcccttgtgtctgagtacaacctctcagaaaactacatggttaccggtactcctgggctcccttgggtgcaagcctctgaccatgttcttgatcgcagagaataagatatggggacgacgcagctggccactcaacgaaggtatcatggctgtgggcattgtttcgatcctgctatcatctctgcttaaaaacgatgtgcccctcgccgggcctctgattgccggaggcatgttgatcgcttgttacgtcataagtggttccagcgcagacttatctctggagaaggccgcggaggtgagctgggaagaggaagctgagcattccggggcctcacacaatattctcgtagaagtgcaggatgacggaactatgaaaatcaaggatgaggagcgggacgatacactgaccatccttctgaaagcaacgttgctagccgtcagtggcgtttatcccctgagcattccagctactctctttgtgtggtacttctggcaaaagaaaaagcagagatctggcgtgctgtgggacaccccttcacccccagaagtcgagagggcagtgcttgatgacgggatatatcgtatcatgcagcgcggattactgggtcggagccaggttggcgtaggggtgttccaagaaaacgtctttcatacaatgtggcacgtgaccagaggagccgttctcatgtaccagggcaagaggttggagccgagttgggcgagcgtgaaaaaggacctgatttcctacggtgggggatggcgactccagggctcttggaatacaggcgaggaagtccaggtgatcgctgtagagcctgggaaaaaccccaagaatgtccaaactgccccaggaaccttcaaaacgcccgaaggtgaggtgggcgcaattgccctggattttaagcctgggacatcgggaagcccaatcgttaaccgggaaggcaagatagtgggtctttatgggaatggagtcgtgactacctcaggcacatacgtttccgctatcgcccaggcaaaagctagtcaggagggccccctgcctgagattgaagacgaggtgttccgcaagagaaacttgaccatcatggatctacacccggggtctggaaaaactaggcggtatctgccagccattgtccgagaagcgatcaagagaaaactccgcaccttaatactggcccccacaagggtggtagcaagcgagatggctgaagcccttaagggtatgcctattcgttaccaaacgactgctgtgaagtccgagcataccggcaaagagatcgttgacctgatgtgccacgcaacatttaccatgcggctcttgtcaccagtcagagtgcccaattataacatgatcattatggatgaagcccatttcactgacccttctagcatcgccgctagggggtacataagtacacgcgtgggaatgggcgaggcggcagccatttttatgaccgctacgccgcccggttccgtcgaagccttcccacagagcaatgcagtaatccaggatgaggaacgagacattcctgagagatcttggaactcagggtatgagtggatcactgattttcccggaaagacagtgtggttcgttccatccataaaaagtggcaatgacattgccaactgtctgcggaagaatggcaaaagggtgatccagctcagccgcaagacctttgataccgaataccaaaagactaaaaacaacgactgggactacgtcgtgacaaccgatatctcggagatgggggctaatttccgtgcggacagagttattgatcctcggaggtgcctgaagcccgtgatccttaaagacggaccagaacgcgtcattctagccggtccgatgcctgtgacagtagcatctgctgcccagcgaagaggccggatagggaggaaccacaataaggagggagatcagtatatctacatgggccagcccctgaacaatgacgaggatcatgcacactggactgaagccaaaatgttgttagacaacattaatacgccagagggtatcatccccgctctgttcgaacctgagcgcgaaaagtccgccgcgattgatggggagtatagactcaggggcgaggcacggaagacctttgtggaactgatgcgtcgcggagaccttccagtttggctgagctacaaagtcgcctcagagggcttccaatatagtgatcgaagatggtgctttgacggggaaaggaacaatcaggtgctcgaggaaaacatggatgtggagatatggacaaaggagggagaacggaaaaagttgcgccccagatggctggacgctaggacttactctgaccctctagccctgcgggagttcaaagaatttgctgcaggtcgaagatccgtcagcggcgatctcatccttgagattgggaagctgccgcagcacttaacccagcgcgcccaaaatgctttggacaacctggttatgctccataattcagaacagggaggcagggcctatcggcacgcaatggaggagctgccagatacaatcgaaacccttatgctgctcgcgttgattgccgtgctgactggtggggtaacgttattctttctaagtggccgtggactgggcaaaaccagcatcgggctcctttgtgtgatggcttcctctgtcctgttgtggatggccagcgtggagccccattggatagcagcttccatcattctggagttctttctcatggttctgcttatccctgagcccgacagacagaggacaccacaggataaccaactcgcctacgtggtcattggactgttgttcatgatcctgactgtagcagccaatgagatgggtttactagaaaccacaaagaaggacctgggcatagggcacgtggctgttgagaaccaccatcacgcggccatgctcgatgtggaccttcatcctgcatcagcttggaccctgtacgccgtcgccactacaattatcacgcccatgatgcgccacaccattgaaaacactacagcaaatatctctttgaccgctatagccaaccaggcggctatcctgatgggactcgataaaggctggccaattagtaagatggacatcggtgtgcctctgcttgccttagggtgctattcgcaggtcaatccgctgaccctcacagcagccgtgttgatgctggttgctcattacgcaattatcggccccggactacaagccaaagcgactcgggaggctcagaagcgaacggccgcaggcataatgaaaaacccaaccgtggatgggattgtagccatcgacctggatcctgtggtctatgacgctaagtttgaaaagcagctcggacagatcatgcttctgattttgtgtacaagccaaatcctgctcatgagaactacctgggccctgtgcgagtccataacattagcaaccggcccccttactacgctgtgggagggttctccagggaaattctggaatacaaccattgctgtttcaatggccaacatctttaggggaagctacctcgcgggcgccggtctagcattctccctgatgaagagtttgggcgggggacgccggggcactggggctcagggagaaaccctgggcgagaaatggaagagacagctcaatcagctttctaaaagcgagttcaacacatataagcgttcaggtattatggaggtggacaggtccgaagccaaggaggggctgaaacggggagagactaccaagcacgcagtcagtcgcggcacagctaaattgcgatggtttgtggaaagaaatctggtaaagcctgagggtaaagtgatcgatctcggctgtgggaggggaggctggagctactattgcgccgggttaaagaaggttacggaagtgaaaggatacaccaagggcggtcccgggcacgaggaaccgataccaatggccacttacggatggaacctggtcaaacttcattctggcaaggacgtgttctttatccctcccgagaaatgtgatacactgctatgcgacattggcgagtcctcaccaaatcccaccatcgaagaggggcggactctccgcgtcctgaagatggtggaaccttggttgagaggaaaccaattctgtattaaaatcctgaatccgtatatgcccagcgttgtagagacactcgagcagatgcagaggaagcacggtggcatgcttgtgcgaaacccactgtcgagaaattctacccatgaaatgtactgggtcagttgcgggacgggaaacattgtgtccgcggttaatatgaccagccgtatgttactgaacagatttacaatggctcaccgcaagcctacttatgagagggatgtggacttgggcgcaggtacccggcacgtcgccgtggaacccgaggtagctaacctcgatatcatagggcagagaattgaaaatatcaaacatgagcacaagtcaacatggcattacgacgaggataacccttataaaacttgggcctaccacggatcctatgaagtgaagccatctggcagcgcaagttccatggttaatggcgtcgtgaaactgctaaccaagccctgggacgtgatccctatggtcacacaaattgccatgaccgatactacgccattcgggcagcagcgcgtttttaaggagaaagtggacacaaggacccccaaggctaaacgaggaactgcgcaaataatggaagtaaccgccaagtggctttggggtttcctgagccggaacaaaaagccgagaatctgtacaagggaggaatttacgaagaaagtgcgctctaatgcagctattggcgccgtcttcgtggacgagaaccagtggaactcagcaaaggaggccgttgaagatgagcgtttttgggacctcgtgcatcgggaaagagagctgcacaaacaggggaagtgcgctacctgcgtctacaacatgatgggaaaaagggaaaagaagttgggcgagttcggtaaagccaaggggagtcgcgcgatctggtacatgtggctgggagcacgatttctcgagttcgaagcccttggcttcatgaatgaggatcactggttttcccgggaaaacagcctgtctggcgtggagggggagggattacataaactgggttatattttgagagacatctcgaagatacctggcgggaatatgtacgctgatgacactgccggatgggatacaaggatcaccgaagacgatctccagaacgaggcacgcattactgacatcatggaaccagagcacgctctgctagccaaatcaattttcaaacttacatatcaaaataaagtagttagagtgcagcggcccgctaagaacggcaccgtcatggatgtgatcagcaggcgtgaccagcgaggttccggacaggtgggaacatacggcctgaatacttttaccaacatggaagcccaactcatacgccagatggagagtgagggcattttctctcctagcgaactggagacgccaaacttggcagaaagagtcttagattggctggagaagtatggggttgaacggctcaaaaggatggcgatctccggagacgactgtgtggtaaagcccatcgatgaccgctttgccaccgctcttacagccctgaatgatatgggtaaagtgagaaaggacattccgcagtgggagccttcaaaaggctggaacgattggcagcaagtccccttctgcagtcatcactttcaccagctaataatgaaggacgggcgggagatcgtggttccatgtaggaatcaggatgaactggtgggacgagcacgtgtctctcagggcgctggttggagcctcagagagactgcctgcttggggaagtcctacgcacaaatgtggcagctgatgtatttccatcgccgggaccttaggctggccgcgaacgctatttgttcagccgtgcctgtagattggatccccaccagcagaacaacttggtctattcacgcacatcaccagtggatgaccacggaagacatgctctccgtttggaatcgcgtgtggatcgaggaaaacccatggatggaggataaaacacatataagtagctggggagacgtcccctacttaggcaagcgggaggaccaatggtgcggctcgctgatcgggttgaccgccagggctacttgggccacaaatattcaggtggcaatcaaccaggttcgaagactgattggaaatgaaaactacctcgattatatgacctccatgaaacggtttaagaatgagtctgaccctgaaggtgctctttggtga

SEQ ID NO: 13923 - RNA, 9879 nt, synthetic construct
  misc_feature 1..9879: note = derived and/or modified CDS sequence (opt3) from DENV-1__GU131747__SS-prME
  source 1..9879: mol_type = other RNA
tccgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacgctaattgccatggacctcggcgaactgtgtgaagatactatgacctacaaatgcccacggataacagaaaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgcagggaaactggttcatcagattttcggaaccgcgtacggcgtgttgttttctggtgtcagctggactatgaagatagggatcggcgtgctcctgacatggttaggactaaattcacgaagtacctccctaagcatgacatgtattgctgtaggcctcgtgactctgtaccttggggttatggtccaggccgattctggatgcgtgatcaactggaaaggccgcgaattgaagtgtggttcagggatcttcgtgaccaatgaggtccacacgtggacagaacaatataagtttcaggcagacagtccgaaaagactgagcgccgctattggaaaggcctgggaggagggcgtttgcggtataaggtccgcaacccggctcgaaaacatcatgtggaaacagatttctaacgagctgaatcatatcttactggaaaacgacatgaagttcactgtggtggtaggcgatgtcgctgggattcttgcccagggcaagaagatgatccgccctcaacccatggagtacaaatattcgtggaaaagctggggcaaggcgaagataatcggggccgacgtgcagaataccacatttattatcgatggaccaaacactcctgaatgtcccgacgatcagagagcttggaatatttgggaggttgaggactacggcttcggtatctttaccacaaacatatggttgaagctcagggattcctatacacaggtgtgcgaccaccgtctgatgtcagcagccattaaagatagtcgggctgtccacgccgacatggggtactggatcgaatctgagaagaatgaaacctggaaactagcacgagcgagcttcattgaggtgaagacttgtatctggccaaagtcccatacactgtggtcaaacggagttctcgaaagcgagatgataatccccaaaatttatggcggtcctatctctcaacacaattacagaccaggctacttcacccagactgccgggccgtggcatctgggaaaacttgagttggattttgacctgtgcgaaggcacaaccgtggtagtcgatgagcactgcgggaacaggggaccctccttacgcacgactaccgtgacaggcaaaattatccacgaatggtgttgccggagttgtaccctccctccactgagattcaggggtgaggacgggtgctggtatggaatggagatacgccccgtgaaggaaaaagaggaaaatcttgtcaagagcatggtttctgctggctccggtgaggtggactcatttagtctgggcttgctctgtattagcatcatgatcgaagaggtaatgcgatcgcggtggtcccgtaagatgctgatgactgggacactagccgtgttctttctgctcattatgggacagctgacctggaacgatcttatcagattgtgcattatggtcggcgcaaatgcttctgacaggatggggatgggaacaacttacctggccttaatggcaaccttcaaaatgcgccctatgtttgccgtgggcctcctgttccggagacttacgagcagggaggttctgctactcacaataggtctgtcattggtggctagtgtcgaactgccaaactccttagaggaactcggggatggactggcgatgggcatcatgattcttaagctgttgaccgactttcaatctcatcagctctgggccactctgctaagcctgaccttcatcaaaacaactttttcccttcactatgcatggaagaccatggctatggtgctctcaattgttagcctgttccccttgtgtctgagtacgacatctcagaaaaccacttggttaccggtgtttctcggctccctggggtgcaagcctcttacaatgttcctgatcgccgagaataagatatggggacgacgcagctggccattgaacgaaggtatcatggccgtcggcattgtatcgatcctcctgtcatctctactgaaaaacgatgtgccccttgctgggcctctcattgcaggaggcatgctgatcgcctgttacgttataagtggttccagcgcggacttgtctttagagaaggctgccgaggtgagctgggaagaggaagcagagcattccggggcctcacacaatattctggtcgaagtgcaggatgacggaaccatgaaaatcaaggatgaggagcgggacgatactctcacagtactgcttaaagctaccctgttggcagtgagtggcgtctatcccctaagcatcccagccacgctgttcgtttggtacttttggcaaaagaaaaagcagagatctggcgtgctctgggacactccttcacccccagaagtggagagggcggtcctggatgacgggatttatcgtataatgcagcgcggacttttaggtcggagccaggtgggcgttggggtattccaagaaaacgtgtttcataccatgtggcacgtcacaagaggagctgtgctgatgtaccagggcaagaggctcgagccgagttgggccagcgttaaaaaggacttgatctcctacggtgggggatggcgactgcagggctcttggaataccggcgaggaagtgcaggtcattgcagtggagcctgggaaaaaccccaagaatgtacaaacagccccaggaactttcaaaacccccgaaggtgaggtcggcgctatcgccctcgattttaagcctgggacgtcgggaagcccaattgtgaaccgggaaggcaagatcgttggtctgtatgggaatggagtggtcacaacttcaggcacctacgtgtccgcaatagctcaggccaaagcgagtcaggagggcccccttcctgagatcgaagacgaggttttccgcaagagaaacctgacaattatggatttgcacccggggtctggaaaaaccaggcggtatctaccagccatcgtgcgagaagcaattaagagaaaactgcgcactctcatcttagctcccaccagggtcgtggccagcgagatggctgaagcactgaagggtatgcctatacgttaccaaacaacggccgtaaagtccgagcatactggcaaagagattgtggaccttatgtgccacgccacctttacaatgcggctgctctcaccagttagagtccccaattataacatgatcatcatggatgaagctcatttcaccgacccttctagcattgcggcaagggggtacatcagtactcgcgtgggaatgggcgaggccgctgccatatttatgacagcaaccccgcccggttccgtggaagccttcccacagagcaatgctgtcattcaggatgaggaacgagacatccctgagagatcttggaactcagggtatgagtggattacggattttcccggaaagactgtatggttcgtgccatccatcaaaagtggcaatgacatagcgaactgtttgcggaagaatggcaaaagggttattcagctgagccgcaagacattcgataccgaataccaaaagaccaaaaacaacgactgggactacgtggtcactacagatatctcggagatgggggccaattttcgtgcagacagagtgatcgatcctcggaggtgcctcaagcccgttattctgaaagacggaccagaacgcgtgatccttgctggtccgatgcctgtcaccgtggcctctgcagcccagcgaagaggccggattgggaggaaccacaataaggagggagatcagtatatatacatgggccagcccctaaacaatgacgaggatcatgctcactggacagaagccaaaatgctgttggacaacatcaatactccagagggtattatccccgcgttattcgaacctgagcgcgaaaagtccgcagccatcgatggggagtatagactgaggggcgaggctcggaagacgtttgtagaactcatgcgtcgcggagacctgccagtgtggcttagctacaaagttgcctcagagggcttccaatatagtgatcgaagatggtgctttgacggggaaaggaacaatcaggtcctggaggaaaacatggatgtggagatttggaccaaggagggagaacggaaaaagctccgccccagatggttggacgctaggacatactctgaccctctggcactacgggagttcaaagaatttgccgctggtcgaagatccgtgagcggcgatctgatactcgagatcgggaaacttccgcagcacctgactcagcgcgcccaaaatgcattagacaacttggtcatgctgcataattcagaacagggaggcagggcgtatcggcacgccatggaggagctcccagataccattgaaacactgatgcttctggctctcatcgccgttttgaccggtggggtgactctgttctttttaagtggccgtggactaggcaaaacgagcattgggctgctctgtgtaatggcatcctctgtgcttctgtggatggctagcgtcgagccccattggatcgccgcatccataatcttggagttctttctgatggtgctcctgattcctgagcccgacagacagaggaccccacaggataaccaacttgcctacgttgtgatcggactcctgttcatgattttgacagtcgctgcgaatgagatgggtctgttagaaactaccaagaaggacctaggcatcgggcacgtagccgtggagaaccaccatcacgcagctatgctggatgttgacctccatcctgcctcagcctggacactttacgcagtggctaccactataattacacccatgatgcgccacacgatcgaaaacaccactgccaatatttctctgacagcgatcgctaaccaggccgcaatattgatgggactggataaaggctggccaatcagtaagatggacattggtgtccctctcctggcccttgggtgctatagccaggtgaatccgttaaccctgaccgctgcagtcctcatgttggtggcccattacgcgatcattggccccggactgcaagctaaagccacacgggaggcacagaagcgaactgccgctggcatcatgaaaaacccaacggttgatgggatagtggccattgacctagatcctgtagtgtatgacgcaaagtttgaaaagcagctgggacagatcatgctccttatcctgtgtaccagccaaattttgctgatgagaacaacttgggctctctgcgagtccatcaccctggccacaggccccttaaccactctttgggagggttctccagggaaattctggaatacgacaatagcggtctcaatggccaacattttcaggggaagctacctggcaggcgctggtctcgccttttccctaatgaagagtctgggcgggggacgccggggcaccggggcacagggagaaactttgggcgagaaatggaagagacagctgaatcagctctctaaaagcgagttcaacacctataagcgttcaggtatcatggaggttgacaggtccgaagctaaggaggggcttaaacggggagagacaactaagcacgccgtgagtcgcggcaccgccaaactgcgatggtttgtcgaaagaaatttggtgaagcctgagggtaaagtaattgatctgggctgtgggaggggaggctggagctactattgcgcggggctcaagaaggtgacagaagttaaaggatacacgaagggcggtcccgggcacgaggaaccgatcccaatggctacctacggatggaacttagtgaaactgcattctggcaaggacgtcttctttatacctcccgagaaatgtgatactcttctgtgcgacatcggcgagtcctcaccaaatcccacaattgaagaggggcggaccctacgcgtgctcaagatggtcgaaccttggctgagaggaaaccaattctgtatcaaaattttgaatccgtatatgcccagcgtggttgagactctggagcagatgcagaggaagcacggtggcatgctcgtacgaaacccactttcgagaaattctacacatgaaatgtactgggtgagttgcgggaccggaaacatcgtctccgcagtgaatatgacgagccgtatgctgttaaacagatttaccatggcccaccgcaagcctacatatgagagggatgttgacctgggcgctggtactcggcacgtggccgtcgaacccgaggtggcaaacttggatattatcgggcagagaatagaaaatattaaacatgagcacaagtcaacctggcattacgacgaggataacccttataaaacatgggcctaccacggatcctatgaagtaaagccatctggcagcgctagttccatggtgaatggcgttgtcaaactcctgactaagccctgggacgtgatccctatggtgacccaaatcgcgatgacagataccactccattcgggcagcagcgcgtctttaaggagaaagttgacacgaggacacccaaggccaaacgaggaaccgcacaaattatggaagtgactgctaagtggctatggggtttccttagccggaacaaaaagccgagaatatgtaccagggaggaatttacacgcaaggtacgttctaatgccgcaatcggcgccgtgttcgtcgacgagaaccagtggaactcagctaaagaggccgtggaagatgagcggttttgggacctggttcatagagaaagggagctccacaagcaggggaaatgcgcgacgtgcgtgtacaacatgatgggaaagcgcgagaagaagctgggcgagttcggtaaggcaaaagggagtcgagccatttggtacatgtggttgggagctcggttcctggagtttgaagccctcggcttcatgaatgaggatcactggttttccagagaaaacagcctttctggcgtcgagggggagggactgcataagttaggttatatcctgagggacatttcgaaaatccctggcgggaatatgtacgcagatgacaccgctggatgggatactcgcataacagaagacgatttgcagaacgaggccagaatcaccgacattatggaaccagagcacgctctcctggccaagtcaatcttcaaactaacttatcaaaataaggtggtacgggttcagaggcccgccaaaaatggcacagtgatggatgtcattagccgtcgagaccagcgcggttccggacaggtgggaacctacggccttaatacatttactaacatggaagcgcaactgatcagacagatggagagtgagggcatattctctcctagcgaactcgagaccccaaacctggccgaacgggtgttggattggttagagaagcatggggtcgaaaggctgaagcgcatggctatttccggagacgactgtgttgtgaaacccatcgatgacagatttgccacggcactcaccgctcttaatgatatgggtaaggtacggaaagacatcccgcagtgggagccttcaaagggctggaacgattggcagcaagtgcccttctgcagtcaccactttcatcagctgattatgaaagacgggagggagatagtcgtgccatgtcgaaatcaggatgagctggttggacgtgccagagtgtctcagggcgcaggttggagcctgcgcgagacagcctgcctcgggaagtcctatgcgcaaatgtggcagttgatgtacttccaccggagggacctgagacttgctgccaacgcaatctgttcagccgtccctgtggattggattcccactagccgcaccacatggtctatccatgctcaccatcagtggatgactaccgaagacatgctgtccgtatggaatcgggtttggattgaggaaaacccatggatggaggataagacgcacatcagtagctggggagacgtgccctatctcggcaaaagggaggaccaatggtgcggctcgttaatagggctgacagcccgagcaacctgggctactaatatccaggtcgccattaaccaggtgagacggttgatcggaaatgaaaactacctggattacatgacatccatgaagaggtttaaaaatgagtctgaccctgaaggtgcgctctggtga

SEQ ID NO: 13924 - RNA, 9879 nt, synthetic construct
  misc_feature 1..9879: note = derived and/or modified CDS sequence (opt3) from DENV-1__GU131748__SS-prME
  source 1..9879: mol_type = other RNA
agcgtgaccatgctgttcatgctcgtccccacagcccttgcttttcacctgactacgagaggaggggaacctcatatgatcgtttccaagcaggaaagaggaaaatctttgttattcaagacctcagccggtgtgaatatgtgcacactgattgccatggacctgggcgaactctgtgaagatactatgacctacaaatgcccacggataacagagaccgaaccggacgatgtagactgttggtgcaatgcgactgatacatgggtgacctatgggacgtgtagtcaaactggagagcaccgccgagacaagcgtagcgtcgctctggcaccccatgtgggccttggtctggagaccagaacagaaacttggatgtcctctgagggggcatggaaacagatccagagggttgaaacctgggccttgcggcaccctggatttacagtgattgctctcttcctggcacatgccatcggcacctcgattacgcagaagggcatcatatttatcctgctcatgttagtcactccatcaatggctatgcgctgcgtggggattggaagcagagatttcgttgagggtctgagtggcgccacatgggttgacgtggtccttgagcacgggtcctgtgtgaccactatggcgaaggataaacccacattggacatcgaactgctaaagaccgaggtgacgaaccctgcagtcctcaggaaactgtgcattgaagccaagatctctaataccacaactgatagccggtgtccaacccaaggagaggctacacttgttgaagaacaagacgccaactttgtgtgccgccgaactttcgtagatagaggctggggtaatgggtgtggactgtttggcaaaggctccttgataacctgcgcaaagttcaagtgcgtgacaaaactcgaggggaagattgtccagtacgaaaacctgaaatattcagtgatcgttaccgtgcacactggagaccagcatcaagtcggtaatgagagtacggaacacggcacaaccgctactattacaccccaagcccctaccaccgagatccagttaactgactacggggcgctgacactcgattgtagcccaaggacgggacttgactttaacgaaatggtgctgttgaccatgaaggagaaatcttggctagtacataagcagtggttcctggatctcccgctgccctggacttccggcgcctcaacaagccaagagacctggaatcggcaggaccttctggttacatttaaaactgcacacgctaagaagcaggaagtggtcgtgttgggtagtcaagagggggccatgcacaccgctctcacgggcgccaccgaaatccagacatctggaactaccacaattttcgcaggccatctgaaatgccgtttaaagatggataaactgactctaaaggggatgtcctatgtcatgtgtaccggatcgttcaaactcgagaaggaagtggccgagacgcagcacggtacagttctggtgcagataaagtacgagggcaccgacgctccttgcaaaatcccattttcgactcaagatgaaaagggggtaacacagaacggacgccttattaccgcgaatcccatcgtcactgacaaagagaagcctgtgaacatagaagcagagccacccttcggcgagtcttatattgttatcggtgccggggaaaaggctttgaagctgtcctggtttaagaaaggctcaagtatcggaaagatgttcgaggccaccgcaagaggcgccaggcggatggctattctcggggatacagcctgggactttggaagcatcggtggcgtgttcacgtccgtcgggaaactggtgcatcagatttttggaaccgcatacggcgtacttttctctggtgtgagctggactatgaagatagggatcggcgttctgttgacatggctcggactaaattcacgaagtacctccttaagcatgacatgtattgcggtcggcctggtgactctatacctcggggtgatggtccaggctgattctggatgcgttatcaactggaaaggccgcgaactgaagtgtggttcagggatctttgtgaccaatgaggtgcacacgtggacagaacaatataagttccaggccgacagtccgaaaagacttagcgcagccattggaaaggcttgggaggagggcgtatgcggtataaggtccgccacccggttggaaaacatcatgtggaaacagatttctaacgagctgaatcatatcctcctggaaaacgacatgaagtttactgtcgtggttggcgatgtggcagggattttagctcagggcaagaaaatgatccgccctcaacccatggagtacaaatattcgtggaaaagctggggcaaggccaagataatcggggcggacgtccagaataccacattcattatcgatggaccaaacactcctgaatgtcccgacgatcagagagcctggaatatttgggaggtggaggactacggctttggtatcttcaccacaaacatatggctgaaacttagggattcctatacgcaggtttgcgaccaccgtttgatgtcagctgcaattaaagatagtaaggccgtgcacgctgacatggggtactggatcgaatctgagaaaaatgaaacctggaagctcgcccgggcatccttcattgaggtaaagacttgtatctggccaaaatcccatacactgtggtcaaacggagtcctagaaagcgagatgataatccccaagatttatggcggtcctatctctcaacacaattaccgaccaggctactttacccagactgcggggccgtggcatctgggaaaactcgagctggatttcgacctttgcgaaggcacaaccgtggtggtcgatgagcactgcgggaacagaggaccctccttgaggacgactaccgttacaggcaagattatccacgaatggtgttgccgcagttgtaccctgcctccattacggtttagaggtgaggacgggtgctggtatggaatggagataaggcccgtgaaagaaaaggaggaaaatctcgtaaagagcatggtgtctgccggctccggtgaggtcgactcattcagtctgggccttctgtgtattagcatcatgatcgaagaggtgatgcgctcgcgatggtcccggaaaatgttgatgactgggacactcgctgtatttttcctgctaattatgggacagctgacctggaacgatctcatccgtctgtgcattatggtgggcgccaatgcatctgacagaatggggatgggaacaacttaccttgctttgatggccacctttaagatgaggcctatgttcgcagtcggcctgttatttcgccggctcacgagcagagaggtgctgcttctgacaataggtctatcactcgttgccagtgtggaactgccaaactccttggaggaactgggggatggattagctatgggcatcatgattctcaaactgcttaccgacttccaatctcatcagctgtgggcgactttgctcagcctgacctttatcaagacaactttctccctacactatgcctggaaaaccatggcaatggtcctgtcaattgtaagcctttttcccctctgtctgagtacgacatctcagaagaccacttggttgccggtgctgttaggctccctcgggtgcaagcctctgacaatgttccttatcgctgagaataaaatatggggaaggcgaagctggccactgaacgaaggtatcatggccgttggcattgtgtcgatcttgctctcatctctgctaaagaacgatgtccccctggccgggcctcttattgctggaggcatgctcatcgcatgttacgtgataagtggttccagcgccgacctgtctttggagaaagcggctgaggtaagctgggaagaggaagccgagcattccggggcatcacacaatattttagtggaagtccaggatgacggaaccatgaagatcaaagatgaggagcgcgacgatactctgacaatcctcctgaaggccacccttctggctgttagtggcgtgtatcccttgagcattccagcaacgctattcgtgtggcatttttggcagaagaagaagcagcggtctggcgtcctgtgggacactccttcacccccagaagtggagagagccgttctcgatgacgggatatacaggatcatgcagcgtggactgcttggtcgcagccaggtaggcgtgggggtcttccaagaaaacgtgtttcacaccatgtggcacgttacacggggagcggtgttaatgtatcagggcaaaagactggagccgagttgggctagcgtcaagaaagacctcatttcctacggtgggggatggaggttgcagggctcttggaataccggcgaggaagtgcaggtaatcgccgtcgagcctgggaagaaccccaaaaatgtgcaaacagcaccaggaactttcaagacccccgaaggtgaggttggcgccattgctctggattttaagcctgggacgtcgggaagcccaatcgtgaaccgagaaggcaaaatagtcggtctctacgggaatggagtggttacaacttcaggcacctatgtgtccgccatcgcacaggctaaggccagtcaggagggccccctgcctgagattgaagacgaggtcttccggaaacgcaaccttacaatcatggatctgcatccggggtctggaaagaccagaaggtacttgccagcgattgtgcgggaagccatcaaacgaaagctaagaactctgatactcgcacccacccgcgtagtggctagcgagatggccgaggctttaaagggtatgcctattaggtatcaaacaacggcagttaaatccgagcacactggcaaggagatcgtcgacctgatgtgccatgccacctttacaatgcgtcttctgtcaccagtgcgggtgcccaattacaacatgatcattatggatgaagcccacttcaccgacccttctagcatcgctgcgagagggtatataagtactagggtcggaatgggcgaggcagccgctatttttatgacagccaccccgcccggttccgtagaagcattcccacagagcaatgccgtgatccaggatgaggaacgcgacattcctgagcgatcttggaactcagggtacgagtggatcacggattttcccggaaaaactgtttggttcgtgccatccataaagagtggcaatgacattgctaactgtctcaggaaaaatggcaagcgggtcatccagttgagcaggaagacattcgataccgaatatcagaaaaccaagaacaacgactgggactacgtggttactacagatatctcggagatgggggcgaattttcgcgccgaccgtgtgattgatcctagacggtgcctgaaacccgtcatcctcaaggacggaccagaaagggtgattctggcaggtccgatgcctgtaaccgtggcttctgccgcacagcgccgaggcagaatagggcggaaccataataaagagggagatcagtacatctatatgggccagccccttaacaatgacgaggatcacgcccactggacagaagctaagatgctactggacaacattaatactccagagggtatcatccccgccttgttcgaacctgagagggaaaagtccgcggcaattgatggggagtaccgcttaagaggcgaggccaggaaaacgtttgttgaactgatgcggcgtggagacctcccagtctggctgagctataaggtggcttcagagggcttccaatacagtgatcgccgatggtgctttgacggggaaagaaacaatcaggtgcttgaggaaaacatggatgtcgagatatggaccaaagagggagaaaggaagaaactgcggccccgctggctcgacgccagaacatattctgaccctttggctctgagggagttcaaggaatttgcagccggtcggcgatccgttagcggcgatctaatcctggagattgggaaactcccgcagcatcttactcagagagctcaaaatgccctggacaacttagtgatgttgcacaattcagaacagggaggccgcgcatacaggcatgcgatggaggagctgccagataccatcgaaacactcatgctgcttgccctgattgctgtactcaccggtggggtgactttgttctttctgagtggccggggattaggcaagacgagcatcgggctactgtgtgtcatggcctcctctgtgctcctttggatggcaagcgttgagccccactggatagctgcctccatcattctggagttctttttgatggtgctgctcatccctgagcccgaccgtcagagaaccccacaggataaccaactggcatatgtcgtaattggacttctcttcatgatcctgacagtggccgctaatgagatgggtttgctggaaactaccaagaaagacttaggcatagggcacgttgcggtggagaaccatcaccatgccgcaatgctagatgtcgacctgcaccctgcttcagcctggacactctacgccgtggcaaccactattatcacacccatgatgaggcatacgattgaaaacaccactgctaatatctctcttacagccatagcgaaccaggctgccatcctgatgggattggataagggctggccaattagtaaaatggacatcggtgtccctctgctcgcactggggtgctacagccaggtgaatccgcttaccttaaccgccgctgttctgatgctcgtggcacactatgccattatcggccccggattgcaagcgaaggctacacgcgaggcccagaaacggactgcagccggcataatgaagaacccaacggtagatgggattgtggctatcgacctggatcctgtcgtttacgacgccaagtttgaaaaacagctaggacagatcatgctgctcattctttgtaccagccaaatcctgttgatgcgaacaacttgggcactgtgcgagtccataaccctcgctacaggccccctgaccactttatgggagggttctccagggaagttctggaatacgacaattgccgtgtcaatggcgaacatcttcagaggaagctatcttgccggcgcaggtctggctttttccctcatgaaaagtctaggcgggggaaggcgcggcaccggggcccagggagaaactctgggcgagaagtggaaacggcagttgaatcagctgtctaagagcgagttcaacacctacaagagatcaggtattatggaggtcgaccgttccgaagcaaaagaggggctcaagaggggagagacaactaaacacgctgtgagtcggggcaccgccaaacttcgctggtttgtagaacgaaatctggtgaaacctgagggtaaggttatcgatttgggctgtgggagaggaggctggagctattactgcgccgggctgaagaaagtgacagaagtcaagggatatacgaaaggcggtcccgggcatgaggaaccgataccaatggcgacctacggatggaacctcgtgaagttacactctggcaaagacgtcttctttatccctcccgagaagtgtgatactctgctttgcgacattggcgagtcctcaccaaatcccacaatcgaagaggggaggaccctgcgggtgctaaaaatggttgaaccttggctccgcggaaaccaattctgtattaagatcctgaatccgtacatgcccagcgtagtggagactttggagcagatgcagagaaagcatggtggcatgctggtcaggaacccactctcgcgaaattctacacacgaaatgtattgggtgagttgcgggaccggaaacattgtttccgctgtgaatatgacgagccggatgcttctgaaccgttttaccatggcacacagaaaacctacatacgagcgcgatgtcgacttaggcgccggtactaggcatgtggctgtagaacccgaggtggccaacctggatatcatagggcagcggattgaaaatatcaagcacgagcataaatcaacctggcactatgacgaggataacccttacaagacatgggcatatcatggatcctacgaagttaaaccatctggcagcgccagttccatggtcaatggcgtggtgaagttgctcactaagccctgggacgtcatccctatggttacccaaattgctatgacagataccactccattcgggcagcagagagtgtttaaagagaaggtagacacgcgcacacccaaagcgaagaggggaaccgcccaaataatggaagtgactgcaaaatggctgtggggtttcctaagccgaaacaagaagccgcggatctgtaccagagaggaatttacaaggaaagtccgctctaatgctgccattggcgcagtgttcgttgacgagaaccagtggaactcagccaaggaggctgtggaagatgagcgtttttgggaccttgtccaccgggaaagagagctgcacaaacaggggaagtgcgccacgtgcgtgtataacatgatgggaaaaagggaaaagaagctcggcgagttcggtaaagcgaaggggagtcgcgcaatctggtacatgtggctgggagcccgattcttggagtttgaagctctgggcttcatgaatgaggatcattggttttcccgggaaaacagcctctctggcgtagagggggagggacttcacaaactgggttacattttaagagacatctcgaagatacctggcgggaatatgtatgccgatgacaccgcaggatgggatactaggatcacagaagacgatctgcagaacgaggctcgcattaccgacatcatggaaccagagcatgccttgctcgctaaatcaattttcaagctgacttaccaaaataaagttgtgagagtccagcggcccgccaagaacggcacagtgatggatgtgatcagcaggcgtgaccagcgaggttccgggcaggtcggaacctatggcctaaatacatttactaacatggaagcacaacttatacgccagatggagagtgagggcattttctctcctagcgaactggagaccccaaacctcgcggaaagagttctggattggttggagaagtacggggtgaaacggttaaagaggatggccatctccggagacgactgtgtagtgaaacccatcgatgaccgctttgctacggccctgaccgcactcaatgatatgggtaaggtcagaaaagacattccgcagtgggaaccttcaaagggctggaacgattggcagcaagtgcccttctgcagtcaccactttcatcagcttataatgaaggacgggcgggagatcgttgtgccatgtaggaatcaggatgagctggtcggacgagctcgtgtgtctcagggcgccggttggagcctaagagaaacagcatgcctggggaaatcctatgcccaaatgtggcagctcatgtacttccaccgccgggacttgaggctggcggctaacgccatttgttcagcagtacctgttgattggatccccactagcagaaccacatggtctattcatgcccaccatcagtggatgactaccgaggacatgctttccgtgtggaatcgcgtctggatcgaagagaacccatggatggaagataagacgcacataagtagctggggagacgtgccctatctgggcaaacgggaggaccaatggtgcggctcgctcatcgggttaacagctagggccacctgggcaactaatattcaggttgctatcaaccaggtgcgaagactgattggaaatgagaactacttggattacatgacatccatgaagcggtttaaaaatgaatctgaccctgagggtgccctgtggtga

SEQ ID NO: 13925 - RNA, 9879 nt, synthetic construct
  misc_feature 1..9879: note = derived and/or modified CDS sequence (opt3) from DENV-1__GQ868615__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatgattctctcaatcgttagcctgttccccttgtgtctgagtacgacatctcagaagaccacttggttaccggtgctcctgggctcccttgggtgcaagcctctgacaatgtttttgatagctgagaataaaatctggggaaggcgaagctggccactcaacgaaggtattatggccgtcggcatcgtatcgattctgctatcatctctgcttaagaacgatgtgcccctcgccgggcctctgatcgctggaggcatgttgatagcatgttacgttattagtggttccagcgccgacttatctctggagaaagcggctgaggtgagctgggaagaggaagccgagcattccggggcatcacacaatatcctcgtcgaagtgcaggatgacggaaccatgaagatcaaagatgaggagcgcgacgatactctgacaattcttctgaaggccaccttgctagctgtaagtggcgtgtatcccctgagcataccagcaacactcttcgtctggtacttctggcagaagaagaagcagcggtctggcgttctgtgggacactccttcacccccagaagtggagagagccgtgcttgatgacgggatctataggattatgcagcgtggattactgggtcgcagccaggtcggcgtgggggtttttcaagaaaacgtattccataccatgtggcacgtgacacggggagcggtcctcatgtaccagggcaaaagattggagccgagttgggctagcgtgaagaaagacctgatctcctacggtgggggatggaggctccagggctcttggaataccggcgaggaagttcaggtgattgccgtcgagcctgggaagaaccccaaaaatgtgcaaacagcaccaggaacttttaagacccccgaaggtgaggtaggcgccatcgctctggatttcaagcctgggacgtcgggaagcccaatagtcaaccgagaaggcaaaatcgtgggtctttatgggaatggagttgtgacaacttcaggcacctacgtctccgccattgcacaggctaaggccagtcaggagggccccctgcctgagatcgaagacgaggtgtttcggaaacgcaacttgacaattatggatctacacccggggtctggaaagaccagaaggtatctgccagcgatcgttcgggaagccataaaacgaaagctcagaactttaattctggcacccacccgcgtggtcgctagcgagatggccgaagctcttaagggtatgcctatcaggtaccaaacaacggcagtgaaatccgagcatactggcaaggagatcgtagacctgatgtgccacgccaccttcacaatgcgtctcttgtcaccagtgcgggttcccaattataacatgattatcatggatgaagcccattttaccgacccttctagcatagctgcgagagggtacattagtactagggtcggaatgggcgaggcagccgctatcttcatgacagccaccccgcccggttccgtggaagcatttccacagagcaatgccgtgattcaggatgaggaacgcgacatccctgagcgatcttggaactcagggtatgagtggataacggatttccccggaaaaactgtctggtttgtaccatccattaagagtggcaatgacatcgctaactgtctgaggaaaaatggcaagcgggtgatccagctcagcaggaagacattcgataccgaataccagaaaaccaagaacaacgactgggactacgttgtgactacagatatttcggagatgggggcgaatttccgcgccgaccgtgtcatcgatcctagacggtgcctgaaacccgtgattcttaaggacggaccagaaagggttatactagcaggtccgatgcctgtgaccgtcgcttctgccgcacagcgccgaggcagaatcgggcggaaccacaataaagagggagatcagtatatttacatgggccagcccctgaacaatgacgaggatcatgcccactggacagaagctaagatgttgttagacaacatcaatactccagagggtatcattcccgccctgtttgaacctgagagggaaaagtccgcggcaatagatggggagtatcgcctcagaggcgaggccaggaaaacgttcgtggaactgatgcggcgtggagaccttccagtatggctgagctacaaggtggcttcagagggctttcaatatagtgatcgccgatggtgcttcgacggggaaagaaacaatcaggttctcgaggaaaacatggatgtcgagatctggaccaaagagggagaaaggaagaaattgcggccccgctggctggacgccagaacatactctgaccctctagctctgagggagtttaaggagttcgcagccggtcggcgatccgtgagcggcgatctcattcttgagatcgggaaactgccgcagcacttaactcagagagctcaaaatgccttggacaacctggtgatgctccataattcagaacagggaggccgcgcatataggcacgcgatggaggagctgccagataccattgaaacacttatgctgctcgccttgatcgctgtcctgaccggtggggttactttatttttcctaagtggccggggactgggcaagacgagcatagggctcctttgtgtgatggcctcctctgtactgttgtggatggcaagcgtggagccccattggatcgctgcctccattatcctggaatttttcctcatggtcctgcttattcctgagcccgaccgtcagagaaccccacaggataaccaactcgcatacgtggttatcggactgttgtttatgatactgacagtggccgctaatgagatgggtttactagaaactaccaagaaagacctgggcattgggcacgtcgcggtagagaaccaccatcacgccgcaatgctcgatgtggaccttcatcctgcttcagcctggacactgtacgccgttgcaaccactatcattacacccatgatgaggcacacgatcgaaaacaccactgctaatatatctttgacagccatcgcgaaccaggctgccattctgatgggactcgataagggctggccaatcagtaaaatggacattggtgtgcctctgcttgcattagggtgctattcgcaggtcaatccgctgaccctcaccgccgctgtgttgatgctggtcgcacattacgccatcataggccccggactacaagcgaaggctacacgcgaggcccagaaacggactgcagccggcattatgaagaacccaacggtggatgggatcgttgctatcgacctggatcctgtggtatatgacgccaagttcgaaaaacagctcggacagattatgcttctgatcttgtgtaccagccaaatactgctcatgcgaacaacttgggcactgtgcgagtccattaccttagctacaggcccccttaccactctgtgggagggttctccagggaagttttggaatacgacaatcgccgtgtcaatggcgaacattttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtatcatggaggtcgaccgttccgaagcaaaagaggggctgaagaggggagagacaactaaacacgctgttagtcggggcaccgccaagttgcgctggttcgtggaacgaaatctggtcaaacctgagggtaaggtgatagatctcggctgtgggagaggaggctggagctactattgcgccgggttaaagaaagtaacagaagtgaagggatacacgaaaggcggtcccgggcacgaggaaccgatcccaatggcgacctacggatggaacctggttaaacttcattctggcaaagacgtgtttttcattcctcccgagaagtgtgatactctgctatgcgacatcggcgagtcctcaccaaatcccacaattgaagaggggaggaccctccgggtcctgaaaatggtggaaccttggttgcgcggaaaccaattttgtatcaagattctgaatccgtatatgcccagcgtcgtggagactctcgagcagatgcagagaaagcacggtggcatgcttgttaggaacccactgtcgcgaaattctacacatgaaatgtactgggtaagttgcgggaccggaaacatcgtgtccgctgtcaatatgacgagccggatgttactgaaccgtttcaccatggcacacagaaaacctacatatgagcgcgatgtggacttgggcgccggtactaggcacgttgctgtggaacccgaggtcgccaacctcgatataattgggcagcggatcgaaaatatcaagcatgagcacaaatcaacctggcattacgacgaggataacccttataagacatgggcataccacggatcctatgaagtgaaaccatctggcagcgccagttccatggtaaatggcgtggttaagctgctaactaagccctgggacgtcattcctatggtgacccaaatagctatgacagataccactccatttgggcagcagagagtgttcaaagagaaggtcgacacgcgcacacccaaagcgaagaggggaaccgcccaaatcatggaagttactgcaaaatggctttggggttttctgagccgaaacaagaagccgcggatttgtaccagagaggagttcacaaggaaagtgcgctctaatgctgccatcggcgcagtatttgtggacgagaaccagtggaactcagccaaggaggctgtcgaagatgagcgtttctgggacctcgtgcatcgggaaagagagctgcacaaacaggggaagtgcgccacgtgcgtttacaacatgatgggaaaaagggaaaagaagttgggcgagtttggtaaagcgaaggggagtcgcgcaatttggtacatgtggctgggagcccgattcctcgagttcgaagctcttggctttatgaatgaggatcactggttctcccgggaaaacagcctgtctggcgtggagggggagggattacataaactgggttatatcttgagagacatatcgaagatccctggcgggaatatgtacgccgatgacaccgcaggatgggatactaggattacagaagacgatctccagaacgaggctcgcatcaccgacattatggaaccagagcacgccctgctagctaaatcaatctttaaacttacttatcaaaataaagtcgtgagagtacagcggcccgccaagaacggcacagttatggatgtgataagcaggcgtgaccagcgaggttccgggcaggtcggaacctacggcctgaatacattcactaacatggaagcacaactcattcgccagatggagagtgagggcatcttttctcctagcgaactggagaccccaaacttggcggaaagagtgttagattggctggagaagtatggggtggaacggctcaaaaggatggccatctccggagacgactgtgtcgttaagcccattgatgaccgcttcgctacggcccttaccgcactgaatgatatgggtaaagtgagaaaggacataccgcagtgggagccttcaaaaggctggaacgattggcagcaagtacccttttgcagtcatcacttccaccagctaatcatgaaggacgggcgggagattgtggtcccatgtaggaatcaggatgaactggtgggacgagctcgtgtttctcagggcgccggttggagcctcagagagacagcatgcttggggaagtcctacgcccaaatgtggcagctgatgtattttcatcgccgggaccttaggctggcggctaacgccatctgttcagcagtgcctgtcgattggattcccactagcagaaccacatggtctatccacgcccatcaccagtggatgactaccgaagacatgctctccgtgtggaatcgcgtatggatagaggaaaacccatggatggaggataaaacgcatatcagtagctggggagacgttccctacttaggcaagcgggaggaccaatggtgcggctcgctgattgggttgacagctagggccacctgggcaactaatatccaggtggctattaaccaggtccgaagactgatcggaaatgaaaactacctcgattatatgacatccatgaaacggttcaagaatgagtctgaccctgaaggtgccctttggtga

SEQ ID NO: 13926 - RNA, 9879 nt, synthetic construct
  misc_feature 1..9879: note = derived and/or modified CDS sequence (opt3) from DENV-1__GU131749__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctactcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggaagcttcaaacttgaaaaggaggtcgctgagacccagcacggtacggtgttggttcagattaagtacgaaggcacagatgcgccttgcaaaataccattctcgacccaagacgagaagggggtgactcagaacggacgcctgatcacagcaaatcccattgtaaccgataaagaaaagcctgtcaacatcgaggccgagccaccctttggcgaatcttatatagtgattggtgctggggagaaagccctcaagctgtcctggttcaagaaaggctcaagtatcggaaagatgtttgaagcaactgccagaggcgctaggcggatggccatccttggggacaccgcatgggatttcggaagcattggtggcgtttttacatccgtggggaaactggtccatcagatcttcggaacggcgtaccgagtgttgttttctggcgtaagctggaccatgaagattggtataggggtgctcctgacttggttaggcctgaattcacgcagtacatccctaagcatgacctgtatcgctgttggactcgtcacactgtaccttggcgtgatggtgcaggccgactctgggtgcgtcattaactggaaaggaagagagttgaagtgtggctcaggtatcttcgttactaatgaagtgcacacctggacggagcaatataagtttcaggcagatagtccgaaaaggctgagcgccgctatcgggaaggcctgggaggaaggagtgtgcggcattcggtccgcaacacgcctcgagaacataatgtggaaacagatctctaacgaactgaatcatattttactggagaacgacatgaagttcaccgtagtcgtgggtgacgttgctggcatccttgtgcaggggaaaaagatgattagacctcaacccatggaatacaaatattcgtggaagagctggggaaaggccaaaatcataggcgcggatgtccagaattccacttttatcattgacgggccaaacacccctgagtgtcccgatgaccagagggcctggaatatctgggaggtggaagattacggattcggcatttttacaactaacatctggttgaagctccgtgactcatatacccaggtttgcgatcaccggctgatgagtgctgcaataaaagactctaaggccgtgcacgctgatatgggttactggattgagagcgaaaaaaatgagacatggaagctagcccgagcatccttcatcgaagtaaagacgtgtatttggccaaaatcacataccctgtggagcaacggggtcctcgagtctgagatgatcatacccaagatccacggaggccctatttcccaacataattatagaccaggttacttcactcagacagcgggcccgtggcacctggggaaacttgaattggactttgatctgtgcgagggaaccactgtggtggtcgacgaacactgcggcaacagggggcccagtttacgcacaaccacggttactggaaagatcattcatgagtggtgttgccggagctgtaccctccctccactgagattcaggggcgaggatggttgctggtacgggatggaaatccgccccgtgaaagagaaggaagagaatcttgtaaagtctatggtgtccgccggatcaggcgaagtcgacagttttagcctgggtttgctctgtatatcgattatgatcgaggaggtgatgcgatcccggtggtctcgtaaaatgctgatgacaggcaccctagctgttttctttctgctcatcatggggcagctgacttggaacgaccttattagattgtgcatcatggtgggagccaatgcaagcgataggatgggcatggggacaacctatctggctttaatggccacattcaagatgcgccctatgtttgcagtcggactcctgttccggagacttacttcaagggaagtgctgctactcaccattggcctgagtttggttgcctccgtggagctgccaaactctttagaagagctcggtgacgggctggctatgggaataatgatccttaaactgttgacggattttcaaagctaccagctctgggcgacactgctatccctgaccttcattaagactaccttttcacttcactatgcctggaaaacaatggcaatggtcctcagcatcgtaagtctgttccccttgtgtctgtctactacctcccagaagacgacatggttaccggtgctcctgggcagccttggctgcaagcctctgaccatgtttttgattgctgaaaataaaatctgggggcgaaagtcgtggccactcaacgagggaataatggccgttggtatcgtgtcaattctgctatctagtctgcttaaaaacgacgtccccctcgccggccctctgatcgctgggggaatgttgattgcatgttacgtgatctccggcagctctgccgatttaagcctggagaaggcggctgaagtatcctgggaggaagaggccgaacattcaggtgcaagtcacaatatactcgtggaggtccaggacgatgggactatgaaaattaaggacgaggaacgcgatgacacactgaccatccttctgaaagccactttgctagctgttagcggagtgtatcccctgtctatcccagcaacactcttcgtgtggcatttctggcaaaagaagaaacagcggtccggcgtcctgtgggataccccttcacccccagaggtggaaagagccgttcttgacgatggcatttacaggataatgcagcgtgggttactgggacgcagtcaggtaggtgtgggcgtctttcaagagaacgtgttccacacgatgtggcacgttactcggggggcggtgctcatgtatcagggaaagagattggagccgagctgggcttccgtcaaaaaggacctgatctcttacggcggtgggtggaggtttcagggatcgtggaataccggcgaagaggtgcaggtaattgccgtcgaacctggcaaaaaccccaagaatgtgcaaacagcaccagggaccttcaagacacccgagggagaagttggtgccatcgctctcgactttaaacctggcactagcgggtcaccaattgtgaaccgagagggaaagatcgtcggcctgtacggtaatggggtggttaccacgtccggaacatatgtgagtgccatagcacaggctaaagcctctcaggagggcccccttcctgaaatcgaggatgaagtcttccggaagcgcaacctgactattatggacttgcatccgggcagcgggaaaaccagaaggtacctaccagcgatcgtgcgggaggccattaagcgaaagctgagaacactcatcttagcacccacccgcgtagtggcttccgaaatggccgaggctctgaaaggaatgcctataaggtatcaaactaccgcagttaagtcagagcacacaggtaaagaaattgtcgatcttatgtgccatgccacgtttactatgcgtctgctctctccagtgcgggtgcccaattacaacatgatcatcatggacgaggcccacttcaccgatcctagcagtattgctgcgagaggctatatctccacaagggtcgggatgggagaagcagccgctatatttatgaccgccactccgcccggcagcatggaggcattcccacagtctaatgccgtaattcaggacgaagagcgcgatatccctgagcgatcatggaactccggttacgaatggattacagactttcccgggaagaccgtgtggttcgttccaagtatcaaagctggaaatgatatagcgaactgtttgagaaagaatggcaagcgggtgattcagctgagcaggaaaacgttcgacactgagtatcaaaagacaaaaaacaacgattgggactacgtcgtgaccaccgacatctcggaaatgggcgccaattttcgcgcagatcgtgttatcgaccctagacggtgcctcaagcccgtgattctgaaagatgggccagagagggtcatccttgctggaccgatgcctgtgactgtagcctctgcagcccagcgccgaggtagaattggccggaaccataataaggagggggaccagtacatatatatgggacagcccctaaacaatgatgaagaccacgctcactggacagaggccaagatgctgttggataacatcaataccccagaaggcattatccccgcgttattcgagcctgaaagggagaaatccgcagccatcgacggtgagtaccgcctgagaggggaagctaggaagacatttgtggagctcatgcggcgtggcgatctgccagtttggcttagctataaagtcgcctcagaaggattccaatacagtgaccgccgatggtgctttgatggcgagagaaacaatcaggtgctggaagagaacatggacgtggagatttggactaaggaaggggagaggaaaaagctccggccccgctggttggatgctagaacgtattctgaccctctggcactaagggaattcaaagagtttgccgctggacggcgatccgtcagcggtgacctgatactcgaaatcggcaagcttccgcagcatctgacccagagagcccaaaatgcattagataacttggttatgctgcacaattcagagcaggggggacgcgcgtacaggcatgccatggaggaactcccagacacaattgagactctgatgcttctggctctcatcgccgtgttgaccggcggtgtaacactgttctttttaagtgggaagggcctaggaaaaaccagcattggcctgctctgtgtgatggcatcctctgtccttctgtggatggctagcgtggaaccccactggatcgccgcatccataatcttggagttctttctgatggttctcctgattcctgagcccgatcggcagcgtactccacaggacaaccaacttgcctatgtggtcatcgggctcctgttcatgattttgacggtagctgcgaatgaaatgggactgttagagaccacaaagaaagatctaggtatcggccacgtggccgttgaaaaccatcaccatgcagctatgctggacgtggatctccaccctgcctcagcctggactctttacgcagtcgctaccacaataattacccccatgatgagacatactatcgagaacacaacggccaatatttctctgaccgcgatcgctaaccaggccgcaatattgatggggctggacaagggatggccaatcagtaaaatggatattggcgtgcctctcctggcccttggttgctactcgcaggtcaatccgttaactctgacagctgcagtgctcatgttggttgcccactatgcgatcattgggcccggcctgcaagctaaggccaccagggaagcacagaagcgcaccgccgctggaatcatgaaaaacccaacaatagacggcattgtggccatcgatctagaccctgtagtgtacgatgcaaagtttgagaaacagctggggcagatcatgctccttattctgtgtactagccaaatcttgctgatgcggacgacctgggctctctgcgagtccataacactggccactggacccttaaccacactttgggaaggctctccaggtaagttctggaataccactattgcggtctcaatggccaacatcttccgagggagctatctggcaggagctggcctcgccttttccctaatgaaaagtctgggtggcgggagaaggggaacgggcgcacagggggagacattgggagaaaagtggaagcgccagctgaatcagctctctaaaagcgagttcaacacctacaagcggtcaggcattatggaagttgacagatccgaggctaaagagggtcttaagcgtggggaaactaccaaacacgccgtgagtaggggaacagccaagctgcggtggtttgtcgagcgcaatttggtgaagcctgaaggcaaagtaatcgacctgggttgtggccgagggggatggagctattactgcgcgggcctcaagaaagtgactgaggttaaggggtataccaaaggaggccccggtcatgaagagccgataccaatggctacatacgggtggaacttagtgaagctgcactctggaaaagatgtcttctttatccctcccgagaagtgtgacacgcttctgtgcgatattggcgaatcctcaccaaatcccaccatcgaggaaggcagaactctaagggtgctcaagatggtcgagccttggctgcgggggaaccaattctgtattaaaatcttgaatccgtacatgcccagcgtggttgagacactggaacagatgcagcgcaagcatggaggtatgctcgtaagaaacccactttcgaggaattctacccacgagatgtattgggtgagttgcggcactgggaacattgtctccgcaatcaatatgacaagccgaatgctgttaaaccggtttaccatggcccaccgtaaacctacgtacgaaagagacgtggatctgggagctggcacccgccatgttgccgtggagcccgaagtcgcaaacttggacataattggtcagaggatcgagaatatcaagcacgagcataaatcaacatggcactatgatgaagacaacccttacaagacttgggcctatcatgggtcctacgaggtgaagccatctggaagcgctagttccatggtaaatggcgtggttaaactcctgaccaagccctgggatgtcattcctatggtgacacaaatagcgatgactgacaccacaccattcggccagcagcgggtgtttaaagaaaaggtcgataccagaactcccaaagccaagcgcgggacggcacaaatcatggaggttacagctaggtggctatggggattccttagccgaaacaagaaaccgcggatttgtaccagagaagagtttactaggaaggtgcgctctaatgccgcaatcggtgccgtattcgtggacgagaaccagtggaattcagctaaagaagccgtcgaggacgatcgtttttgggacctggtgcaccgggaaagagagctccacaagcagggcaaatgcgcgacctgcgtttataacatgatggggaagagggaaaagaaactgggagagttcggcaaggcaaaaggtagtcgcgccatttggtacatgtggttgggggctcgattcctggagtttgaagccctcggattcatgaatgaggatcattggttttcccgggaaaacagcctttctggcgtggagggcgaggggctgcacaagttaggatacatcctgagagacatatcgaaaatccctggtggcaatatgtatgcagatgacacagctgggtgggatacgaggattaccgaagacgatttgcagaacgaggccaagatcactgacattatggaaccagagcatgctctcctggccaaatcaatcttcaagctaacataccaaaataaggtcgtgcgcgtacagagacccgcaaaaaacggaaccgttatggatgtgataagccggagggaccagcgtggctccggtcaggtcgggacttatggacttaatacatttaccaacatggaagcgcaactgattcgacagatggagagtgagggcatcttcctccctaacgaactggagacaccaaatttggccggccgcgtgttagattggctggaaaagtacggggtggagagactcaaacggatggctatctctggagacgactgtgtcgttaagcccattgatgacaggtttgccactgcacttaccgctctgaacgatatgggtaaagtgcgcaaggacataccgcagtgggaacctagcaagggctggaatgattggcagcaagtacccttctgctcccaccactttcatcagctaatcatgaaagacgggagagagattgtggtcccatgtcggaaccaggatgagctggtgggaagggcccgagtttcacagggcgcaggttggagtctccgtgaaacggcctgcttggggaagtcttatgcgcaaatgtggcagctgatgtacttccacagacgcgaccttcggctggctgccaatgcaatctgtagcgccgtgcctgtcgattgggtgcccacctccaggacaacttggtcaattcatgctcaccatcagtggatgaccacagaggacatgctcagcgtatggaacagagtttggatcgaagagaatccatggatggaagataaaactcgcatatcttcctgggaggacgtgccctatttaggaaagcgggaggaccaatggtgcggcagtctgatcggcttgaccgccagggcaacgtgggctacaaacattcaggtcgccatcaatcaggtgcgaagactgattgggaacgaaaattacagcgattacatgacctcgatgaaacggtttaagaacgagtccgaacctgagggagcgctctggtga

SEQ ID NO: 13927 - RNA, 9879 nt, synthetic construct
  misc_feature 1..9879: note = derived and/or modified CDS sequence (opt3) from DENV-1__GU131750__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactaattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctattgagaaagcggctgaggtgagctgggaagaggaagccgagcattccggggcatcacacaatatcttagtagaagtgcaggatgacggaaccatgaagatcaaagatgaggagcgcgacgatactctgacaattctcctgaaggccacccttctggctgtcagtggcgtttatcccttgagcataccagcaacgctattcgtgtggtacttctggcagaaaaagaagcagcggtctggcgtgctgtgggacactccttcacccccagaagtcgggagagccgtgctcgatgacggaatctataggattatgcagcgtggtctgcttggccgcagccaggttggggtaggagtgtttcaagagaacgtcttccataccatgtggcacgtgacacggggcgcggttttaatgtaccagggtaaaagactggaaccgagttgggctagcgtgaagaaagacctcatctcctacgggggaggctggaggttgcagggctcttggaataccggggaggaggtccaggtgattgccgtagaacctggaaagaaccccaaaaatgtccaaacagcaccaggtacttttaagacccccgagggcgaagtgggggccatcgctctggatttcaagcctggaacgtcgggcagcccaatagttaaccgagagggtaaaatcgtggggctctatggaaatggcgtcgtgacaacttcaggcacctacgtttccgccattgcacaggctaaggccagtcaggaagggcccctgcctgagatcgaggacgaagtgtttcggaaacgcaaccttacaattatggatctgcacccgggatctggtaagaccagaaggtatttgccagcgatcgtccgggaggccataaaacgaaagctaagaactctgattctcgcacccacccgcgtggtagctagcgaaatggccgaggctttaaagggcatgcctatcaggtaccaaacaacggcagtgaaatccgaacatactgggaaggagatcgttgacctgatgtgccacgccaccttcacaatgcgtcttctgtcaccagtccgggtgcccaattataacatgattatcatggatgaggcccattttaccgacccttctagcatagctgcgagaggatacattagtactagggtgggcatgggtgaagcagccgctatcttcatgacagccaccccgcccgggtccgtcgaggcatttccacagagcaatgccgtaattcaggatgaggaacgcgacatccctgaacgatcttggaactcaggatatgagtggataacggatttccccggcaaaactgtgtggtttgttccatccattaagagtggcaatgacatcgctaactgtctcaggaaaaatgggaagcgggtgatccagttgagcaggaagacattcgataccgagtaccagaaaaccaagaacaacgactgggactacgtcgtgactacagatatttcggaaatgggagcgaatttccgcgccgaccgtgttatcgatcctagacggtgcctgaaacccgtgattctcaaggacggtccagagagggtcatactggcaggcccgatgcctgtgaccgtagcttctgccgcacagcgccgagggagaatcggacggaaccacaataaagaaggcgatcagtatatttacatgggtcagccccttaacaatgacgaggatcatgcccactggacagaggctaagatgctactggacaacatcaatactccagaagggatcattcccgccttgtttgagcctgaaagggagaagtccgcggcaatagatggcgaatatcgcttaagaggagaggccaggaaaacgttcgtggagctgatgcggcgtggcgacctcccagtttggctgagctacaaggtcgcttcagaagggtttcaatatagtgatcgccgatggtgcttcgacggagagagaaacaatcaggtgcttgaagagaacatggatgtggaaatctggaccaaagagggtgagaggaagaaactgcggccccgctggctcgacgccagaacatactctgaccctttggctctgagggaatttaaggagttcgcagccggccggcgatccgtcagcggggatctaattctggaaatcggaaaactcccgcagcaccttatgcagagagctcaaaatgccctggacaacttagttatgttgcataattcagagcagggcggtcgcgcatataggcacgcgatggaggaactgccagatactattgagaccctcatgctgcttgccctgatcgctgtgctcacagggggcgtaaccttgtttttcctgagtggacggggcttagggaagactagcataggactactgtgtgtgatggcctcctctgtcctcctttggatggcaagcgtggaaccccattggatcgctgcctccattatcctggagtttttcttgatggttctgctcattcctgaacccgaccgtcagagaacgccacaggataaccaactggcatacgtggtcatcggtcttctctttatgatactgaccgtagccgctaatgagatgggcttgctggagacaactaagaaagacttagggattggacacgtggcggttgaaaaccaccatcacgccgcaatgctagatgtggacctgcatcctgcttcagcctggaccctctacgccgtcgcaacaaccatcattactcccatgatgaggcacacaatcgagaacacgaccgctaatatatctcttactgccatcgcgaaccaggctgccattctgatgggcttggataagggttggccaatcagtaaaatggacattggggtgcctctgctcgcactgggctgctattcgcaggtcaatccgcttacattaaccgccgctgtgctgatgctcgttgcacattacgccatcataggacccggcttgcaagcgaaggctacccgcgaagcccagaaacggacagcagccgggattatgaagaacccaactgtggatggaatcgtagctatcgacctggatcctgtggtctatgacgccaagttcgagaaacagctaggccagattatgctgctcatcctttgtacgagccaaatactgttgatgcgaaccacatgggcactgtgcgaatccattactctcgctaccggtcccctgacaaccttatgggaggggtctccaggaaagttttggaatactacgatcgccgtttcaatggcgaacattttcagaggcagctaccttgccggtgcaggcctggctttctccctcatgaaaagtctagggggaggcaggcgcgggacaggagcccagggcgagaccctgggtgaaaagtggaaacggcagttgaatcagctgtctaagagcgagtttaacacttataagagatcagggatcatggaagtggaccgttccgaggcaaaagaaggactcaagaggggcgagaccacaaaacacgctgtcagtcggggtactgccaaacttcgctggttcgtggagcgaaatctggtaaaacctgaaggcaaggtgatagatttggggtgtggaagaggcgggtggagctactattgcgccggactgaagaaagttaccgaggtgaagggctacacaaaaggtgggcccggacacgaggagccgatcccaatggcgacgtacggctggaacctcgtcaagttacattctggcaaagacgtgtttttcattcctcccgaaaagtgtgataccctgctttgcgacatcggggagtcctcaccaaatcccactattgaggaaggaaggacactgcgggtcctaaaaatggtggagccttggctccgcggtaaccaattttgtatcaagattctgaatccgtatatgcccagcgttgtagaaaccttggagcagatgcagagaaagcacggcgggatgctggtgaggaacccactctcgcgaaattctactcatgagatgtactgggtcagttgcggaacaggcaacatcgtgtccgctgttaatatgaccagccggatgcttctgaaccgtttcacgatggcacacagaaaacctacctatgaacgcgatgtggacttaggtgccgggacaaggcacgtcgctgtggagcccgaagtagccaacctggatataattggacagcggatcgagaatatcaagcatgaacacaaatcaacttggcattacgacgaggataacccttataagacctgggcataccacggctcctatgaggtgaaaccatctggcagcgccagttccatggttaatggggtcgtgaagttgctcacaaagccctgggacgtgattcctatggtcactcaaatagctatgaccgatacaaccccatttggacagcagagagttttcaaagaaaaggtggacactcgcacgcccaaagcgaagaggggtacagcccaaatcatggaggtaaccgcaaaatggctgtggggctttctaagccgaaacaagaagccgcggatttgtactagagaagagttcaccaggaaagtgcgctctaatgctgccatcggggcagtctttgtggacgaaaaccagtggaactcagccaaggaggctgttgaggatgaacgtttctgggaccttgtgcatcgggagagagaactgcacaaacagggaaagtgcgccacatgcgtctacaacatgatgggcaaaagggagaagaagctcggtgaatttgggaaagcgaagggaagtcgcgcaatttggtacatgtggctgggcgcccgattcttggagttcgaggctctgggctttatgaatgaagatcactggttctcccgggagaacagcctctctggggtggaaggagagggtcttcataaactgggctatatcttaagagacatatcgaagatccctgggggaaatatgtacgccgatgacacggcaggctgggataccaggattactgaggacgatctgcagaacgaagctcgcatcacagacaccatggagccagaacacgccttgctcgctaaatcaatttttaagctgacttatcaaaataaagtagttagagtgcagcggcccgccaagaacggtacagtcatggatgtgatcagcaggcgtgaccagcgagggtccggacaggtgggcacctacggcctaaatacattcactaacatggaggcacaacttatacgccagatggaaagtgaggggatattttctcctagcgagctggaaaccccaaacctcgcggagagagtcctggattggttggaaaagtatggagttgagcggttaaaaaggatggccatctccggtgacgactgtgtggtaaagcccatcgatgaccgcttcgctacggccctgaccgcactcaatgatatgggcaaagtgagaaaggacattccgcagtgggaaccttcaaaagggtggaacgattggcagcaagtccccttttgcagtcatcacttccaccagcttataatgaaggacggacgggagatcgtggttccatgtaggaatcaggatgagctggtgggccgagctcgtgtctctcagggtgccgggtggagcctaagagaaacagcatgcctgggaaagtcctacgcccaaatgtggcagctcatgtattttcatcgccgggacttgaggctggcggctaacgccatttgttcagcagtgcctgtagattggatccccactagcagaaccacatggtctattcacgcccatcaccagtggatgactaccgaggacatgctttccgtttggaatcgcgtgtggatcgaagagaacccatggatggaagataaaacgcatataagtagctggggcgacgtcccctacctgggcaagcgggaggaccaatggtgcgggtcgctcatcggattaacagctagggccacctgggcaactaatattcaggtggctatcaaccaggttcgaagactgattggtaatgagaactacttggattatatgacatccatgaaacggttcaagaatgaatctgaccctgagggcgccctgtggtga

SEQ ID NO: 13928 - RNA, 9879 nt, synthetic construct
  misc_feature 1..9879: note = derived and/or modified CDS sequence (opt3) from DENV-1__GU131751__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgattgccacaatcaccccccaggcgcctagcactgagatccagttaaccgactacggggccctgacactcgattgttctccaaggaccggacttgactttaacgaaatggtcctgttgactatgaaggagaaatcctggctagtgcataagcagtggttcctggatctcccgctgccctggacatcaggcgcaagcacgagtcaagagacctggaatcggcaggaccttctggtaacttttaaaacagctcacgccaagaagcaggaagttgtggtcttgggttctcaagagggggctatgcacaccgccctcacaggcgcaactgaaattcagacctccggaacgaccacaatattcgccggccatctgaaatgccgtttaaagatggataaactgactctaaaggggatgagctatgtgatgtgtaccggatcgttcaaactcgagaaggaagtcgctgagacacagcacggtactgtgctggttcagatcaagtacgagggcaccgacgcgccttgcaaaattccattttctacgcaagatgaaaagggggtgacacagaacggacgccttatcaccgcaaatcccatagtaactgacaaagagaagcctgtcaacattgaagccgagccacccttcggcgagtcctatatcgtgatcggtgctggggaaaaagccttgaagctgtcatggtttaagaaaggcagtagcattggaaagatgttcgaggcaacagccagaggcgctaggcggatggccatcctcggggataccgcatgggactttggatccattggtggcgttttcacttctgtggggaaactggtccatcagatatttggaaccgcgtacggcgtgcttttcagcggtgtatcatggacaatgaagatcgggattggcgtgctgttgacgtggctcggactgaatagtcgatccaccagcttatctatgacttgtatcgctgttggcctggtcacactatacctcggggtgatggtgcaggccgattcaggatgcgtcatcaactggaaaggccgcgaactgaagtgtggtagtgggatttttgttaccaatgaggtgcacacatggactgaacaatataagttccaggcagacagcccgaaaagactttccgccgctataggaaaggcctgggaggagggcgtgtgcggtatcaggtctgcaacccggttggaaaacattatgtggaaacagatctcgaacgagctgaatcatattctcctggaaaacgacatgaagtttacggtagtcgtgggcgatgttgctgggatcttagcccagggaaaaaaggtgatacgccctcaacccatggagcacaaatacagctggaagtcctggggcaaggcgaaaatcattggggccgacgtccagaatacaaccttcatcattgatggaccaaacactcctgaatgtcccgacgatcagagagcttggaatatctgggaggtggaggactatggctttggtatattcaccacaaacatttggctgaagcttagggattcatacactcaggtttgcgaccaccgtttgatgagtgcagccatccgggattctaaagctgtgcatgccgacatggggtattggattgaaagcgagaagaatgaaacctggaaactcgcacgagcgtccttcatcgaggtaaagacatgtatatggccaaagtcacacacgctgtggagcaacggagtcctagaatctgagatgatcattcccaaaatctacggcggtcctatttcccaacataattatagaccaggctactttacccagactgccgggccgtggcacctgggaaagctcgagctggatttcgacctttgcgaaggcacaaccgtggtggtcgatgagcactgcgggaacaggggacccagtttgcgcactacaaccgttacgggcaaaatcatacatgaatggtgttgccggagctgtactctgcctccattaagatttaagggtgaggacgggtgctggtacggaatggagattaggcccgtgaaagaaaaggaggaaaatctcgtaaagtctatggtgtccgctggctcaggtgaggtcgacagtttcagcctgggccttctgtgtatctcgatcatgattgaagaggtgatgcgctccaaatggtctcgaaagatgttgatgaccgggacactcgccgtttttttcctgctaatcatgggacagctgacctggaacgatctcattcggctgtgcataatggtgggcgcaaatgctagcgaccgtatggggatgggaactacatatcttgccttgatggcaacctttaaaatgagacctatgttcgccgtcggcctgttatttaggcgcctcacatcacgggaggtgctgcttctgactatcggtctaagtctcgttgcttccgtggaactgccaaactctttggaggaactgggggatggattagcgatgggcattatgatcctcaagctgcttaccgacttccaaagccaccagctgtgggccacgttgctctccctgacatttattaaaaccactttctcactacattacgcatggaagaccatggctatggtcctgagcatcgtaagtctttttcccctctgtctgtctacaacttcccagaagaccacgtggttgccggtgctgttaggcagcctcgggtgcaaacctctgacaatgttccttatagccgagaataagatctggggaagaaaatcgtggccactgaacgaaggtattatggccgttggcatcgtgtcaattttgctctctagtctgctaaagaacgatgtccccctggctgggcctcttatcgcaggaggcatgctcatagcctgttatgtgatttccggtagctctgcggacctgagcttggagaaagctgccgaggtatcctgggaagaggaagcagagcactcaggggccagtcataatatcttagtggaagtccaggatgacggaaccatgaagatcaaagatgaggagagggacgatactctgacaattctcctgaaggctacccttctggcagttagcggcgtgtaccccttgtctataccagccactctattcgtgtggtatttttggcaaaagaaaaagcagcgatccggcgtcctgtgggacatcccttcacccccagaagtggagcgcgcggttctcgatgacgggatttaccggatcatgcagagaggactgcttggtaggagtcaggtaggcgtgggggtcttccaagaaaacgtgtttcacacaatgtggcacgttacccgtggagctgtgttaatgtatcagggcaaacgcctggagccgagctgggcctccgtcaagaaagacctcatttcttacggtgggggatggcggttgcagggctcgtggaatacgggcgaggaagtgcaggtaatcgcagtcgagcctgggaagaaccccaagaatgtgcaaactgccccaggaaccttcaaaacaagcgaaggtgaggttggcgctatagccctggattttaagcccgggacctcaggatcccctatcgtgaacagagaaggcaaaattgtcggtctctacgggaatggagtggttacaactagtggcacctatgtgtctgcaatcgctcaggccaaggcgagccaggagggcccactgcccgagattgaagacgaggtcttcaaaaagaggaaccttacgatcatggatctgcatcctgggtccggaaagacacgacggtacttgccggccatagtgcgcgaagcaattaaaagaaagctaaggactctgatcctcgctccaacccgggtagtggcctcagagatggctgaagcattaaaaggtatgcccatccgatatcaaacaaccgccgttaagtctgagcacactggcaaagagattgtcgacctgatgtgccatgccacctttacaatgagacttctgagccctgtgcgcgtgccaaattacaacatgatcataatggatgaagctcacttcacggaccccagttccattgcggcaagggggtatatcagcactcgtgtcggaatgggcgaggccgctgccatttttatgaccgcaacacctccgggttctgtagaagccttcccccagtcaaatgctgtgatccaggatgaggaacgggacataccagagagatcctggaacagtgggtacgagtggattaccgattttcctggaaagactgtttggttcgtgcccagcatcaagtcgggcaatgacatcgcgaactgtctcaggaaaaatggcaagcgcgtcattcagttgtctcgaaaaacattcgataccgaatatcaaaagacgaaaaacaacgactgggactacgtggttactacagatatctccgagatgggggccaattttagagcagaccgggtgattgatccaaggcgctgcctgaagcctgtcatactcaaggacggacccgaacgtgtgatcctggctggtccaatgccggtaaccgtggccagcgcagcccagagacggggcaggattgggcgcaaccataataaagagggagatcagtacatctatatgggccagcctcttaacaatgacgaggatcacgctcactggaccgaagccaagatgctactggacaacatcaatactcccgagggtattataccagcgttgttcgaacccgagcgagaaaaatcagcagccatcgatggggagtacagattacggggcgaggctaggaagacatttgttgaactgatgcgcagaggagacctccctgtctggctgagttataaagtggcctctgagggcttccaatactccgataggcggtggtgctttgacggggaacgtaacaatcaggtgcttgaggaaaacatggatgtcgagatttggaccaaggagggagaacgcaaaaagctgcgaccaagatggctcgacgctaggacatatagcgaccccttggcactgcgggagttcaaggaatttgccgctggtcgcagatcagttagtggcgatctaatcctggagattgggaaactccctcagcatcttactcagagggcccaaaatgcactggacaacttagtgatgttgcacaatagcgaacagggaggccgggcgtaccgacatgccatggaggagctgccggatacgatcgaaaccctcatgctgcttgctctgatagccgtactcacaggtggggtgactttgttctttctgtccggcagaggattaggcaagacctctatcgggctactgtgtgtcatggcaagctccgtgctcctttggatggcttcagttgagccacactggattgccgcatctatcattctggaattctttttgatggtgctgctcatccccgagcctgaccgccagaggacaccccaggataaccaactggcctatgtcgtaataggacttctcttcatgattctgaccgtggctgcgaatgagatgggtttgctggaaactacgaaaaaggacttaggcatcgggcacgttgccgtggagaaccatcaccatgcagctatgctagatgtcgacctgcacccagccagtgcctggaccctctacgcagtggctacaactattatcacccctatgatgcggcatacaatagaaaacaccactgccaatatctcgcttacagcgattgctaaccaggccgcaatcctgatgggattggataaaggctggcccattagcaagatggacatcggtgtcccactgctcgccctggggtgctactcccaggtgaatcctcttacgttaaccgctactgttctgatgctcgtggcacactatgccataattggcccgggattgcaagcgaaggctacacgtgaggcccagaaaagaaccgcagccggcatcatgaagaaccccaccgtagatgggatcgtggctattgacctggatccagtcgtttacgacgccaaatttgaaaagcagctaggacagatcatgctgctcatactttgtacatctcaaattctgttgatgaggactacgtgggcactgtgcgagtcaatcaccctcgctacaggccctctgactaccttatgggagggtagccccgggaaattctggaatacaaccattgccgtgtccatggcgaacatcttccgcggaagttatcttgccggcgcaggtctggctttttctctcatgaagagcctaggcgggggacggcgaggcactggggcccagggagaaacgctgggcgagaagtggaaaagacagttgaatcagctgtcaaagtccgaattcaacacatacaaaaggagtggtataatggaggtcgaccgcagcgaagcaaaggaggggctcaaacggggagagaccactaagcacgctgtgtctagaggcaccgccaagcttcgttggtttgtagaaaggaatctggtgaaaccagagggtaaggttatcgatttgggctgtgggcggggaggctggtcctattactgcgccgggctgaaaaaggtgacagaagtcaaaggatatactaagggcggtcctgggcatgaggaacccattccgatggcgacctacggatggaacctcgtgaaattacactcaggcaaggacgtcttctttatcccacctgagaagtgtgatacactgctttgcgacattggcgagagctcgcccaatccaacgatcgaagaggggcgcaccctgcgagtgctaaaaatggttgaaccctggctcagaggaaaccaattctgtattaagatcctgaatccttacatgccgtctgtagtggagactttggagcagatgcagaggaaacatggtggcatgctggtccggaaccccctcagtcgcaattccacacacgaaatgtattgggtgagctgcgggaccggaaacatagtttcagctgtgaatatgacttccagaatgcttctgaacaggtttacaatggcacaccgaaagccaacctacgagcgggatgtcgacttaggcgccggtacgcgtcatgtggctgtagaacctgaggtggccaacctggatattatcgggcagagaatcgaaaatattaaacacgagcataagtctacctggcactatgacgaggataacccctacaagacatgggcatatcatggaagctacgaagttaaacctagtggctccgccagctctatggtcaatggcgtggtgaagttgctcactaaaccatgggacgtcatacccatggttacccaaatcgctatgacagatactacccctttcgggcagcagcgcgtgtttaaggagaaagtagacacaaggaccccaaaggcgaagcggggaactgcccaaattatggaagtgacggcaaaatggctgtggggtttcctatcaagaaacaagaaaccccgcatctgtacaagggaggaatttacccgaaaggtccggagtaatgctgccattggcgcagtgttcgttgacgagaaccagtggaattccgccaaagaggctgtggaagatgagagattttgggaccttgtccacagggaacgcgagctgcacaagcaggggaagtgcgccacttgcgtgtataacatgatgggaaaacgtgaaaagaaactcggcgagttcggtaaggcgaaagggagccgggcaatctggtacatgtggctgggagccagattcttggagtttgaagctctgggcttcatgaatgaggatcattggttttctagggaaaactcgctctcaggcgtagagggggagggacttcacaagctgggttacatattacgcgacatcagcaaaattccgggcgggaatatgtatgccgatgacaccgcaggatgggatacacgaatcacggaagacgatctgcagaacgaggctaagattaccgacatcatggaacctgagcatgccttgctcgctaagtccatattcaaactgacttaccaaaataaggttgtgcgggtccagagaccagccaaaaacggcacagtgatggatgtgattagtaggcgcgaccagagaggttctgggcaggtcggaacctatggcctaaatacttttacaaacatggaagcacaacttatccggcagatggagagcgagggcatcttctccccctcagaactggagacccctaacctcgcggggagggttctggattggttggaaaagtacggagtggagcgtttaaaacgaatggccattagtggtgacgactgtgtagtgaagccaatagatgaccgctttgctacagccctgactgcactcaatgatatgggcaaggtcagaaaagacatcccccagtgggaaccgtctaaggggtggaacgattggcagcaagtgcctttctgcagccaccactttcatcagcttattatgaaagacggacgggagatcgttgtgccctgtaggaatcaggatgagctggtcggccgcgctagagtgtcccagggtgccgggtggtcactacgggaaaccgcatgcctgggaaagagctatgcccaaatgtggcagctcatgtacttccacaggcgagacttgcgtctggcggctaacgccatttgttctgcagtaccagttgattgggtgcctacgtccagaaccacatggagtatccatgcccaccatcagtggatgactaccgaggacatgcttagcgtctggaatcgcgtgtggatagaagagaacccctggatggaagataaaacacacatctcgtcctggggcgacgttccatatctgggcaagcgggaggaccaatggtgcgggtctctcattggattaactgctagggccacctgggcaacgaatatccaggtggctattaaccaggtcagacgcctgatcggtaatgagaactacttggattacatgacatcaatgaagcggtttaaaaatgaaagcgaccccgagggcgccctgtggtga

SEQ ID NO: 13929 - RNA, 9879 nt, synthetic construct
  misc_feature 1..9879: note = derived and/or modified CDS sequence (opt3) from DENV-1__GU131753__SS-prME
  source 1..9879: mol_type = other RNA
agcgtgaccatgctgctcatgcttatgcccacggcactggctttccacttgactacgagaggaggggaacctcatatgatcgtcaccaagcaggaaagggggaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttaccgcactgtttctggcccatgctattggcacgtctatcactcagaagggcattatcttcatactcttaatgctggtgacaccatcgatggccatgcgctgcgtcgggatcggatcaagagattttgtggagggtcttagcggcgcgacctgggtagacgttgtgttggagcacgggagttgtgtcactacaatggcaaaggataaacccaccctggacattgaactactcaagacggaggtgaccaaccctgccgtgctgaggaaactttgcatcgaagctaagatttccaatacaactaccgattctcggtgtccaacacaaggagaggccactctgatggaagaacaagacgcaaacttcgtctgccgccgaacctttgttgatagaggctggggtaatgggtgtggattgttcggcaaaggcagcctcatcacatgcgctaagtttaagtgcgtgaccaaactggaggggaagatagtacagtacgaaaacttaaaatattccgtgattgtcactgtgcacacgggagaccagcatcaagttggtaatgagtcaacagaacacggcaccactgccaccatcacaccccaggcgcctaccagtgagattcagctgactgactacggggccctcacacttgattgtagcccaaggacgggactggacttcaacgaaatggtgttgctaaccatgaaggagaaatcttggctggtccataagcagtggtttctcgatctgccgcttccctggacttccggcgcatcaacaagccaagagacctggaatcggcaggacctgttggtgacattcaaaactgctcacgccaagaagcaggaagtagttgtgctcggtagtcaagagggggctatgcacaccgccctgacgggcgcaaccgaaatccagacatctggaactaccacaatctttgccggccatttaaaatgccgtctgaagatggataaactaactctcaaggggatgtcctatgtcatgtgtaccgggtcgttcaaactggagaaggaagtggctgagacgcagcacggtacagtccttgtgcagattaagtacgagggcaccgacgcgccttgcaaaataccattctcgactcaagatgaaaagggggttacacagaacggacgcttgatcaccgcaaatcccattatcactgacaaagagaagcctgtgaacatagaagccgagccaccctttggcgagtcttatattgtaatcggtgctggggaaaaagccctgaagctctcctggttcaagaaaggctcaagtatcggaaagatgtttgaggcaaccgccagaggcgctaggcggatggccattctgggggatacagcatgggacttcggaagcatcggtggcgtctttacgtccattgggaaacttgtgcatcagatattcggaaccgcgtacggcgttctgttttctggtgtgagctggactatgaagatcgggattggcgtcttgctcacatggctgggattaaattcacgaagtacctccctgagcatgacatgtatcgctgtgggcctagtaactctctacctgggggtgatggttcaggccgattctggatgcgtcatcaactggaaaggccgcgaacttaagtgtggttcagggattttcgtgaccaatgaggtgcacacgtggacagaacaatataagtttcaggcagacagtccgaaaagattgagcgccgctataggaaaggcctgggaggagggcgtctgcggtatcaggtccgcaacccggctggaaaacattatgtggaaacagatctctaacgagctcaatcatattctgttagaaaacgacatgaagttcactgttgtggtgggcgatgtagtcgggatcctggctcagggcaagaagatgatacgccctcaacccatggagcacaaatactcgtggaaaagctggggcaaggccaagatcattggggcggacgtgcagaataccacatttatcattgatggaccaaacactcctgaatgtcccgacgatcagagagcctggaatatctgggaggttgaggactatggcttcggtatatttaccacaaacatttggcttaagatgagggattcctacacacaggtgtgcgaccaccgtttgatgtcagctgcaatcaaagatagtaaggccgtccatgctgacatggggtattggattgaatctgagaaaaatgaaacctggaagctcgcccgggcatccttcatcgaggtgaagacttgtatatggccaaaatcccacacactgtggtcaaacggagttctagaaagcgagatgatcattcccaagatctacggcggtcctatttctcaacataattatcgaccaggctacttcacccagactgcggggccgtggcacctgggaaaactcgagctggattttgacctttgcgaaggcacaaccgtggtagtcgatgagcactgcgggaacagaggaccctccttgaggacgactaccgtgacaggcaagatcatacatgaatggtgttgccgcagttgtaccctgcctccattacggttcaaaggtgaggacgggtgctggtacggaatggagattagacccgtgaaggaaaaggaggaaaatctcgtcaaaagcatggtttctgccggctccggtgaggtggactcatttagtctgggccttctgtgtatcagcatcatgattgaagaggtaatgaggtcgcgctggtcccgaaagatgttgatgactgggacactcgctgtgttcctgctactgatcatgggacagctcacctggaacgatctgattcggctttgcataatggtcggcgccaatgcatctgaccgtatggggatgggaacaacttatttggctctgatggccacctttaaaatgagacctatgttcgcagtgggcttactctttaggcgcctgacgagccgggaggttcttctgctaacaatcggtctctcactggtggccagtgtcgaattgccaaactccctggaggaattaggggatggactcgctatgggcattatgatcctgaaacttctgaccgacttccaatctcaccagttgtgggcgactctcctgagcctaacctttattaaaacaactctgtcccttcattacgcctggaagaccatggcaatggtgctctcaatcgttagcctgatacccttgtgtctgagtacgacatctcagaagaccacttggttaccggtgctcctgggctcccttgggtgcaaacctctgacaatgttcttgatcgctgagaataagatttggggaagaaaaagctggccactcaacgaaggtatcatggccgtcggcgtagtgtcgattctgctatcatctctgcttaagaacgatgttcccctcgccgggcctctgatcgctggaggcatgttgatagcatgttatgtgattagtggttccagcgccgacttatctctggagaaagcggctgaggtcagctgggaagaggaagccgagcactccggggcatcacataatatcctcgtggaagtacaggatgacggaaccatgaagatcaaagatgaggagagggacgatactctgacaattcttctgaaggccaccttgctagctgtgagtggcgtctaccccctgagcataccagcaacgctctttgtttggtatttctggcaaaagaaaaagcagcgatctggcgtgctgtgggacactccttcacccccagaagtggagcgcgccgtccttgatgacgggatctaccggattatgcagagaggattactgggtaggagccaggtgggcgttggggtatttcaagaaaacgtgttccacaccatgtggcacgtcacacgtggagcggtgctcatgtatcagggcaaacgcttggagccgagttgggctagcgttaagaaagacctgatctcctacggtgggggatggcggctccagggctcttggaataccggcgaggaagtgcaggtcattgccgtggagcctgggaagaaccccaagaatgtacaaacagcaccaggaactttcaaaacccccgaaggtgaggtcggcgccatcgctctggattttaagcctgggacgtcgggaagcccaatagtgaacagagaaggcaaaatcgttggtctttacgggaatggagtggtcacaacttcaggcacctatgtgtccgccattgcacaggctaaggccagtcaggagggccccctgcctgagatcgaagacgaggttttcaggaaacgaaacttgacaattatggatctacatccggggtctggaaagacccggcgctacctgccagcgatcgtgagagaagccatgaagaggaaactccggactttaatactggcacccacccgagtcgtggctagcgagatggccgaagctcttaagggtatgcctattagatatcaaacaacggcagtaaaatccgagcacactggcaaggagatcgtggacctgatgtgccatgccacctttacaatgcgcctcttgtcaccagttagggtccccaattacaacatgatcattatggatgaagcccacttcaccgacccttctagcatcgctgcgcgtgggtatataagtactcgggtgggaatgggcgaggcagccgctatttttatgacagccaccccgcccggttccgtggaagcattcccacagagcaatgccgtcatccaggatgaggaaagagacattcctgagaggtcttggaactcagggtacgagtggatcacggattttcccggaaaaactgtatggttcgtgccatccataaagagtggcaatgacattgctaactgtctgcgcaagaatggcaaacgagttatccagctcagcagaaagacatttgataccgaatatcagaagaccaagaacaacgactgggactacgtggtcactacagatatctcggagatgggggcgaatttccgggccgacagggtgattgatcctcgccgttgcctgaaacccgttatccttaaggacggaccagaaagagtgattctagcaggtccgatgcctgtcaccgtggcttctgccgcacagcggaggggccgcatagggcgaaaccataataaggagggagatcagtacatctatatgggccagcccctgaacaatgacgaggatcacgcccactggacagaagctaaaatgttgttagacaacattaatactccagagggtatcatccccgccctgtttgaacctgagagagaaaagtccgcggcaattgatggggagtaccggctcaggggcgaggcccgcaaaacgttcgtagaactgatgagaaggggagaccttccagtgtggctgagctataaggttgcttcagagggcttccaatacagtgatcggcgttggtgctttgacggggaacgcaacaatcaggtcctcgaggaaaacatggatgtggagatatggaccaaagagggagaacgaaagaaattgagacccaggtggctggacgcccggacatattctgaccctctagctctgcgcgagttcaaggaatttgcagccggtagaaggtccgtgagcggcgatctcatccttgagattgggaagctgccgcagcatttaactcagcgggctcaaaatgccttggacaacctggtcatgctccacaattcagaacagggaggccgagcatacagacatgcgatggaggagctgccagataccatcgaaacacttatgctgctcgccttgattgctgttctgaccggtggggtgactttattctttctaagtggccgcggactgggcaaaacgagcatcgggctcctttgtgtaaccgcctcctctgtgctgttgtggatggcaagcgtcgagccccactggatagctgcctccatcattctggagttctttctcatggtgctgcttatccctgagcccgacaggcagcggacaccacaggataaccaactcgcatatgttgtgattggactgttgttcatgatcctgactgtcgccgctaatgagatgggtttactagaaaccacaaagaaagacctgggcatagggcacgtagcggtggagaaccatcaccatgccaccatgctcgatgttgaccttcaccctgcatcagcttggactctgtacgccgtggccacaacgattatcacccccatgatgcgtcatactattgaaaacacaaccgcaaatatctctttgaccgctatagccaaccaggcggctatcctgatgggactcgataagggctggccaattagtaaaatggacatcggtgtccctctgcttgccttagggtgctacagccaggtgaatccgctgacactcactgcagccgtcttgatgctggtggctcactatgcaattatcggccccggactacaagccaaggcgacgagagaggctcagaagaggaccgccgcaggcataatgaaaaacccaacagttgatgggattgtggccatcgacctggatcctgtagtgtacgacgctaagtttgaaaaacagctcggacagatcatgcttctgattttgtgtactagccaaatcctgctcatgcgcaccacatgggccctgtgcgagtccataaccttagcaactggcccccttacgacactgtgggagggttctccagggaagttctggaataccactattgctgtctcaatggccaacatctttcggggaagctatctcgcgggcgccggtctagcattctccctgatgaaaagtttgggcgggggacgaagaggcaccggggctcagggagaaacactgggcgagaagtggaagaggcagctcaatcagctttctaaaagcgaatttaacatttacaagcgctcaggtatcatggaggttgaccggtccgaagccaaagaggggctgaagagaggagagactaccaaacacgcagtgagtcgtggcacagctaagttgaggtggttcgtcgaacggaatctggtgaagcctgagggtaaagtaatagatctcggctgtgggcgcggaggctggagctattactgcgccgggttaaagaaagtgacggaagttaagggatataccaaaggcggtcccgggcatgaggaaccgatcccaatggccacttacggatggaacctggtgaaacttcactctggcaaagacgtcttctttacacctcccgagaagtgtgataccctgctatgcgacattggcgagtcctcaccaaatcccactatcgaagaggggcgaacactcagagtgctgaagatggtcgaaccttggttgaggggaaaccaattctgtattaaaatcctgaatccgtacatgcccagcgtggttgagaccctcgagcagatgcagcggaagcatggtggcatgcttgtacgcaacccactgtcgagaaattctacgcacgaaatgtattgggtgagttgcgggaccggaaacattgtctccgcggtgaatatgacaagcaggatgttactgaaccgatttactatggctcaccggaaacctacctacgagaaggatgttgacttgggcgcaggtacacgtcatgtggccgtcgaacccgaggtggctaacctcgatatcatagggcagagaattgaaaatatcaaacacgagcataagtcaacttggcactatgacgaggataacccttacaagacctgggcctatcatggatcctacgaagtaaaaccatctggcagcgcaagttccatggtgaatggcgttgtcaagctgctaacaaaaccctgggacgtgatccctatggtgacccaaattgccatgactgatacgacaccattcgggcagcagcgcgtctttaaggagaaagttgacaccaggactcccaaggctaagcggggaaccgtgcaaataatggaagtaacagcgagatggctttggggtttcctgagccgcaacaaaaagccgaggatctgtacgcgagaggaatttacccggaaagtgagatctaatgccgcaattggcgctgtcttcgtggacgagaaccagtggaactcagccaaggaggcagttgaagatgagaggttttgggacctcgtgaaaaaggaacgcgagctgcacaagcaggggaaatgcgccacttgcgtctataacatgatgggaaagcgtgagaaaaagttgggcgagttcggtaaagctaaggggagtcgggccatctggtacatgtggctgggagcgagatttctcgagttcgaagcacttggctttatgaatgaggatcactggttctccagggaaaacagcctgtctggcgtggagggggagggattacataaactgggttacattttgcgcgacatctcgaagatacctggcgggaatatgtatgccgatgacacagctggatgggatacccgaatcactgaagacgatctccagaacgaggccaagattacagacatcatggaaccagagcacgcactgctagctacctcaattttcaaacttacataccaaaataaggtagttcgggtgcagagacccgccaaaaacggcactgtcatggatgtgatcagcaggcgcgaccagagaggttccggacaggtgggaacctatggcctgaatacgtttaccaacatggaagctcaactcatacggcagatggagagtgagggcattttcctgccttctgaattggagacaccaaacttagccgaaagggtctttgattggctggagaagtacggggttgaacgtctcaaacgaatggcaatcagcggagacgactgtgtggtaaagcccatcgatgaccgcttcgcgactgcccttaccgctctgaatgatatgggtaaggtgagaaaagacattccgcagtgggagccttccaagggctggaacgattggcagcaagtccccttttgctcacatcacttccaccagctaataatgaaagacgggcgggagatcgtggttccatgtaggaatcaggatgaactggtgggacgcgccagagtcagtcagggcgcaggttggtctctccgggagacagcttgcttgggaaagagctatgcccaaatgtggcagctgatgtactttcataggcgagaccttcgtctggcagccaacgcgatttgttccgctgtgcctgtagattgggttcccacttcaagaaccacgtggagcatccacgcccatcaccagtggatgacaaccgaagacatgctctctgtgtggaatcgcgtctggattgaggaaaacccatggatggaggataaaactcatgtgtccagttggggagacgttccctatttaggcaagcgggaggaccaatggtgcggcagcctgatcgggttgacagcaagggccacctgggcttcgaatatacaggtggccatcaaccaggtcagacgcctgattggaaatgaaaactacctcgattacatgacttccatgaagcggttcaaaaatgagggtgaccctgaaggcgcactttggtga

SEQ ID NO: 13930 - RNA, 9879 nt, synthetic construct
  misc_feature 1..9879: note = derived and/or modified CDS sequence (opt3) from DENV-1__GU131754__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagataagcctgtcaacatagaggccgaaccacccttcggcgagtcctatattgtgatcggtgctggggagaaagccttgaagctgtcatggtttaagaaaggcagtagcatcggaaagatgttcgaagcaaccgccagaggcgctaggcggatggccattctcggggacactgcatgggattttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgactcaggatgcgtcgttaactggaaaggccgcgagctgaagtgtggtagtgggatctttgtgacaaatgaagtgcacacttggaccgagcaatataagttccaggcagacagcccgaaaagactttccgccgctatcggaaaggcctgggaagagggcgtatgcggtattaggtctgcaacgcggttggagaacataatgtggaaacagatctcgaacgaactgaatcatattctcctggagaacgatatgaagtttacagtcgtggttggcgacgtggctgggatcttagcccagggaaaaaagatgattcgccctcaacccatggaatacaaatatagctggaagtcctggggcaaggcgaaaatcataggggccgatgtccagaataccactttcatcattgacggaccaaacacccctgagtgtcccgatgaccagagagcttggaatatctgggaagtggaggattacggctttggtattttcacaactaacatctggctgaagcttagggactcatatacccaggtttgcgatcaccgtttgatgagtgcagccataaaagactctaaggctgtgcacgccgatatggggtactggattgagagcgaaaaaaatgagacatggaagctcgcacgggcgtccttcatcgaagtaaagacgtgtatttggccaaaatcacataccctgtggagcaacggagtcctagagtctgaaatgatcatacccaagatctatggcggtcctatttcccaacacaattaccgaccaggctactttactcagacagccgggccgtggcatctgggaaaactcgagctggacttcgatctttgcgagggcaccactgtggtggtcgacgaacactgcgggaacagaggacccagtttgaggacaaccacggttactggcaagatcattcacgagtggtgttgccgcagctgtaccctgcctccattacggtttaaaggtgaagacgggtgctggtatggaatggagatcagacccgtgaaggagaaggaagagaatctcgtaaaatctatggtgtccgctggctcaggtgaagtcgatagtttcagcctgggccttctgtgtatatcgattatgatcgaggaagtgatgaggtcccgctggtctcgaaagatgttgatgacagggaccctcgccgtttttttcctgctaatcatgggacagctgacttggaacgacctcattcggctgtgcatcatggtgggcgcaaatgctagcgatcgtatggggatgggaacaacctaccttgccttgatggcaacatttaaaatgagacctatgttcgccgtcggcctgttatttaggcgcctcacttcacgggaggtgctgcttctgaccattggtctaagtctcgttgcttccgtggagctgccaaactctttggaagagctgggggacggattagcgatgggcataatgatcctcaagctgcttacggatttccaaagccatcagctgtgggccacattgctctccctgacctttattaaaactaccttctcactacactatgcatggaagacaatggctatggtcctgagcatcgtaagtctttttcccctctgtatgtctactacctcccagaagacgacatggctgccggtgttgctgggcagcttagggtgcaaacctctcaccatgttcctgattgccgaaaataagatctggggaagaaaatcgtggccacttaacgagggtataatggccgttggcatcgtgtcaattctgttgtctagtctcctgaagaacgacgtccccctagctgggcctctgatcgcaggaggcatgcttattgcctgttacgtgatctccggtagctctgcggatctcagcctggaaaaagctgccgaggtatcctgggaggaagaggcagaacattcaggggccagtcacaatatattggtggaggtccaggacgatggaactatgaagattaaagacgaagagagggatgacacattaaccatcctgctcaaggctactctgcttgcagttagcggcgtgtatcccctgtctatcccagccacattgttcgtgtggtacttttggcaaaagaaaaagcagcgatccggcgtcctatgggataccccttcacccccagaggtggaacgcgcggttctggacgacgggatttatcggataatgcagagaggactcctgggtaggagtcaggtaggcgtgggggtcttccaagagaacgtgtttcatacgatgtggcacgttactcgtggagctgtgcttatgtaccagggcaaacgcttagaaccgagctgggcctccgtcaagaaagatctgatctcttacggtgggggatggcggctccagggctcgtggaataccggcgaggaggtgcaggtaattgcagtcgaacctgggaagaaccccaagaatgtgcaaacagccccaggaaccttcaaaacaagcgagggtgaagttggcgctatcgccttggactttaagcccgggacttcaggatcccctattgtgaacagagagggcaaaatcgtcggtctgtatgggaatggagtggttaccacgagtggcacatacgtgtctgcaatagctcaggccaaggcgagccaggaaggcccactccccgagatcgaggatgaagtcttcaggaaacgaaacctgactattatggaccttcaccctgggtccggaaagacccggcgctatctgccggccatcgtgagagaggcaattaagaggaaattgcggacactaatcctggctccaacccgagtagtggcctcagaaatggctgaggcactcaagggtatgcccataagataccaaactaccgccgttaaatctgaacatacaggcaaggagattgtcgatttaatgtgccacgccacgtttactatgcgcctgcttagccctgtgagggtgccaaattataacatgatcatcatggacgaggctcatttcaccgatcccagttccattgcggcacgtgggtacatcagcacacgggtcggaatgggcgaagccgctgccatatttatgaccgcaactcctccgggttctgtagaggccttcccccagtcaaatgctgtgattcaggacgaagagagagatatcccagaaaggtcctggaacagtgggtatgagtggattacagactttcctggaaaaaccgtttggttcgtgcccagcatcaagtcgggcaatgatatagcgaactgtctgcgcaagaatggcaaacgagtcattcagctctctagaaagacgttcgacactgagtaccaaaaaacaaagaacaacgactgggattacgtggttaccaccgacatctccgaaatgggggccaattttcgggcagatagggtgatcgacccacgccgttgcttgaaacctgtcattctgaaggatggacccgagagagtgatcctcgctggtccaatgccggtaactgtggccagcgcagcccagcggaggggccgcattgggcgaaaccacaataaggaaggagaccagtatgtttacatgggccagcctctgaacaatgatgaggaccatgctcactggacagaggccaaaatgcttctagataacataaatacccccgaaggtatcattccagcgctgttcgagcccgaaagagagaagtcagcagccatcgacggggaatatcggttgaggggcgaggctcgcaaaacatttgtcgagttaatgagaaggggagatctgcctgtgtggctcagttacaaggtggcctctgaaggcttccaatattccgaccggcgttggtgctttgatggggagcgcaacaatcaggtcctggaagagaacatggacgttgaaatctggactaaagagggagagcgaaagaaacttagaccaaggtggctggacgctcggacgtacagcgatcccctcgcattgcgcgaattcaaggagtttgccgctggtagaaggtcagtgagtggcgacctgattctagaaatagggaagctgcctcagcacctcacccagcgggcccaaaatgcacttgataacctggtaatgttacataatagcgagcagggaggccgagcgtatagacacgccatggaagagttgccggacacaatcgagactctgatgctcctggctcttattgccgtgctgaccggtggggtcacactcttctttttgtccggccgcggactgggcaaaacctctatcgggttactatgtgtgatggcaagctccgctctgctctggatggcctcagttgaaccacattggattgcagcctctatcatacttgagttctttctgatggtgttgctgatccccgaacctgataggcagcggactccccaggacaaccaactcgcttacgtcgtaattggactgcttttcatgatcctcacggtggcggccaatgagatgggtctgttggagaccacaaagaaagatctgggcattgggcacgttgcagtggaaaaccaccatcacgctgccatgttagacgtcgatctacatccagccagtgcatggactctgtacgctgtggccaccacaatcataacccctatgatgcgtcacactattgagaacacaacggcgaatatctcgctcaccgctattgccaaccaggcagccatccttatgggactggacaagggctggcccataagcaaaatggatatcggtgtcccattgctggctctcgggtgctattcccaggtgaatcctctgactcttacagcagccgttttaatgctggtggcgcattacgctattatcggcccgggactccaagccaaggcaaccagagaagcccagaagaggaccgctgccggcattatgaaaaaccccacagtagacgggatcgtggcaatagatttggacccagtcgtttatgacgctaagtttgagaaacagctgggacagattatgctactgatcctctgtacttctcaaatccttctgatgcgcacgacctgggccttgtgcgaatcaattacactggcgactggccctctcaccacactgtgggagggtagccccgggaagttctggaataccactatcgccgtgtccatggcaaacatattccggggaagttacttagctggcgccggtcttgcattttctctgatgaaaagcctcggcgggggacgaagaggcacgggggctcagggagagacactaggcgaaaagtggaagaggcagctgaatcagttgtcaaaatccgagttcaacacctataagcgcagtggtattatggaagtcgatcggagcgaggccaaagaagggctgaagagaggagagactaccaaacacgccgtgtctcgtggcacagcgaagctcaggtggtttgtagagcggaatcttgtgaagccagaaggtaaagttatcgacctgggctgtgggcgcggaggctggtcctactattgcgctgggttgaagaaagtgactgaggtcaagggatacaccaaaggcggtcctgggcacgaagagcccattccgatggcaacatacggatggaacctggtgaagctccattcaggcaaagatgtcttctttatcccacctgaaaagtgtgacacgttactgtgcgatataggcgagagctcgcccaatccaaccatcgaggaagggcgaactcttagagtgctgaagatggttgagccctggctaaggggaaaccaattctgtattaaaatcctcaatccttatatgccgtctgtagtggaaacactggagcagatgcagcggaagcacggtggcatgttggtccgcaaccccctgagtagaaattccacccatgagatgtactgggtgagctgcgggactggaaacattgtttcagccgtgaatatgacatccaggatgctccttaaccgatttaccatggctcaccggaaaccaacgtatgaacgtgacgtcgatctgggcgccggtaccagacacgtggcagtagagcctgaagtggccaacttagacatcattgggcagcgcatcgagaatataaagcatgaacacaaatctacatggcattacgatgaggacaacccctataagacttgggcttaccacggaagctatgaggttaagcctagtggctccgcgagctctatggtcaatggcgtggtgaaactgttgaccaagccatgggatgtcattcccatggttacacaaatcgccatgactgacaccacacctttcgggcagcagagggtgtttaaagaaaaggtagacacccggactccaaaagcaaagagaggaacggctcaaatcatggaggtgacagccaagtggctctggggtttcctgtcacgcaacaaaaagcccaggatttgtacccgagaagagtttactcggaaagtcagaagtaatgcagccataggcgctgtgttcgttgatgaaaaccagtggaattccgccaaggaggcggtggaggacgaaaggttttgggatctagtccatcgcgagcgtgaacttcacaaacaggggaagtgcgcaacctgcgtgtacaacatgatgggaaagcgggagaaaaagctgggcgaattcggtaaagccaaggggagcagagctatctggtacatgtggctcggagccaggttcctggagtttgaggcattgggcttcatgaatgaagaccactggttttctcgcgagaactcgctgtcaggcgtagaaggggagggactccataaacttggttatattctgcgagatatcagcaagattccgggcgggaatatgtacgctgacgatacagccggatgggacacgcggatcaccgaggatgacttacagaacgaagctaaaataactgatatcatggagcctgaacacgccctgttggcaaagtccattttcaagctcacatatcaaaataaagttgtgagagtccagaggccagcgaagaacggcaccgtgatggacgtgatcagtcgcagagatcagcggggttctgggcaggtcggaacttacggcctgaatacatttaccaacatggaggcccaactaattaggcagatggaaagcgagggcatcttctccccctcagagcttgaaacacctaacctggctgggcgtgttctcgactggctggagaaacatggagtggaacgattgaagcgcatggccataagtggtgacgattgtgtagtgaaaccaattgacgatagatttgcaactgctttaaccgccctgaatgacatgggcaaggtccggaaggatatcccccagtgggagccgtctaaagggtggaacgactggcagcaagtgcctttctgcagccaccactttcatcagctcatcatgaaggatggaagggaaattgttgtgccctgtcgcaatcaggacgagcttgtcggcagagcacgggtgtcccagggtgccgggtggtcactgagggagacggcgtgcctaggaaaaagctatgctcaaatgtggcagctgatgtacttccaccgacgtgatctcagattggccgcaaacgccatatgttctgctgtaccagttgactgggtgcctacctcccgcacaacttggagtatccatgcccaccatcagtggatgaccacagaagatatgctgagcgtctggaatcgggtgtggattgaggaaaacccctggatggaggacaagactcacatctcgtcctggggcgacgttccatatcttggcaaaagggaagatcaatggtgcgggtctctgattggactcaccgcaagagctacgtgggccacaaatatccaggtggcgataaaccaggtccgccggttaatcggtaatgagaactacctggactacatgacctcaatgaagaggtttaagaatgagagcgatcccgaaggcgctttgtggtga

SEQ ID NO: 13931 - RNA, 9879 nt, synthetic construct
  misc_feature 1..9879: note = derived and/or modified CDS sequence (opt3) from DENV-1__GU131755__SS-prME
  source 1..9879: mol_type = other RNA
agcgtgaccatgctgctcatgcttatgcccaccgccctggctttccacttgactacgagaggcggggaacctcatatgatcgtctccaagcaggaaaggggaaagtctttactgtttaagacctcagccggtgttaatatgtgcacgctaattgccatggacctcggcgaactgtgtgaagatactatgacctacaagtgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctccgcgggatgtcctatgtgatgtgtaccgggagcttcaagctggagaaagaagtcgccgagacgcagcacggtacagtgcttgttcagataaagtacgagggcaccgacgctccttgcaagatcccattctcgactcaagatgaaaaaggggtgacacagaacggaagattgattaccgcgaatcccatcgtaactgacaaggagaaacctgtcaacatagaagcagagccaccctttggcgagtcttatattgtgatcggtgccggggaaaaggctctgaaactctcctggttcaagaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagtacaagtattcgtggaaaagctggggcaaggccaagataatcggggcggacgtgcagaataccacatttattatcgatggaccaaacactcctgaatgtcccgacgatcagagggcctggaatatttgggaggtcgaggactacggcttcggtatctttaccacaaacatatggcttaaattgcgtgattcctatacacaggtgtgcgaccaccggctcatgtcagctgcaattaaggatagtaaagccgttcacgctgacatggggtactggatcgaatctgagaagaatgaaacctggaaactggcccgagcatccttcattgaggtgaagacttgtatctggccaaagtcccatacactatggtcaaacggagtactggaaagcgagatgataatccccaaaatttatggcggtcctatctctcaacacaattacagaccaggctacttcacccagactgcggggccgtggcatctcggaaagctggagcttgattttgacttgtgcgaaggcacaaccgtcgtggtggatgagcactgcgggaacaggggaccctccctgcgcacgactaccgtcacaggcaaaattatccacgaatggtgttgccggagttgtaccttacctccactcagattcaggggtgaggacgggtgctggtatggaatggagatacgccccgttaaggaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattatgggacagctcacctggaacgatctgatcagactttgcattatggttggcgccaatgcatctgacaggatggggatgggaacaacttacttggctctgatggccaccttcaaaatacgccctatgtttgcagtgggcttactcttccggagactgacgagcagggaggtccttctgctaacaatcggtctctcactggtggccagtgttgaattgccaaactccctggaggaattaggggatggactcgctatgggcattatgatcctgaaacttctgaccgactttcaatctcatcagttgtgggcgactctcctgagcctaaccttcattaaaacaactttttccctgcactgtgcctggaagaccatggcaatggtgctttcaatcgtcagcctcttccccctgtgcttgagtacgacatctcagaaaaccacttggctgccggtattactcggctccctggggtgtaagcctcttacaatgtttctgatagctgagaataagatctggggacgacgcagctggccattgaacgaaggtattatggccgtgggcatcgtttcgattctcctgtcatctctactgaaaaacgatgtgccccttgccgggcctctcatcgctggaggcatgctgatagcatgctatgtcattagtggttccagcgccgacttgtctttagagaaggcggctgaggtgagctgggaagaggaagccgagcattccggggcatcacacaatatcctggtagaagtgcaggatgacggaaccatgaaaatcaaggatgaggagcgggacgatactctcacaattctgcttaaagccaccctgttggctgtcagtggcgtttaccccctaagcataccagcaacgctgttcgtgtggtatttctggcaaaagaaaaagcagagatctggcgtgctctgggacactccttcacccccagaagtcgagagggccgtgctggatgacgggatctaccgtattatgcagcgcggacttttaggtcggagccaggttggcgtaggggtgtttcaagaaaacgtcttccataccatgtggcacgtgacaagaggagcggttctgatgtatcagggcaagaggctcgagccgagttgggctagcgtgaaaaaggacttgatctcctacggtgggggatggcgactgcagggctcttggaataccggcgaggaagtccaggtgattgccgtagagcctgggaaaaaccccaagaatgtccaaacagcaccaggaacttttaaaacccccgaaggtgaggtgggcgccatcgctctcgatttcaagcctgggacgtcgggaagcccaatagttaaccgggaaggcaagatcgtgggtctgtacgggaatggagtcgtgacaacttcaggcacctatgtttccgccattgcacaggctaaagccagtcaggagggcccccttcctgagatcgaagacgaggtgtttcgcaagagaaacctgacaattatggatttgcacccggggtctggaaaaaccaggcggtacctaccagcgatcgtccgagaagccataaagagaaaactgcgcactctcattttagcacccaccagggtggtagctagcgagatggccgaagctctgaagggtatgcctatccgttatcaaacaacggcagtgaagtccgagcatactggcaaagagatcgttgaccttatgtgtcacgccaccttcacaatgcggctgctctcaccagtcagagtgcccaattacaacatgattatcatggatgaagcccattttaccgacccttctagcatagctgcgagggggtatattagtactcgcgtgggaatgggcgaggcagccgctatcttcatgacagccaccccgcccggttccgtcgaagcatttccacagagcaatgccgtaattcaggatgaggaacgagacatccctgagagatcttggaactcagggtacgagtggataacggatttccccggaaagactgtgtggtttgttccatccattaaaagtggcaatgacatcgctaactgcttgcggaagaatggcaaaagggtgatccagctgagccgcaagacattcgataccgaatatcaaaagaccaaaaacaacgactgggactacgtcgtgactacagatatttcggagatgggggcgaatttccgtgccgacagagttatcgatcctcggaggtgcctcaagcccgtgattctgaaagacggaccagaacgcgtcatacttgcaggtccgatgcctgtgaccgtagcttctgccgcacagcgaagaggccggatcgggaggaaccacaataaggagggagatcagtacatttatatgggccagcccctaaacaatgacgaggatcatgcccactggacagaagctaaaatgctgttggacaacatcaatactccagagggtatcattcccgccttatttgaacctgagcgcgaaaagtccgcggcaatagatggggagtacagactgaggggcgaggcccggaagacgttcgtggaactcatgcgtcgcggagacctgccagtttggcttagctataaagtcgcttcagagggctttcaatacagtgatcgaagatggtgtttcgacggggaaaggaacaatcaggtgctggaggaaaacatggatgtggagatctggaccaaggagggagaacggaaaaagctccgccccagatggttggacgccaggacatattctgaccctctggctctacgggagtttaaagagttcgcagccggtcgaagatccgtcagcggcgatctgattctcgagatcgggaaacttccgcagcacctgactcagcgcgctcaaaatgccttagacaacttggttatgctgcataattcagaacagggaggcagggcataccggcacgcgatggaggagctcccagataccattgaaacactgatgcttctggccctcatcgctgtgttgaccggtggggtaactctgtttttcttaagtggccgtggactaggcaaaacgagcatagggctgctctgcgtgatggcctcctctgtccttctgtggatggcaagcgtggagccccattggatcgctgcctccattatcttggaatttttcctgatggttctcctgattcctgagcccgacaagcagagaaccccacaggataaccaacttgcatatgtggtcatcggactcctgtttatgatattgacagtagccgctaatgagatgggtctgttagaaactaccaagaaagacctaggcattgggcacgtggcggttgagaaccaccatcacgccgcaatgctggatgtggacctccatcctgcttcagcctggacactttacgccgtcgcaaccactatcattacacccatgatgaggcacacgatcgaaaacaccactgctaatatatctctgacagccatcgcgaaccaggctgccattttgatgggactggataagggctggccaatcagtaaaatggacattggtgtgcctctcctggcacttgggtgttactcgcaggtcaatccgttaaccctgaccgccgctgtgctcatgttggttgcacattatgccatcataggccccggactgcaagcgaaggctacacgcgaggcccagaaacggactgcagccggcattatgaagaacccaacggtggatgggatcgtagctatcgacctagatcctgtggtctacgacgccaagttcgaaaaacagctgggacagattatgctccttatcctgtgcaccagccaaatattgctgatgcgaacaacttgggcactctgtgagtccattaccctggctacaggccccttaaccactctttgggagggttctccagggaagttttggaatacgacaatcgccgtttcaatggcgaacattttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtatcatggaggtggaccgttccgaagcaaaagaggggcttaagaggggagagacaactaaacacgctgtcagtcggggcaccgccaagctgcgctggttcgtggaacgaaatttggtaaaacctgagggtaaggtgatagatctgggctgcgggagaggaggctggagctattactgtgccgggctcaagaaagttacagaagtgaagggatatacgaaaggcggtcccgggcacgaggaaccgatcccaatggcgacctacggatggaacttagtcaagctgcattctggcaaagacgtgtttttcattcctcccgagaagtgcgatactcttctgtgtgacatcggcgagtcctcaccaaatcccacaattgaagaggggaggaccctacgggtcctcaaaatggtggaaccttggctgcgcggaaaccaattttgcatcaagattttgaatccgtacatgcccagcgttgtagagactctggagcagatgcagagaaagcacggtggcatgctcgtgaggaacccactttcgcgaaattctacacatgaaatgtattgggtcagttgtgggaccggaaacatcgtgtccgctgttaatatgacgagccggatgctgttaaaccgtttcaccatggcacacagaaaacctacatacgagcgcgatgtggacctgggcgccggtactaggcacgtcgctgtggaacccgaggtagccaacttggatataattgggcagcggatcgaaaatatcaagcatgagcacaaatcaacctggcattatgacgaggataacccttacaagacatgggcatatcacggatcctacgaagtgaaaccatctggcagcgccagttccatggttaatggcgtcgtgaagctcctgactaagccctgggacgtgattcctatggtcacccaaatagctatgacagataccactccatttgggcagcagagagttttcaaagagaaggtggacacgcgcacacccaaagcgaagaggggaaccgcccaaatcatggaagtaactgcaaaatggctatggggttttcttagccgaaacaagaagccgcggatttgcaccagagaggagttcacaaggaaagtgcgctctaatgctgccatcggcgcagtctttattgacgagaaccagtggaactcagccaaggaggctgtggaagatgagcgtttctgggacctggttcatcgggaaagagagctccacaaacaggggaagtgcgccacgtgtgtgtataacatgatgggaaaaagggaaaagaagctgggcgagtttggtaaagcgaaggggagtcgcgcaatctggtacatgtggttgggagcccgattcctggagttcgaagctctcggctttatgaatgaggatcactggttctcccgggaaaacagcctttctggcgtcgagggggagggactgcataaattaggttacatactgagagacatctcgaagattcctggcgggaatatgtatgccgatgacaccgcaggatgggatactaggatcacagaagacgatttgcagaacgaggctcgcattaccgacatcatggaaccagagcacgccctcctggctaaatcaatatttaagctaacttaccaaaataaagtggtaagagttcagcggcccgccaagaacggcacagtgatggatgtcattagcaggcgtgaccagcgaggttccggacaggtgggaacctatggccttaatacattcactaacatggaagcacaactgatccgccagatggagagtgagggcatcttttctcctagcgaactcgagaccccaaacctggcggaaagagtgttggattggttagagaagtacggggtcgaacggctgaaaaggatggccatttccggagacgactgcgttgtgaagcccatagatgaccgcttcgctacggccctcaccgcacttaatgatatgggtaaagtaagaaaggacatcccgcagtgggagccttcaaaaggctggaacgattggcagcaagtgcccttttgtagtcatcacttccaccagctgattatgaaggacgggcgggagatcgtcgtgccatgcaggaatcaggatgagctagttggacgagctcgtgtgtctcagggcgccggttggagcctgagagagacagcatgtctcgggaagtcctatgcccaaatgtggcagttgatgtactttcatcgccgggacctgaggcttgcggctaacgccatttgctcagcagtccctgtggattggatccccactagcagaaccacatggtctatacacgcccatcaccagtggatgactaccgaagacatgctgtccgtatggaatcgcgtttggatcgaggaaaacccatggatggaggataaaacgcatattagtagctggggagacgtgccctatctcggcaagcgggaggaccaatggtgtggctcgttaatcgggctgacagctagggccacctgggcaactaatattcaggtcgctatcaaccaggtgcgaagattgattggaaatgaaaactacctggattacatgacatccatgaaacggttcaagaatgagtctgaccctgaaggtgccctctggtga

SEQ ID NO: 13932 - RNA, 9879 nt, synthetic construct
  misc_feature 1..9879: note = derived and/or modified CDS sequence (opt3) from DENV-1__GU131756__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgcattctttctactgattatgggacagctcacttggaacgatctgatccggctttgcattatggtgggcgctaatgccagcgaccgtatggggatgggaacaacctacttggcactgatggccacattcaaaatgagacctatgtttgctgttggcttactcttcaggcgcctgacttcacgggaggtgcttctgctaaccataggtctcagtctggtcgcgtccgtggaattgccaaactctctggaggaattaggggatggactcgccatgggcatcatgattctgaagcttctgacggactttcaaagccatcagttgtgggcaacactcctgtccctaaccttcatcagaactaccttttcactgcactatgcttggaaaacaatggccatggttcttagcattgtgagtctcttccccctgtgtttgtctactacctcccagaagacgacatggctgccggtcttactcggcagcctggggtgcaagcctcttaccatgtttctgatcgccgagaataaaatatggggaaggaagtcgtggccattgaacgaaggtatcatggctgtaggcattgtgtcaatcctcctgtctagtctactgaaaaacgatgttccccttgcagggcctctcattgccggaggcatgctgatcgcgtgttacgtgatatccggtagctctgctgacttgagcttagagaaggccgcagtcgtgtcctgggaggaagaggccgaacattcaggggctagtcacaatattctggtagaggtgcaggatgacggaactatgaaaatcaaggatgaagagcgagacgatacactcaccatcctgcttaaagcaactctgttggccgtcagcggcgtttatcccctatctattccagcgacactgttcgtgtggtacttctggcaaaagaagaaacagcgctccggcgtgctctgggacaccccttcacccccagaggtcgaacgggctgtgctggatgacgggatatatagaatcatgcagaggggacttttaggtcgtagtcaggttggcgtaggggtgtttcaagagaacgtcttccatacgatgtggcacgtgactcgcggagccgttctgatgtaccagggcaagcggctcgaaccgagctgggcatccgtgaaaaaggacttgatttcttacggtgggggatggagactgcagggctcgtggaataccggcgaggaggtccaggtgatcgccgtagaacctgggaaaaaccccaagaatgtccaaacagctccaggaacctttaagacaagcgagggtgaagtgggcgccattgcactcgatttcaaacccgggacttcaggatcccctatcgttaacagggagggcaagatagtgggtctgtatgggaatggagtcgtgaccacgagtggcacatacgtttctgctatcgcccaggcgaaagccagccaggaaggcccacttcccgagattgaggacgaagtgtttcgaaagcggaacctgactatcatggatttgcaccctgggtccggaaaaacccgcagatatctaccggcaattgtcagggaggctatcaagcggaagctgcgaacactcatattagccccaaccagagtggtagcttcagaaatggcagaggccctgaaaggtatgcccattcgctaccaaactaccgccgtgaagtctgaacatacaggcaaagagatcgttgaccttatgtgccacgctacgttcactatgaggctgctcagccctgtccgtgtgccaaattataacatgatcattatggatgaggcgcattttaccgaccccagttccatcgcagcccgggggtacataagcacaagagtgggaatgggcgaagctgccgcaattttcatgaccgccactcctccgggttctgtcgaggcttttccccagtcaaatgcggtaatccaggatgaagagagggacattccagaacgctcctggaacagtgggtatgagtggatcacagatttccctggaaagaccgtgtggtttgttcccagcataaaatcgggcaatgacattgccaactgtttgcgaaagaatggcaagagagtgatccagctgtctcggaaaacgttcgatactgagtaccaaaagacaaaaaacaacgactgggactacgtcgtgaccaccgatatctccgaaatgggggcaaatttcagggctgaccgcgttattgatccacgtagatgcctcaagcctgtgatcctgaaagacggacccgagcgggtcattcttgccggtccaatgccggtgactgtagcaagcgccgctcagaggcgcggccgaatagggagaaaccacaataaggaaggagatcagtatatctacatgggccagcctctaaacaatgacgaggatcatgcccactggacagaggcgaagatgctgttggacaacattaatacccccgaaggtatcatcccagcattatttgagcccgaacgggagaaatcagccgctattgatggggaatataggctgcgcggcgaggccagaaagacattcgtggagctcatgaggcggggagacctgcctgtttggcttagttacaaagtcgcttctgaaggctttcaatattccgatcgtcgctggtgcttcgacggggagcgaaacaatcaggtgctggaagagaacatggatgtggaaatatggactaaggagggagagagaaaaaagctcaggccacggtggttggacgcacgcacgtacagcgaccccctggccctaagagaatttaaagagttcgctgccggtaggcggtcagtcagtggcgatctgatcctcgaaattgggaagcttcctcagcacctgacccagcgagcacaaaatgcgttagacaacttggttatgctgcataatagcgagcagggaggcagagcctatcgccacgctatggaagagctcccggatacaatcgagactctgatgcttctggccctcattgcagtgttgaccggtggggtaacactgtttttcttatccggcaggggactaggcaagacctctatcgggctgctctgtgtgatggctagctccgtccttctgtggatggcctcagtggaaccacattggatagcagcctctatcattttggagtttttcctgatggttctcctgatccccgaacctgaccggcagcgtactccccaggataaccaacttgcttacgtggtcattggactcctgtttatgatcttgacggtagcggccaatgagatgggtctgttagagaccacaaaaaaggacctaggcatagggcacgtggcagttgaaaaccaccatcacgctgccatgctggatgtggacctccatccagccagtgcatggactctttacgctgtcgccaccacaattatcacccctatgatgagacacactattgagaacacaacggcgaatatctcgctgaccgctatagccaaccaggcagccatcttgatgggactggataaaggctggcccattagcaagatggacatcggtgtgccactcctggctcttgggtgctattcccaggtcaatcctttaactctgacagcagccgtgctcatgttggttgcgcattacgctattatcggcccgggactgcaagccaaagcaaccagggaagcccagaagcgcaccgctgccggcataatgaagaaccccacagtggatgggattgtagcaatcgacctagatccagtggtctatgacgctaaattcgagaagcagctgggacagatcatgctccttattctgtgtacttctcaaatcttgctgatgcggacgacctgggccctctgcgaatcaataacactggcgactggccctttaaccacactttgggagggtagccccgggaaattttggaataccactattgccgtttccatggcaaacatcttccgaggaagttacctggctggcgccggtctcgcattctctctaatgaagagcctgggcgggggaagaaggggcacgggggctcagggagagacattgggcgaaaaatggaagcgccagctgaatcagctctcaaagtccgagtttaacacctataaacggagtggtattatggaagtggacagaagcgaggccaaggaagggcttaaacgtggagagactaccaagcacgccgtctctaggggcacagcgaaactgcggtggttcgtggagcgcaatttggtaaagccagaaggtaaggtgatcgatctgggctgtgggcgaggaggctggtcctactattgcgctgggctcaaaaaggttactgaggtgaaaggatacaccaagggcggtcctgggcacgaagagcccataccgatggcaacatacggatggaacttagtcaaactgcattcaggcaaggacgtgtttttcatcccacctgaaaaatgtgatacgcttctgtgcgacattggcgagagctcgcccaatccaaccatcgaggaagggagaactctaagggtcctcaagatggtggagccctggctgcggggaaaccaattttgtattaagatcttgaatccttatatgccgtctgttgtagaaacactggagcagatgcagcgcaaacacggtggcatgctcgtgagaaacccccttagtaggaattccacccatgagatgtactgggtcagctgcgggactggaaacattgtgtcagccgttaatatgacatcccgaatgctgttaaaccggttcaccatggctcaccgtaagccaacgtatgaaagagatgtggacctgggcgccggtacccgccacgtcgcagtggagcctgaagtagccaacttggatatcatagggcagaggattgagaatatcaaacatgaacacaagtctacatggcattacgacgaggataacccctataaaacttgggcttaccacggaagctatgaggtgaagcctagtggctccgcgagctctatggttaatggcgtcgtgaagctcctgaccaaaccatgggacgtgatccccatggtcacacaaattgccatgactgataccacaccttttgggcagcagcgggttttcaaggaaaaagtggacaccagaactccaaaggcaaaacgcggaacggctcaaataatggaggtaacagccaagtggctatggggttttctttcaaggaacaagaaaccccgaatctgtacccgggaagagttcactagaaaggtgaggagtaatgcagccattggcgctgtctttgtggacgaaaaccagtggaattccgccaaagaggcggttgaggatgaacgcttctgggacctggtgcatcgtgagcgggaactccacaagcaggggaaatgcgcaacctgcgtctacaacatgatgggaaagagagagaagaaactgggcgaatttggtaaggccaaagggagcagggctatctggtacatgtggttgggagcccgcttcctggagttcgaggcactcggctttatgaatgaagatcactggttctctcgagagaactcgctttcaggcgtggaaggggagggactgcataagttaggttatattctgcgggacatcagcaaaataccgggcgggaatatgtacgctgatgacacagccggatgggatacgagaatcaccgaggacgatttgcagaacgaagctaagattactgacatcatggagcctgaacacgccctcctggcaaaatccatttttaagctaacatatcaaaataaggtagttagggtgcagcgcccagcgaaaaacggcaccgtcatggatgtgatcagtagacgggaccagaggggttctgggcaggtgggaacttacggccttaatacattcaccaacatggaggcccaactgatacgtcagatggaaagcgagggcattttttccccctcagagctcgaaacacctaacctggctgggcgagtcttggattggttagagaagcatggagttgaacgcctgaaaagaatggccatcagtggtgacgactgtgtggtaaagccaatcgatgaccggttcgcaactgctctcaccgcccttaatgatatgggcaaagtgaggaaggacattccccagtgggagccgtctaaggggtggaacgattggcagcaagtccctttttgcagccaccacttccatcagctgataatgaaagacggacgcgaaatcgtggttccctgtagaaatcaggatgagctagtgggccgggcaagggtctcccagggtgccgggtggtcactgcgagagacggcgtgcctcggaaagagctatgctcaaatgtggcagttgatgtactttcaccgtagagacctgcgccttgccgcaaacgccatttgttctgctgtgccagtagattgggttcctacctcccggacaacttggagtatccatgcccaccatcagtggatgaccacagaagacatgctgagcgtgtggaatagggtctggattgaggaaaacccctggatggaggataaaactcacatctcgtcctggggcgacgtgccatatctcggcaagagagaagaccaatggtgcgggtctttaataggactgaccgcacgcgctacgtgggccacaaatatccaggttgcgattaaccaggtgcggaggttgctgggtaatgagaactacctcgattacatgacctcaatgaaacgattcaagaatgagagcgaccccgaaggcgctctttggtga

SEQ ID NO: 13933 - RNA, 9879 nt, synthetic construct
  misc_feature 1..9879: note = derived and/or modified CDS sequence (opt3) from DENV-1__GU131758__SS-prME
  source 1..9879: mol_type = other RNA
agcgtgaccatgctgctcatgcttatgcccaccgcactggctttccacttgactacgagaggcggggaacctcatatgatcgtctccaagcaggaaaggggaaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgtgccttgcaagataccattttctacccaggatgaaaaaggggtaactcaaaacggacgccttatcacagcgaatcccattgtcaccgacaaggagaaacctgtgaacatcgaagcagagccacccttcggcgagtcctatatagttattggtgccggggaaaaggctttgaagctgtcatggtttaaaaagggcagtagcatcggaaaaatgttcgaggccactgcaagaggcgccaggcggatggctatcctcggggataccgcctgggactttggatccattggtggcgtgttcacatctgtcgggaagctggtgcatcagatctttggaacggcatacggcgtacttttcagcggtgtgtcatggaccatgaaaattgggataggcgttctgttgacttggctcggactgaatagtcgatccactagcttatctatgacctgtatcgcggtcggcctggtgacactatacctcggggtgatggtccaggctgattcaggatgcgttattaactggaagggccgcgaactgaagtgtggtagtgggatctttgtgactaatgaggtgcacacctggacggaacagtataaattccaagccgacagcccgaagagactttccgcagccatcggaaaggcttgggaggagggcgtatgcggtattaggtctgccacacggttggaaaacataatgtggaagcagatctcgaacgagctgaatcatattctcctggaaaacgacatgaaatttaccgtcgtggttggcgatgtggcagggatcttagctcagggaaagaaaatgattcgccctcagcccatggagtacaagtatagctggaagtcctggggcaaagccaagatcataggggcggacgtccaaaatactaccttcatcattgatggaccaaacacacctgaatgtcccgacgatcagagagcctggaatatctgggaggtggaggactacggctttggtattttcactaccaacatctggctgaaacttagggattcatatacacaggtttgcgaccaccgtttgatgagtgctgcaataaaggattctaaagccgtgcacgctgacatggggtactggattgaaagcgagaagaatgaaacgtggaagctcgcccgggcatccttcatcgaggtaaaaacctgtatttggccaaagtcacatactctgtggagcaacggagtcctagaatctgagatgatcatacccaaaatctatggcggtcctatttcccagcacaattaccgaccaggctactttacacaaaccgcggggccgtggcatctgggaaagctcgagctggatttcgacctttgcgaaggcactacagtggtggtcgatgagcactgcgggaacagaggacccagtttgaggaccacgactgttaccggcaaaatcattcacgaatggtgttgccgcagctgtacactgcctccattacggtttaagggtgaggacgggtgctggtatggaatggagatcagacccgtgaaggaaaaagaggaaaatctcgtaaagtctatggtgtccgccggctcaggtgaggtcgacagtttcagcctgggccttctgtgtatatcgattatgatcgaagaggtgatgaggtcccgctggtctcgaaaaatgttgatgaccgggactctcgctgtatttttcctgctaatcatgggacagctgacatggaacgatctcattcggctgtgcatcatggtgggcgccaatgcaagcgaccgtatggggatgggaaccacataccttgctttgatggccacttttaagatgagacctatgttcgcagtcggcctgttatttaggcgcctcacctcacgggaggtgctgcttctgacgattggtctaagtctcgttgcctccgtggaactgccaaactctttggaggaactgggggatggattagctatgggcataatgatcctcaaactgcttacagacttccagagccatcaactgtgggcgaccttgctctcctttactttcattaagaccacattttcactgcactatgcctggaagactatggcaatggtcctaagcatcgtaagtctgttccccctttgtctctctaccacgtcccagaaaacaacctggctgccggtgttgctgggcagcttagggtgcaagcctctcactatgttcctgattgctgagaataaagtttggggaagaaagtcgtggccacttaacgaaggtatcatggccgtgggcatagtctcaatcctgttgtctagtctcctgaaaaacgatgtgcccctagccgggcctctgattgctggaggcatgcttatcgcatgttacgtaatttccggtagctctgccgacctcagcctggagaaggcggctgaggtgtcctgggaagaggaagccgagcattcaggggcaagtcacaatatcttggtcgaagttcaggatgacggaacaatgaaaataaaggatgaggagagggacgataccttaactattctgctcaaggccacactgcttgctgtgagcggcgtgtatcccctgtctatcccagcaaccttgtttgtctggtacttctggcagaaaaagaaacaacgatccggcgtgctatgggacacgccttcacccccagaagttgagcgcgccgtactggatgacgggatctatcggattatgcagagaggactcctgggtaggagtcaggtgggcgtcggggtgtttcaggaaaacgttttccatactatgtggcacgtgacccgtggagcggtccttatgtaccaaggcaagcgcttagagccgagctgggcttccgtgaaaaaggacctgatatcttacggtgggggatggcggctccagggctcgtggaatacaggcgaggaagtacaggtcatcgccgtggagcctgggaagaaccccaaaaatgttcagaccgcaccaggaacatttaagactagcgaaggtgaggtgggcgccattgctttggatttcaaacccgggacctcaggatcccctatcgtcaacagagaaggcaagattgtgggtctgtatgggaatggagttgtgacgacaagtggcacttacgtctctgccatcgcacaagctaaagccagccaggagggcccactccccgagatagaagacgaggtgtttaggaagcgaaacctgaccatcatggatcttcaccctgggtccggaaagacacggcgctatctgccggcgattgtaagagaagccatcaaaaggaagttgcggaccctaattctggcaccaactcgagtggttgcttcagagatggccgaagctctcaaaggtatgcccatcagataccagaccacagcagtcaagtctgagcatacgggcaaagagatagtggacttaatgtgccacgccactttcaccatgcgcctgcttagccctgtgagggtcccaaattataacatgattatcatggatgaagcccattttacagaccccagttccatcgctgcgcgtgggtacattagcacccgggtaggaatgggcgaggcagccgctatcttcatgactgccacacctccgggttctgtggaagcatttccccaatcaaatgccgttatacaggatgaggaaagagacattccagagaggtcctggaacagtgggtatgagtggatcaccgatttccctggaaagacggtgtggttcgtccccagcattaagtcgggcaatgacatcgctaactgtctgcgcaaaaatggcaagcgagtgatacagctctctagaaaaacttttgatacagaataccagaagaccaaaaacaacgactgggactacgttgtgaccactgatatttccgagatgggggcgaatttccgggccgacagggtcatcgatccacgccgttgcttgaagcctgtgatcctgaaggacggacccgaaagagtaattctcgcaggtccaatgccggtgacagttgctagcgccgcacaacggaggggccgcatcgggcgaaaccacaataaagagggagatcagtatatttacatgggccagcctctgaacaatgacgaggatcatgcccactggaccgaagctaagatgcttctagacaacataaatacacccgagggtatcattccagccctgtttgaacccgagagagaaaaatcagcggcaatcgatggggagtatcggttgaggggcgaggcccgcaagactttcgtcgaattaatgagaaggggagacctgcctgtgtggctcagttacaaagtggcttctgagggctttcagtattccgatcggcgttggtgcttcgacggggaacgcaacaatcaagtcctggaggaaaacatggatgttgagatctggacgaaggagggagaacgaaagaaacttagaccaaggtggctggacgcccggacctacagcgaccccctcgctttgcgcgagtttaaagagttcgcagccggtagaaggtcagtgagtggcgatctgattctagagatagggaaactgcctcagcacctcacacagcgggctcagaatgcccttgacaacctggtaatgttacataatagcgaacaaggaggccgagcatatagacacgcgatggaggagttgccggatactatcgaaaccctgatgctcctggcccttattgctgtgctgacaggtggggtcaccctctttttcttgtccggccgcggactgggcaagacttctatcgggttactatgtgtgatggccagctccgttctgctctggatggcatcagtggagccacattggattgctgcctctatcatacttgaatttttcctgatggtcttgctgatccccgagcctgacaggcagcggacgccccaggataaccagctcgcatacgtagtgattggactgctttttatgatcctcaccgttgccgctaatgagatgggtctgttggaaacaactaaaaaggacctgggcattgggcacgcggccgtggagaaccaccatcacgcagctatgttagatgtcgacctacatccagccagtgcctggaccctgtacgcagtggctacaaccatcataactcctatgatgcgtcacacaattgaaaacacgaccgccaatatctcgctcactgcgattgctaaccaagccgcaatccttatgggactggataaaggctggcccataagcaagatggacatcggtgtcccattgctggccctcgggtgctattcccaggtgaatcctctgacacttaccgctgcagttttaatgctggtggcccattacgcgattatcggcccgggactccaggctaaggccaccagagaggcacagaagaggacagccgctggcattatgaagaaccccactgtagatgggatcgtggccatagacttggatccagtcgtttatgacgcaaaattcgaaaagcagctgggacagattatgctactgatcctctgtacgtctcagatccttctgatgcgcaccacatgggctttgtgcgagtcaattactctggccaccggccctctcacaaccctgtgggagggtagccccgggaaattctggaatactacgatcgcggtgtccatggccaacatatttcggggaagttacttagcaggcgctggtcttgccttctctctgatgaaaagcctcggcgggggacgaagaggcacaggggcacaaggagaaaccctaggcgagaagtggaaaaggcagctgaatcagttgtcaaagtccgaatttaacacttataaacgcagtggtattatggaggtcgaccggagcgaagctaaggaggggctgaaaagaggagagaccacaaagcacgccgtgtctcgtggcactgccaagctcaggtggttcgtagaacggaatcttgtgaaaccagagggtaaggttatcgatctgggctgtgggcgcggaggctggtcctactattgcgcggggttgaaaaaggtgaccgaagtcaaaggatacacaaagggcggtcctgggcacgaggaacccattccgatggctacgtacggatggaacctggtgaaactccattcaggcaaggacgtctttttcatcccacctgagaagtgtgataccttactgtgcgacataggcgagagctcgcccaatccaactatcgaagaggggcgaacacttagagtgctgaaaatggttgaaccctggctaaggggaaaccagttttgtattaagatcctcaatccttatatgccgtctgtagtggagaccctggagcaaatgcagcggaaacacggtggcatgttggtccgcaaccccctgagtagaaattccactcatgaaatgtactgggtgagctgcgggacaggaaacattgtttcagcagtgaatatgacctccaggatgctccttaaccgattcacgatggcccaccggaagccaacctatgagcgtgatgtcgacctgggcgctggtacaagacacgtggccgtagaacctgaggtggcaaacttagatatcattgggcagcgcatcgaaaatataaaacatgagcacaagtctacttggcattacgacgaggataacccctataagacctgggcctaccacggaagctatgaagttaaacctagtggctccgctagctctatggtcaatggcgtggtgaagctgttgacaaaaccatgggacgtcattcccatggttactcagatcgcgatgaccgatacaaccccttttgggcaacagagggtgttcaaggagaaagtagacactcggacgccaaaggccaagagaggaacagcacagatcatggaagtgaccgctaaatggctctggggttttctgtcacgcaacaagaaacccaggatttgtactcgagaggagttcacccggaaggtcagaagtaatgccgcaataggcgccgtgtttgttgacgagaaccaatggaactccgctaaagaggccgtggaagatgagaggttctgggacctagtccatcgcgaacgtgagcttcacaagcaggggaagtgcgcgacatgcgtgtacaacatgatgggaaaacgggaaaagaaactgggcgagttcggtaaggcaaaagggagcagagccatctggtacatgtggctcggagctaggtttctggagttcgaagccttgggctttatgaatgaggatcactggttctctcgcgaaaactcgctgtcaggcgtagagggggagggactccataaacttggttatattctgcgagacatcagcaaaattccgggcgggaatatgtacgcagatgacacggctggatgggatacccggatcactgaagacgatttacagaacgaggccaagataacagacatcatggaacctgagcacgctctgttggccaagtccatttttaaactcacctatcagaataaggttgtgagagtccaaaggccagccaagaatggcactgtgatggatgtgatcagtcgcagagaccagcggggttctgggcaggtcggaacatacggcctgaataccttcacaaacatggaagcgcagctaattaggcaaatggagagcgagggcatcttttccccctcagaacttgagactcctaacctggccgggcgtgttctcgattggctggaaaagcatggagtggagcgattgaaacgcatggctataagtggtgacgactgtgtagtgaagccaattgatgacagattcgccaccgcattaacggctctgaatgatatgggcaaggtccggaaagacatcccccagtgggaaccgtctaaggggtggaacgattggcaacaggtgcctttttgcagccaccacttccatcaactcatcatgaaagacggaagggagattgttgtgccctgtcgcaatcaggatgagcttgtcggcagagcccgggtgtcccagggtgcagggtggtcactgagggaaaccgcctgcctaggaaagagctatgcgcagatgtggcaactgatgtactttcaccgacgtgacctcagattggctgccaacgcaatatgttctgccgtaccagttgattgggtgcctacatcccgcactacctggagtatccatgctcaccatcagtggatgacaactgaggacatgctgagcgtctggaatcgggtgtggattgaagagaacccctggatggaagataaaacccacatctcgtcctggggcgacgttccatatcttggcaagagggaggaccagtggtgcgggtctctgattggactcacggccagagcaacatgggctaccaatatccaagtggccataaaccaggtccgccggttaatcggtaatgagaactacctggattacatgacttcaatgaagaggttcaaaaatgaaagcgaccccgagggcgcgttgtggtga

SEQ ID NO: 13934 - RNA, 9879 nt, synthetic construct
  misc_feature 1..9879: note = derived and/or modified CDS sequence (opt3) from DENV-1__GU131759__SS-prME
  source 1..9879: mol_type = other RNA
agcgtgaccatgctgctcatgcttatgcccaccgcactggctttccacttgactacgagaggcggggaacctcatatgatcgtctccaagcaggaaagggggaagtctttactgtttaagacctcagccggtgttaatatgtgcacactaattgccatggacctcggcgagttctgtgaagatactatgacctacaagtgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctcctttactttcattaagaccacattttcactgcactatgcatggaagactatggctatggtgctaagcatcgtcagtctgttccccctttgtctctctaccacgtcccagaaaacaacctggctgccggtattgctgggcagcttagggtgcaagcctctcactatgttcctgattgccgagaataaagtgtggggaagaaagtcgtggccacttaacgaaggtatcatggccgttggcatagtgtcaatcctgttgtctagtctcctgaaaaacgatgtccccctagctgggcctctgattgcaggaggcatgcttatcgcctgttacgtgatttccggtagctctgcggacctcagcctggagaaggctgccgaggtatcctgggaagaggaagcagagcattcaggggccagtcacaatatcttggtggaagtccaggatgacggaacaatgaaaataaaggatgaggagagggacgataccttaactattctgctcaaggctacactgcttgcagttagcggcgtgtatcccctgtctatcccagccaccttgtttgtgtggtacttctggcagaaaaagaaacaacgatccggcgtcctatgggacacgccttcacccccagaagtggagcgcgcggttctggatgacgggatctatcggattatgcagagaggactcctgggtaggagtcaggtaggcgtgggggtctttcaggaaaacgtgttccatactatgtggcacgttacccgtggagctgtgcttatgtaccaaggcaagcgcttagagccgagctgggcctccgtcaaaaaggacctgatatcttacggtgggggatggcggctccagggctcgtggaatacaggcgaggaagtgcaggtaatcgcagtcgagcctgggaagaaccccaaaaatgtgcagaccgccccaggaacatttaagactagcgaaggtgaggttggcgctattgccttggatttcaaacccgggacctcaggatcccctatcgtgaacagagaaggcaagattgtcggtctgtatgggaatggagtggttacgacaagtggcacttacgtgtctgcaatcgctcaagccaaagcgagccaggagggcccactccccgagatagaagacgaggtctttaggaagcgaaacctgaccatcatggatcttcaccctgggtccggaaagacacggcgctatctgccggccattgtgagagaagcaatcaaaaggaagttgcggaccctaattctggctccaactcgagtagtggcctcagagatggctgaagcactcaaaggtatgcccatcagataccagaccacagccgttaagtctgagcatacgggcaaagagatagtcgacttaatgtgccacgccactttcaccatgcgcctgcttagccctgtgagggtgccaaattataacatgattatcatggatgaagctcattttacagaccccagttccatcgcggcacgtgggtacattagcacccgggtcggaatgggcgaggccgctgccatcttcatgactgcaacacctccgggttctgtagaagcctttccccaatcaaatgctgtgatacaggatgaggaaagagacattccagagaggtcctggaacagtgggtatgagtggatcaccgatttccctggaaagacggtttggttcgtgcccagcattaagtcgggcaatgacatcgcgaactgtctgcgcaaaaatggcaagcgagtcatacagctctctagaaaaacttttgatacagaataccagaagaccaaaaacaacgactgggactacgtggttaccactgatatttccgagatgggggccaatttccgggcagacagggtgatcgatccacgccgttgcttgaagcctgtcatcctgaaggacggacccgaaagagtgattctcgctggtccaatgccggtaacagtggccagcgcagcccaacggaggggccgcatcgggcgaaaccacaataaagagggagatcagtatatttacatgggccagcctctgaacaatgacgaggatcatgctcactggaccgaagccaagatgcttctagacaacataaatacacccgagggtatcattccagcgctgtttgaacccgagagagaaaaatcagcagccatcgatggggagtatcggttgaggggcgaggctcgcaagactttcgttgaattaatgagaaggggagacctgcctgtctggctcagtcacaaagtggcctctgagggctttcagtactccgatcggcgttggtgcttcgacggggaacgcaacaatcaagtgctggaggaaaacatggatgtcgagatctggacgaaggagggagaacgaaagaaacttagaccaaggtggctggacgctcggacctatagcgaccccctcgcattgcgcgagtttaaagagttcgccgctggtagaaggtcagttagtggcgatctgattctagagatagggaaactgcctcagcatctcacacagcgggcccagaatgcacttgacaacctggtgatgttacacaatagcgaacaaggaggccgagcgtacagacatgccatggaggagttgccggatactatcgaaaccctgatgctcctggctcttattgccgtactgacaggtggggtgaccctctttttcttgtccggccgcggactgggcaagacttctatcgggttactatgtgtcatggcaagctccgtgctgctctggatggcttcagttgagccacactggattgccgcatctatcatacttgaatttttcctgatggtgttgctgatccccgagcctgacaggcagcggacgccccaggataaccagctcgcctatgtcgtaattggactgctttttatgatcctcaccgtggctgcgaatgagatgggtctgttggaaacaactaaaaaggacctgggcattgggcacgccgcagttgagaaccatcaccatgctgccatgttagatgtggacctacacccagccagtgcatggaccctgtacgctgtcgccacaaccatcataactcctatgatgcgtcatacaattgaaaacacgaccgcgaatatctcgctcactgctattgccaaccaagcagccatccttatgggactggataaaggctggcccataagcaagatggacatcggtgtgccattgctggctctcgggtgctactcccaggtcaatcctctgacacttaccgcagccgtgttaatgctggttgcgcactatgctattatcggcccgggactccaggccaaggcaaccagagaggcccaaaagaggacagctgccggcattatgaagaaccccactgtggatgggatcgtagcaatagacttggatccagtggtctacgacgctaaattcgaaaagcagctgggacagattatgctactgatcctctgtacgtctcagatccttctgatgcgcaccacatgggccttgtgcgagtcaattactctggcgaccggccctctcacaaccctgtgggagggtagccccgggaaattctggaatactacgatcgccgtttccatggcaaacatatttcggggaagttatttagctggcgccggtcttgcattctctctgatgaaaagcctcggcgggggacgaagaggcacaggggctcaaggagaaaccctaggcgagaagtggaaaaggcagctgaatcagttgtcaaagtccgaatttaacacttacaaacgcagtggtattatggaggtggaccggagcgaagccaaggaggggctgaaaagaggagagaccacaaagcacgccgtctctcgtggcactgcgaagctcaggtggttcgtggaacggaatcttgtaaaaccagagggtaaggtgatcgatctgggctgtgggcgcggaggctggtcctattactgcgctgggttgaaaaaggttaccgaagtgaaaggatatacaaagggcggtcctgggcatgaggaacccattccgatggcaacgtacggatggaacctggtcaaactccactcaggcaaggacgtgtttttcatcccacctgagaagtgtgataccttactgtgcgacataggcgagagctcgcccaatccaactatcgaagaggggcgaacacttagagtcctgaaaatggtggaaccctggctaaggggaaaccagttttgtattaagatcctcaatccttacatgccgtctgttgtagagaccctggagcaaatgcagcggaaacatggtggcatgttggtgcgcaaccccctgagtagaaattccactcacgaaatgtattgggtcagctgcgggacaggaaacattgtgtcagccgttaatatgacctccaggatgctccttaaccgattcacgatggctcaccggaagccaacctacgagcgtgatgtggacctgggcgccggtacaagacatgtcgcagtggaacctgaggtagccaacttagatatcattgggcagcgcatcgaaaatataaaacacgagcataagtctacttggcactatgacgaggataacccctacaagacctgggcttatcatggaagctacgaagtgaaacctagtggctccgcgagctctatggttaatggcgtcgtgaagctgttgacaaaaccatgggacgtgattcccatggtcactcagatcgccatgaccgatacaaccccttttgggcaacagagggttttcaaggagaaagtggacactcggacgccaaaggcaaagagaggaacagctcagatcatggaagtaaccgccaaatggctctggggttttctgtcacgcaacaagaaacccaggatttgtactcgagaggagttcacccggaaggtgagaagtaatgcagccataggcgctgtctttgtggacgagaaccaatggaactccgccaaagaggcggttgaagatgagaggttctgggacctagtgcaccgcgaacgtgagcttcacaagcaggggaagtgcgcaacatgcgtctataacatgatgggaaaacgggaaaagaaactgggcgagttcggtaaggccaaagggagcagagctatctggtacatgtggctcggagccaggtttctggagttcgaagcattgggctttatgaatgaggatcattggttctctcgcgaaaactcgctgtcaggcgtggagggggagggactccacaaacttggttacattctgcgagacatcagcaaaattccgggcgggaatatgtatgctgatgacacggccggatgggatacccggatcactgaagacgatttacagaacgaggctaagataacagacatcatggaacctgagcatgccctgttggcaaagtccatttttaaactcacctaccagaataaggtagttagagtgcaaaggccagcgaaaaacggcactgtcatggatgtgatcagtcgcagagaccagcggggttctggacaggtgggaacatatggcctgaataccttcacaaacatggaagcccagctaattaggcaaatggagagcgagggcatcttttccccctcagaacttgagactcctaacctggctgggcgtgtcctcgattggctggaaaagcacggagttgagcgattgaaacgcatggccataagtggtgacgactgtgtggtaaagccaattgatgacagattcgcaaccgctttaacggccctgaatgatatgggcaaggtgcggaaagacatcccccagtgggaaccgtctaaggggtggaacgattggcagcaggtccctttttgcagccaccatttccaccaactcatcatgaaagacggaagggagattgtggttccctgtcgcaatcaggatgagcttgtgggcagagcacgggtctcccagggtgccgggtggtcactgagggaaaccgcgtgcctaggaaagagctacgctcagatgtggcaactgatgtattttcatcgacgtgacctcagattggccgcaaacgccatatgttctgctgtgccagtagattgggttcctacatcccgcactacctggagtatccacgcccatcaccagtggatgacaactgaggacatgctgagcgtgtggaatcgggtctggattgaagagaacccctggatggaagataaaacccacatctcgtcctggggcgacgtgccataccttggcaagagggaggaccagtggtgcgggtctctgattggactcacggcaagagctacatgggccaccaatatccaagttgcgataaaccaggtgcgccggttaatcggtaatgagaactatctggattacatgacttcaatgaagaggttcaaaaatgaaagcgaccccgagggcgctttgtggtga

SEQ ID NO: 13935 - RNA, 9879 nt, synthetic construct
  misc_feature 1..9879: note = derived and/or modified CDS sequence (opt3) from DENV-1__GU131761__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaatatgtgcacgctgattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaaaaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatgattctctcaatcgttagcctgttccccttgtgtctgagtacgacatctcagaagaccacttggttaccggtgctcctgggctcccttgggtgcaagcctctgacaatgtttttgatagctgagaataaaatctggggaaggcgaagctggccactcaacgaaggtattatggccgtcggcatcgtatcgattctgctatcatctctgcttaagaacgatgtgcccctcgccgggcctctgatcgctggaggcatgttgatagcatgttacgttattagtggttccagcgccgacttatctctggagaaagcggctgaggtgagctgggaagaggaagccgagcattccggggcatcacacaatatcctcgtcgaagtgcaggatgacggaaccatgaagatccaagatgaggagcgcgacgatactctgacaattcttctgaaagccaccttgctagctgtaagtggcgtgtatcccctgagcataccagcaacactcttcgtctggtacttctggcagaagaaaaagcagcggtctggcgttctgtgggacactccttcacccccagaagtggagagagccgtgcttgatgacgggatctataggattatgcagcgtggattactgggtcgcagccaagtcggcgtgggggtttttcaggaaaacgtattccataccatgtggcacgtgacacggggagcggtcctcatgtaccagggcaagagattggagccgagttgggctagcgtgaaaaaggacctgatctcctacggtgggggatggaggctccagggctcttggaataccggcgaggaagttcaagtgattgccgtcgagcctgggaaaaaccccaagaatgtgcagacagcaccaggaacttttaaaacccccgaaggtgaggtaggcgccatcgctctggatttcaagcctgggacgtcgggaagcccaatagtcaaccgagaaggcaagatcgtgggtctttatgggaatggagttgtgacaacttcaggcacctacgtctccgccattgcacaggctaaagccagtcaagagggccccctgcctgagatcgaagacgaggtgtttcggaagcgcaacttgacaattatggatctacacccggggtctggaaaaaccagaaggtatctgccagcgatcgttcgggaagccataaagcgaaaactcagaactttaattctggcacccacccgcgtggtcgctagcgagatggccgaagctcttaagggtatgcctatcaggtaccagacaacggcagtgaagtccgagcatactggcaaagagatcgtagacctgatgtgccacgccaccttcacaatgcgtctcttgtcaccagtgcgggttcccaattataacatgattatcatggatgaagcccattttaccgacccttctagcatagctgcgagagggtacattagtactagggtcggaatgggcgaggcagccgctatcttcatgacagccaccccgcccggttccgtggaagcatttccacagagcaatgccgtgattcaggatgaggaacgcgacatccctgagcgatcttggaactcagggtatgagtggataacggatttccccggaaagactgtctggtttgtaccatccattaaaagtggcaatgacatcgctaactgtctgagaaagaatggcaaacgggtgatccaactcagcaggaagacattcgataccgaataccagaagaccaaaaacaacgactgggactacgttgtgactacagatatttcggagatgggggcgaatttccgcgccgaccgtgtcatcgatcctagacggtgcctgaagcccgtgattcttaaagacggaccagaaagggttatactagcaggtccgatgcctgtgaccgtcgcttctgccgcacagcgccgaggcagaatcgggcggaaccacaataaggagggagatcagtatatttacatgggccaacccctgaacaatgacgaggatcatgcccactggacagaagctaaaatgttgttagacaacatcaatactccagagggtatcattcccgccctgtttgaacctgagagggaaaagtccgcggcaatagatggggagtatcgcctcagaggcgaggccaggaagacgttcgtggaactgatgcggcgtggagaccttccagtatggctgagctacaaagtggcttcagagggctttcagtatagtgatcgccgatggtgcttcgacggggaaagaaacaatcaggttctcgaggaaaacatggatgtcgagatctggaccaaggagggagaaaggaaaaagttgcggccccgctggctggacgccagaacatactctgaccctctagctctgagggagtttaaagagttcgcagccggtcggcgatccgtgagcggcgatctcattcttgagatcgggaagctgccgcagcacttaactcaaagagctcagaatgccttggacaacctggtgatgctccataattcagaacagggaggccgcgcatataggcacgcgatggaggagctgccagataccattgaaacacttatgctgctcgccttgatcgctgtcctgaccggtggggttactttatttttcctaagtggccggggactgggcaaaacgagcatagggctcctttgtgtgatggcctcctctgtactgttgtggatggcaagcgtggagccccattggatcgctgcctccattatcctggaatttttcctcatggtcctgcttattcctgagcccgaccgtcagagaaccccacaagataaccagctcgcatacgtggttatcggactgttgtttatgatactgacagtggccgctaatgagatgggtttactagaaactaccaagaaggacctgggcattgggcacgtcgcggtagagaaccaccatcacgccgcaatgctcgatgtggaccttcatcctgcttcagcctggacactgtacgccgttgcaaccactatcattacacccatgatgaggcacacgatcgaaaacaccactgctaatatatctttgacagccatcgcgaaccaggctgccattctgatgggactcgataaaggctggccaatcagtaagatggacattggtgtgcctctgcttgcattagggtgctattcgcaagtcaatccgctgaccctcaccgccgctgtgttgatgctggtcgcacattacgccatcataggccccggactacaggcgaaagctacacgcgaggcccagaagcggactgcagccggcattatgaaaaacccaacggtggatgggatcgttgctatcgacctggatcctgtggtatatgacgccaagttcgaaaagcagctcggacaaattatgcttctgatcttgtgtaccagccagatactgctcatgcgaacaacttgggcactgtgcgagtccattaccttagctacaggcccccttaccactctgtgggagggttctccagggaaattttggaatacgacaatcgccgtgtcaatggcgaacattttcagaggaagctacctcgccggcgcaggtctagctttctccctgatgaagagtttgggcgggggaaggcgcggcaccggggcccagggagaaactctgggcgagaaatggaagcggcagctcaatcaactttctaaaagcgaatttaacacctataagagatcaggtatcatggaggtcgaccgttccgaagcaaaggaggggctgaaaaggggagagacaactaagcacgctgttagtcggggcaccgccaaattgcgctggttcgtggaacgaaatctggtcaagcctgagggtaaagtgatagatctcggctgtgggagaggaggctggagctactattgcgccgggttaaagaaggtaacagaagtgaaaggatacacgaagggcggtcccgggcacgaggaaccgatcccaatggcgacctacggatggaacctggttaaacttcattctggcaaggacgtgtttttcattcctcccgagaaatgtgatactctgctatgcgacatcggcgagtcctcaccaaatcccacaattgaagaggggaggaccctccgggtcctgaagatggtggaaccttggttgcgcggaaaccagttttgtatcaaaattctgaatccgtatatgcccagcgtcgtggagactctcgagcagatgcagagaaagcacggtggcatgcttgttaggaacccactgtcgcgaaattctacacatgaaatgtactgggtaagttgcgggaccggaaacatcgtgtccgctgtcaatatgacgagccggatgttactgaaccgtttcaccatggcacacagaaagcctacatatgagcgcgatgtggacttgggcgccggtactaggcacgttgctgtggaacccgaggtcgccaacctcgatataattgggcaacggatcgaaaatatcaaacatgagcacaagtcaacctggcattacgacgaggataacccttataaaacatgggcataccacggatcctatgaagtgaagccatctggcagcgccagttccatggtaaatggcgtggttaaactgctaactaagccctgggacgtcattcctatggtgacccagatagctatgacagataccactccatttgggcagcaaagagtgttcaaggagaaagtcgacacgcgcacacccaaggcgaaaaggggaaccgcccagatcatggaagttactgcaaagtggctttggggttttctgagccgaaacaaaaagccgcggatttgtaccagagaggagttcacaaggaaggtgcgctctaatgctgccatcggcgcagtatttgtggacgagaaccagtggaactcagccaaagaggctgtcgaagatgagcgtttctgggacctcgtgcatcgggaaagagagctgcacaagcaggggaaatgcgccacgtgcgtttacaacatgatgggaaagagggagaaaaagttgggcgagtttggtaaggcgaaagggagtcgcgcaatttggtacatgtggctgggagcccgattcctcgagttcgaagctcttggctttatgaatgaggatcactggttctcccgggaaaacagcctgtctggcgtggagggggagggattacataagctgggttatatcttgagagacatatcgaaaatccctggcgggaatatgtacgccgatgacaccgcaggatgggatactaggattacagaagacgatctccaaaacgaggctcgcatcaccgacattatggaaccagagcacgccctgctagctaagtcaatctttaaacttacttatcagaataaggtcgtgagagtacagcggcccgccaaaaacggcacagttatggatgtgataagcaggcgtgaccagcgaggttccgggcaagtcggaacctacggcctgaatacattcactaacatggaagcacagctcattcgccagatggagagtgagggcatcttttctcctagcgaactggagaccccaaacttggcggaaagagtgttagattggctggagaagtatggggtggaacggctcaagaggatggccatctccggagacgactgtgtcgttaaacccattgatgaccgcttcgctacggcccttaccgcactgaatgatatgggtaaggtgagaaaagacataccgcagtgggagccttcaaagggctggaacgattggcaacaggtacccttttgcagtcatcacttccaccagctaatcatgaaagacgggcgggagattgtggtcccatgtaggaatcaggatgaactggtgggacgagctcgtgtttctcaaggcgccggttggagcctcagagagacagcatgcttggggaagtcctacgcccagatgtggcagctgatgtattttcatcgccgggaccttaggctggcggctaacgccatctgttcagcagtgcctgtcgattggattcccactagcagaaccacatggtctatccacgcccatcaccaatggatgactaccgaagacatgctctccgtgtggaatcgcgtatggatagaggaaaacccatggatggaggataagacgcatatcagtagctggggagacgttccctacttaggcaaacgggaggaccagtggtgcggctcgctgattgggttgacagctagggccacctgggcaactaatatccaggtggctattaaccaggtccgaagactgatcggaaatgaaaactacctcgattatatgacatccatgaagcggttcaaaaatgagtctgaccctgaaggtgccctttggtga

SEQ ID NO: 13936 - RNA, 9879 nt, synthetic construct
  misc_feature 1..9879: note = derived and/or modified CDS sequence (opt3) from DENV-1__GU131762__SS-prME
  source 1..9879: mol_type = other RNA
agcgtgaccatgctgctcatgcttatgcccacagcactggctttccacttgactacgagaggaggggaacctcatatgatcgtctccaagcaggaaagggggaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccatgagcttatctatgacttgtattgctgttggcctggtcacactatacctcggggtgatggtgcaggccgattcaggatgcgtcatcaactggaaaggccgcgaactgaagtgtggtagtgggatctttgttaccaatgaggtgcacacatggactgaacaatataagttccaggcagacagcccgaaaagactttccgccgctattggaaaggcctgggaggagggcgtgtgcggtataaggtctgcaacccggttggaaaacatcatgtggaaacagatttcgaacgagctgaatcatatcctcctggaaaacgacatgaagtttacggtagtcgtgggcgatgttgctgggattttagcccagggcaagaagatgatccgccctcaacccatggagtacaaatatagctggaagtcctggggcaaggcgaaaataatcggggccgacgtgcagaatacaaccttcattatcgatggaccaaacactcctgaatgtcccgacgatcagagagcttggaatatttgggaggtcgaggactacggctttggtatcttcaccacaaacatatggctgaaacttagggattcatatactcaggtgtgcgaccaccgtttgatgagtgcagccattaaagattctaaggctgttcacgccgacatggggtactggatcgaaagcgagaaaaatgaaacctggaagctcgcacgggcgtccttcattgaggtgaagacatgtatctggccaaaatcacatacgctgtggagcaacggagtactagaatctgagatgataatccccaagatttatggcggtcctatctcccaacacaattaccgaccaggctactttacccagactgccgggccgtggcatctgggaaaactcgagctggatttcgacctttgcgaaggcacaaccgtcgtggtggatgagcactgcgggaacagaggacccagtttgaggactacaaccgtcacgggcaagattatccacgaatggtgttgccgcagctgtactctgcctccattacggtttaaaggtgaggacgggtgctggtatggaatggagataagacccgttaaggaaaaggaggaaaatctcgtgaaatctatggtatccgctggctcaggtgaggtggacagtttcagcctgggccttctgtgtatttcgatcatgatcgaagaggtcatgaggtcccgctggtctcgaaagatgttgatgaccgggacactcgccgtgtttttcctgctaattatgggacagctgacctggaacgatctcatccggctgtgcattatggttggcgcaaatgctagcgaccgtatggggatgggaactacataccttgccttgatggcaacctttaaaatgagacctatgttcgccgtgggcctgttatttaggcgcctcacatcacgggaggtcctgcttctgactataggtctaagtctcgtggcttccgttgaactgccaaactctttggaggaactgggggatggattagcgatgggcatcatgattctcaagctgcttaccgacttccaaagccatcagctgtgggccacgttgctctccctgacatttatcaaaaccactttctcactacactatgcatggaagaccatggctatggtgctgagcattgtcagtctttttcccctctgtctgtctacaacttcccagaagaccacgtggttgccggtactgttaggcagcctcgggtgcaaacctctgacaatgttccttatcgccgagaataagatatggggaagaaaatcgtggccactgaacgaaggtatcatggccgtgggcattgtttcaatcttgctctctagtctgctaaagaacgatgtgcccctggctgggcctcttattgcaggaggcatgctcatcgcctgttacgtcatatccggtagctctgcggacctgagcttggagaaagctgccgaggtgtcctgggaagaggaagcagagcattcaggggccagtcacaatattttagtagaagtgcaggatgacggaaccatgaagatcaaagatgaggagagggacgatactctgacaatcctcctgaaggctacccttctggcagtcagcggcgtttatcccttgtctattccagccactctattcctgtggtacttttggcaaaagaaaaagcagcgatccggcgtgctctgggacacaccttcacccccagaagtggagcgcgcggtcctggatgacgggatatatcggatcatgcagagaggacttttaggtaggagtcaggtgggcgttggggtattccaagaaaacgtgtttcataccatgtggcacgtcacgcgtggagctgtgctgatgtaccagggcaaacgcctcgagccgagctgggcctccgttaagaaagacttgatttcttacggtgggggatggcggctgcagggctcgtggaatactggcgaggaagtgcaggtcatcgcagtggagcctgggaagaaccccaagaatgtacaaaccgccccaggaacattcaaaaccagcgaaggtgaggtcggcgctattgccctcgattttaagcccgggacatcaggatcccctatcgtgaacagagaaggcaaaatagttggtctgtatgggaatggagtggtcactaccagtggcacgtacgtgtctgcaatcgctcaggccaaggcgagccaggagggcccacttcccgagattgaagacgaggttttcaggaaacgaaacctgacaatcatggatttgcaccctgggtccggaaagactcggcgctatctaccggccattgtgagagaagcaatcaagaggaaactgcggaccctcatattagctccaacacgagtcgtggcctcagagatggctgaagcactgaagggtatgcccattagataccaaaccactgccgtaaaatctgagcataccggcaaggagatcgtggaccttatgtgccacgccacatttacgatgcgcctgctcagccctgttagggtcccaaattataacatgatcattatggatgaagctcatttcactgaccccagttccatcgcggcacgtgggtacataagcacccgggtgggaatgggcgaggccgctgccatttttatgacagcaacccctccgggttctgtggaagccttcccccagtcaaatgctgtcatccaggatgaggaaagagacattccagagaggtcctggaacagtgggtatgagtggatcactgattttcctggaaaaacagtatggttcgtgcccagcataaagtcgggcaatgacattgcgaactgtttgcgcaagaatggcaaacgagttatccagctgtctagaaagaccttcgatacggaataccagaagactaagaacaacgactgggactacgtggtcacaaccgatatctccgagatgggggccaattttcgggcagacagggtgattgatccacgccgttgcctcaaacctgttatcctgaaggacggacccgaaagagtgattcttgctggtccaatgccggtcaccgtggccagcgcagcccagcggaggggccgcatagggcgaaaccacaataaggagggagatcagtatatctacatgggccagcctctaaacaatgacgaggatcatgctcactggactgaagccaaaatgctgttggacaacattaatacacccgagggtatcatcccagcgttattcgaacccgagagagaaaagtcagcagccattgatggggagtatcggctgaggggcgaggctcgcaaaacctttgtagaactcatgagaaggggagacctgcctgtgtggcttagttacaaggttgcctctgagggcttccaatattccgatcggcgttggtgctttgacggggaacgcaacaatcaggtcctggaggaaaacatggatgtggagatatggacaaaagagggagaacgaaagaaactcagaccaaggtggttggacgctcgggtgtacagcgaccccctggcactacgcgagttcaaggaatttgccgctggtagaaggtcagtcagtggcgatctgatcctcgagattgggaaacttcctcagcacctgactcagcgggcccaaaatgcattagacaacttggttatgctgcataatagcgaacagggaggccgagcgtatagacacgccatggaggagctcccggatacgatcgaaaccctgatgcttctggctctcattgccgtgttgacaggtggggtaactctgttctttttatccggccgcggactaggcaaaacctctatcgggctgctctgtgtgatggcaagctccgtccttctgtggatggcttcagtggagccacattggatagccgcatctatcattttggagttctttctgatggttctcctgatccccgagcctgacaggcagcggacaccccaggataaccaacttgcctacgtggtcattggactcctgttcatgatcttgaccgtagctgcgaatgagatgggtctgttagaaactacgaagaaagacctaggcatagggcacgtggccgttgagaaccaccatcacgcagctatgctggatgtggacctccatccagccagtgcctggaccctttacgcagtcgctacaactattatcacccctatgatgcgtcacacaattgaaaacaccactgccaatatctcgctgacagcgatagctaaccaggccgcaatcttgatgggactggataagggctggcccattagcaaaatggacatcggtgtgccactcctggcccttgggtgctattcccaggtcaatcctttaacgctgaccgctgcagtgctcatgttggttgcccattacgcgattatcggcccgggactgcaagctaaggccactagagaggcacagaagaggacagccgctggcataatgaaaaaccccaccgtggatgggattgtagccatcgacctagatccagtggtctatgacgcaaagtttgaaaaacagctgggacagatcatgctccttattctgtgtacctctcaaatcttgctgatgcgcacaacttgggctctctgcgagtcaataacgctggccaccggccctttaacaactctttgggagggtagccccgggaagttctggaataccacaattgcggtttccatggccaacatcttccggggaagttacctggcaggcgctggtctcgccttttctctaatgaaaagcctgggcgggggacgaagaggcaccggggcacagggagaaactttgggcgagaagtggaagaggcagctgaatcagctctcaaaatccgagttcaacacgtataagcgcagtggtattatggaggtggaccggagcgaagctaaagaggggcttaagagaggagagacaaccaaacacgccgtctctcgtggcactgccaagctgaggtggtttgtggaacggaatttggtaaagccagagggtaaagtgatcgatctgggctgtgggcgcggaggctggtcctactattgcgcggggctcaagaaagttaccgaagtgaagggatacacaaaaggcggtcctgggcacgaggaacccataccgatggctacttacggatggaacttagtcaagctgcattcaggcaaagacgtgttctttatcccacctgagaagtgtgatacccttctgtgcgacattggcgagagctcgcccaatccaacaatcgaagaggggcgaacgctaagagtcctcaagatggtggaaccctggctgaggggaaaccaattctgtattaaaatcttgaatccttatatgccgtctgttgtagagaccctggagcagatgcagcggaagcacggtggcatgctcgtgcgcaacccccttagtagaaattccactcatgaaatgtactgggtcagctgcgggacaggaaacattgtgtcagcagttaatatgacctccaggatgctgttaaaccgatttactatggcccaccggaaaccaacatatgagcgtgatgtggacctgggcgctggtaccagacacgtcgccgtggaacctgaggtagcaaacttggatatcatagggcagcgcattgaaaatatcaagcatgagcacaaatctacgtggcattacgacgaggataacccctataagacctgggcctaccacggaagctatgaagtgaagcctagtggctccgctagctctatggttaatggcgtcgtgaaactcctgacaaagccatgggacgtgatccccatggtcactcaaattgcgatgaccgatacaactcctttcgggcagcagagggtttttaaagagaaggtggacacccggacaccaaaagccaagagaggaaccgcacaaataatggaagtaactgctaagtggctatggggtttcctttcacgcaacaaaaagcccaggatctgtacgcgagaggaatttacacggaaagtgagaagtaatgccgcaattggcgccgtcttcgtggacgagaaccagtggaactccgctaaggaggccgttgaagatgagaggttttgggacctggtgcatcgcgaacgtgagctccacaaacaggggaagtgcgcgacctgcgtctacaacatgatgggaaagcgggagaaaaagctgggcgagttcggtaaagcaaaggggagcagagccatctggtacatgtggttgggagctaggttcctggagtttgaagccctcggcttcatgaatgaggatcactggttttctcgcgaaaactcgctttcaggcgtggagggggagggactgcataaattaggttatattctgcgagacatcagcaagataccgggcgggaatatgtacgcagatgacactgctggatgggatacccggatcacagaagacgatttgcagaacgaggccaaaattacggacatcatggaacctgagcacgctctcctggccaagtccattttcaagctaacctatcaaaataaagtagttagagtgcagaggccagcaaagaacggcactgtcatggatgtgatcagtcgcagagaccagcggggttctggacaggtgggaacatacggccttaatacctttactaacatggaagcgcaactgataaggcagatggagagcgagggcattttctccccctcagaactcgagacacctaacctggccgggcgtgtcttggattggttagaaaaacatggagttgagcgactgaagcgcatggctatcagtggtgacgactgtgtggtaaaaccaatcgatgacagatttgccaccgcactcacagctcttaatgatatgggcaaggtgcggaaggacattccccagtgggaaccgtctaaagggtggaacgattggcagcaagtccctttctgcagccaccactttcatcagctgataatgaaggacggaagggagatcgtggttccctgtcgcaatcaggatgagctagtgggcagagcccgggtctcccagggtgcagggtggtcactgagggaaactgcctgcctcggaaaaagctatgcgcaaatgtggcagttgatgtacttccaccgacgtgacctgagacttgctgccaacgcaatttgttctgccgtgccagtagattgggttcctacctcccgcacgacctggagtatccatgctcaccatcagtggatgacaactgaggacatgctgagcgtgtggaatcgggtctggattgaagagaacccctggatggaagataagacccacatctcgtcctggggcgacgtgccatatctcggcaaaagggaggaccaatggtgcgggtctttaataggactgacagccagagcaacttgggctaccaatatccaggttgccattaaccaggtgcgccggttgatcggtaatgagaactacctggattacatgacgtcaatgaagaggtttaagaatgaaagcgaccccgagggcgcgctctggtga

SEQ ID NO: 13937 - RNA, 9879 nt, synthetic construct
  misc_feature 1..9879: note = derived and/or modified CDS sequence (opt3) from DENV-1__GU131763__SS-prME
  source 1..9879: mol_type = other RNA
agcgtgaccatgctgctcatgcttatgcccacagcactggctttccacttgactacgagaggaggggaacctcatatgatcgtcaccaagcaggaaaggggaaaatccttactgtttaagacatctgccggtgttaatatgtgcactctaattgcaatggacctcggagaactgtgtgaagataccatgacatacaaatgcccacggataaccgaagcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggcagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggccagcttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggccttggtgaggtggactccttttcactgggcttgctctgtattagtatcatgatcgaagaggtcatgaggagccgctggtcgcgaaagatgctgatggctgggaccctagccgtgttcctgctcctgattatgggacagcttacttggaacgatttgatccggctgtgcattatggttggcgcaaatgcttccgaccgtatggggatgggaacaacctatttagccctcatggcaacatttaaaatgagacctatgttcgccgtgggcctgctttttaggcgcctgacttctcgggaggtcctactcctgaccataggtttgagcctggtggcttcagttgaattaccaaacagtctcgaggaactgggggatggacttgcgatgggcatcatgattctgaagttgctcacggacttccaatcccaccagctgtgggccacactactgtctcttacctttatcaaaactaccctcagcctgcattacgcatggaagacaatggctatggtgttgtccattgtctcactgttccccttatgtctcagcactaccagtcagaagacgacatggctgccggtacttctgggctctttggggtgcaaacctctcaccatgtttctgatcgccgagaataagatatggggaagaaaatcctggccactaaacgaaggtatcatggccgtgggcgttgtgagcattctgctttcgtcactcctgaagaacgatgtccccttggctgggcctttaatcgcaggaggcatgctgattgcctgttatgtgatctctggtagttccgcggacctcagcctggagaaagctgccgaggtatcttgggaagaggaagcagagcacagcggggcctcccataatatacttgtggaagtccaggatgacggaactatgaagattaaagatgaggagagggacgatacactgaccatcttgctaaaggctactctgctcgcaatctcaggcgtttaccccctgagtattccagccacacttttcgtgtggtatttttggcaaaagaaaaagcagcgaagcggcgtgttatgggacaccccttctcccccagaagtcgagcgcgcggtgctggatgacgggatataccggatcatgcagagaggactcttgggtaggtcccaggttggcgtaggggtgttccaagaaaacgtcttccacacgatgtggcacgtgactcgtggagctgttctgatgtatcagggcaaacgcctcgagccgtcatgggccagtgtgaagaaagacctgattagctacggtgggggatggcggcttcagggctcctggaataccggcgaggaagtccaggtgatcgcagtagagcctgggaagaaccccaagaatgtccaaacagccccaggaacctttaaaacacccgaaggtgaggtgggcgctattgccctggatttcaagcctgggacttctggatcgccaatcgttaacagagaaggcaaaatagtgggtttgtacgggaatggagtcgtgaccacgagcggcacatatgtttcagcaatcgctcaggccaaggcgtcccaggagggccccctacctgagattgaagacgaggtgtttaggaaacgaaacctgactatcatggatctccatccggggagtggaaagacccggcgctacttaccagccattgtcagagaagcaatcaagaggaaactgcggacacttatactggctcccacccgagtggtagcctctgagatggctgaagcactcaagggtatgcctattagatatcaaactaccgccgtgaaaagcgagcacacaggcaaggagatcgttgacttgatgtgccatgccacgttcactatgcgcctgctctccccagtcagggtgcccaattacaacatgatcattatggatgaagctcactttaccgacccttcatctatcgcggcacgtgggtatataagcacacgggtgggaatgggcgaggccgctgccattttcatgaccgcaactccgcccggtagtgtcgaagcctttccacagtccaatgctgtaatccaggatgaggaaagagacattcctgagaggagctggaactctgggtacgagtggatcacagatttccccggaaaaaccgtgtggtttgttccatcaataaagtccggcaatgacattgcgaactgtctgcgcaagaatggcaaacgagtgatccagcttagtagaaagacgttcgatactgaatatcagaaaaccaagaacaacgactgggactacgtcgtgaccaccgatatcagcgagatgggggccaattttcgggcagacagggttattgatcctcgccgttgcctaaaacccgtgatcctgaaggacggaccagaaagagtcattttggctggtccgatgcctgtgactgtagcctcggcagcccagcggaggggccgcatagggcgaaaccataataaggagggagatcagtacatctatatgggccagcccttaaacaatgacgaggatcacgctcactggacagaagccaaaatgctgctcgacaacattaataccccagagggtatcatccccgcgctgttcgaacctgagagagaaaagtctgcagccattgatggggagtaccggcttaggggcgaggctcgcaaaacattcgtggaactgatgagaaggggagacctcccagtttggttgtcctataaggtcgccagcgagggctttcaatactcagatcggcgttggtgcttcgacggggaacgcaacaatcaggtgctggaggaaaacatggatgtggagatatggactaaagagggagaacgaaagaaactaagacccaggtggctggacgctcggacgtatagtgaccctctcgcacttcgcgagtttaaggagttcgccgctggtagaaggtctgtctccggcgatctgatcttagagattgggaagttgccgcagcatctgacccagcgggcccaaaatgcactcgacaacctggttatgcttcacaatagcgaacagggaggccgagcgtacagacatgccatggaggagctgccagatacaatcgaaactctcatgttgctggctttaattgccgtgctaaccggtggggtaacactgtttttcctctcaggccgcggacttggcaaaaccagtatcgggctgttgtgtgtgatggcaagctccgtcctgctctggatggcttctgtggagccccactggatagccgcaagcatcattctggaatttttccttatggttctcctgatccctgagcccgacaggcagcggactccacaggataaccaattggcctatgtggtcattggactgttatttatgatcctaacggtagctgcgaatgagatgggtctgctcgaaaccacaaagaaagaccttggcatagggcacgtggccgttgagaaccatcaccatgcaactatgctggatgtggacttgcaccctgcttccgcctggaccctgtacgccgtcgcaacaaccattatcactcccatgatgcgtcatacaattgaaaacacgaccgctaatatctcactcactgccatagcgaaccaggctgccatcctgatgggacttgataagggctggccaatttctaaaatggacatcggtgtgcctttactggcactcgggtgctacagtcaggtcaatccgttgacactgaccgccgctgtgctaatgctggttgcacactatgccattatcggccccggactccaagcgaaggctaccagagaggcccagaagaggacagcagccggcataatgaaaaacccaactgtggatgggattgtagctatcgaccttgatcctgtggtctacgacgccaagttcgaaaaacagctgggacagatcatgttgctgattctctgtacgtcgcaaatcctgttaatgcgcaccacatgggcactttgcgagagcataactctggctaccggccccctcacaaccctatgggagggttccccagggaagttttggaatactacgattgccgtttctatggcgaacatcttccggggatcatatctggccggcgcaggtttggcttttagcctgatgaaatccctcggcgggggacgaagaggcacaggggcccagggagaaacccttggcgagaagtggaagaggcagctgaatcagttgagtaaatctgagttcaacatttacaagcgcagcggtatcatggaggtggaccggtcagaagcaaaagaggggctgaagagaggagagactacccgtcacgctgtctccaggggcacagccaaactccggtggttcgtggaacgcaatttagtaaagcctgagggtaaggtgatagatctgggctgtgggcgaggaggctggagttattactgcgccgggcttaaaaaggttactgaagtgaaaggatataccaagggcggtcccgggcatgaggaaccgatcccaatggcgacatacggatggaacctggtcaaactacacagcggcaaggacgtgtttttcacgcctcccgagagatgtgataccctcctgtgcgacattggcgagtcttccccaaatcccactatcgaagaggggaggacattgcgggtcctgaaaatggtggaaccttggctccgcggaaaccaattttgtattaagatccttaatccgtacatgccctcagttgtagagaccctggagcagatgcagagaaagcatggtggcatgttagtgaggaacccactgagccgaaattcgactcacgaaatgtattgggtctcttgcgggacaggaaacattgtgagtgctgttaatatgacctcccggatgttgctcaaccgtttcacgatggcacacagaaaacctacctacgagcgcgatgtggacctgggcgccggtacaaggcatgtcgctgtggaacccgaggtagccaacctagatatcatagggcagcggattgaaaatatcaagcacgagcataaaagcacttggcactatgacgaggataacccttacaagacctgggcatatcatggatcatacgaagtgaaaccatccggctctgccagcagtatggttaatggcgtcgtgaaacttctgacaaagccctgggacgtgatccctatggtcactcaaattgctatgaccgatacaaccccatttgggcagcagagagttttcaaagagaaggtggacactcgcacgcccaaagcgaagaggggaacagcccaaataatggaagtaaccgcacgatggctctggggttttctgtcccggaacaaaaagccgagaatctgtactagggaggagttcacccgcaaggtgcgtagcaatgctgccattggcgcagtctttgtggacgagaaccagtggaactctgccaaagaggctgttgaagatgagcggttctgggacttggtgcagaaggaaagagagctgcacaaacaggggaagtgcgccacatgcgtctataacatgatgggaaaaagggaaaagaagctcggcgagtttggtaaagcgaaggggtcacgcgcaatctggtacatgtggcttggagcccgattcctggagtttgaggctttaggcttcatgaatgaggatcactggttcagtcgggaaaactccctgagcggcgtggagggggagggattgcataaactcggttacattctgagagacatctctaagatacctggcgggaatatgtatgccgatgacacggcaggatgggataccaggatcactgaagacgatctacaaaacgaggctaaaattacagacatcatggaaccagagcacgcccttctggctacctcgatttttaagctcacttaccagaataaagtagttcgcgtgcagagacccgccaagaacggcacagtcatggatgtgatctcacggagggaccagcgtggtagcgggcaagtgggaacctatggcctgaatacattcactaacatggaagcacagttgatacgacagatggagtccgagggcatatttttacctagtgaactggagaccccaaacctcgcggaacgcgtccttgattggctggagaagcatggggttgaaagactaaaacggatggccatctctggagacgactgtgtggtaaagcccatcgatgacaggttcgctacggccctgaccgcactcaatgatatgggtaaagtgcgcaaggacattccgcagtgggagcctagcaaaggctggaacgattggcaacaggtccccttttgctcccaccacttccatcagttgataatgaaggacgggagagagatcgtggttccatgtcggaatcaggatgaactggtgggaagggctcgagtctcacaaggcgccggttggagtcttcgtgagacagcatgcctggggaagtcttacgcccagatgtggcagctcatgtattttcacagacgcgacttacggctggcggctaacgccatttgtagcgcagtgcctgtagattgggttcccacttccaggaccacatggtcaatccatgcccaccatcaatggatgactaccgaagacatgttgagcgtgtggaataaagtctggattgaggaaaacccatggatggaggataagacgcacgtgtcttcctggggagacgttccctacctgggcaaaagagaggaccagtggtgcggcagtctcatcgggcttacagctcgcgccacctgggcaagcaatatacaggtggctatcaaccaggtccggaggctgattggaaatgaaaactatctagattacatgacttcgatgaagcgattcaaaaatgagggtgaccctgaaggcgccctgtggtga

SEQ ID NO: 13938 - RNA, 9879 nt, synthetic construct
  misc_feature 1..9879: note = derived and/or modified CDS sequence (opt3) from DENV-1__GU131766__SS-prME
  source 1..9879: mol_type = other RNA
agcgtgaccatgctgctcatgcttatgcccacagccctggctttccacttgactacgagaggaggggagcctcatatgatcgtcaccaagcaggaaaggggaaaatccttactgtttaagacatctgccggtgttaatatgtgcactttaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaattgaacacggcacgacagccaccatcactccccaggcgcctaccagtgagatccagctgacagactacggggccctcacccttgattgtagcccaaggactggactggacttcaacgaaatggtgttgctaacaatgaaggagaaatcttggctggtccataagcagtggtttctcgatctgccgcttccctggacgtccggcgcatcaaccagccaagagacttggaatcggcaggacctgttggtgacattcaaaaccgctcacgccaagaagcaggaagtagttgtgctcggtagtcaagagggggctatgcacacagccctgactggcgcaaccgaaattcagacgtctggaaccacaactatatttgccggccatttaaaatgccgtctgaagatggataaactaaccctcaaggggatgtcctatgtcatgtgtacaggtagcttcaaactggagaaggaagtggctgagactcagcacggaaccgtccttgtgcagatcaagtacgagggcacggacgcgccttgcaaaattccattctcgacacaagatgaaaagggggttacccagaacggacgcttgatcactgcaaatcccatagtgattgacaaagagaagcctgtaaacatcgaagccgagccaccctttggcgagtcttatatcgtcattggtgctggggaaaaagccctgaagctctcctggttcaagaaaggctcaagtatcggaaagatgtttgaggcaacagccagaggcgctaggcggatggccattctgggggataccgcatgggacttcggaagcataggtggcgtgtttacttccatcgggaaacttgttcatcagattttcggaaccgcgtacggcgtgctgttttctggtgtcagctggacaatgaagatcgggatcggcgtgttgctcacgtggctgggattaaattcacgaagtacctccctgagcatgacttgtattgctgtaggcctagtgacactctacctgggggttatggtccaggccgattctggatgcgtgataaactggaaaggccgcgaacttaagtgtggttcagggatcttcgtgaccaatgaggtccacacatggactgaacaatataagtttcaggcagacagtccgaaaagattgagcgccgctattggaaaggcctgggaggagggcgtttgcggtatcaggtccgcaacccggctggaaaacattatgtggaaacagatctctaacgagctcaatcatatactgttagaaaacgacatgaagttcacggtggtggtaggcgatgtcgtggggatcctggctcagggcaagaagatgattcgccctcaacccatggagcacaaatactcgtggaaaagctggggcaaggccaaaatcattggggcggacgttcagaatacaacctttatcatagatggaccaaacactcctgaatgtcccgacgatcagagagcctggaatatttgggaggtggaggactatggcttcggtatctttaccacaaacatttggcttaagatgagggattcctacactcaggtctgcgaccaccgtttgatgtcagctgcaatcaaagatagtaaggccgtgcatgctgacatggggtattggatagaatctgagaaaaatgaaacctggaagctcgcccgggcatccttcatcgaggttaagacatgtatttggccaaaatcccacacgctgtggtcaaacggagtgctagaaagcgagatgatcattcccaagatctacggcggtcctatatctcaacataattatcgaccaggctacttcacccagactgcggggccgtggcacctgggaaaactcgagctggattttgacctttgcgaaggcacaaccgtagtcgtggatgagcactgcgggaacagaggaccctccttgaggactacaaccgtgacgggcaagattatccatgaatggtgttgccgcagttgtactctgcctccattacggttcaaaggtgaggacgggtgctggtacggaatggagatcagacccgtcaaggaaaaggaggaaaatctcgttaaaagcatggtgtctgccggctccggtgaggtagactcatttagtctgggccttctgtgtattagcatcatgattgaagaggtgatgaggtcgcgctggtcccgaaagatgttgatgaccgggacactcgctgtcttcctgctactgataatgggacagctcacctggaacgatctgatccggctttgcattatggtgggcgccaatgcatctgaccgtatggggatgggaactacatatttggctctgatggccacctttaaaatgagacctatgttcgcagttggcttactctttaggcgcctgacaagccgggaggtgcttctgctaactatcggtctctcactggtcgccagtgtggaattgccaaactccctggaggaattaggggatggactcgctatgggcattatgatcctgaaacttctgaccgacttccaatctcaccagttgtgtgcgacgctcctgagcctaacatttataaaaaccactctgtcccttcattacgcctggaagaccatggcaatggttctctcaatcgtgagcctgattcccttgtgcctgagtacaacttctcagaagaccacgtggttaccggtcctcctgggctcccttgggtgtaaacctctgacaatgttcttgatcgctgagaataagatttggggaagaaaaagctggccactcaacgaaggtatcatggccgtaggcgtggtttcgatactgctatcatctctgcttaagaacgatgtgcccctcgccgggcctctgattgctggaggcatgttgatcgcatgctatgtcatcagtggttccagcgccgacttatctctggagaaagcggctgaggtgagctgggaagaggaagccgagcactccggggcatcacataatattctcgtagaagtgcaggatgacggaaccatgaagataaaagatgaggagagggacgatactctgacaatccttctgaaggccaccttgctagctgtcagtggcgtttaccccctgagcattccagcaactctctttgtgtggtatttctggcaaaagaaaaagcagcgatctggcgtgctgtgggacacaccttcacccccagaagtcgagcgcgccgtgcttgatgacgggatctaccggattatgcagagaggattactgggtaggagccaggttggcgtaggggtgtttcaagaaaacgtcttccacaccatgtggcacgtgacgcgtggagcggttctcatgtatcagggcaaacgcttggagccgagttgggctagcgtgaagaaagacctgatctcctacggtgggggatggcggctccagggctcttggaatactggcgaggaagtccaggtgatagccgtagagcctgggaagaaccccaagaatgtccaaaccgcaccaggaacattcaaaacccccgaaggtgaggtgggcgccatcgctctggattttaagcctgggacatcgggaagcccaattgttaacagagaaggcaaaatcgtgggtctttacgggaatggagtcgtgactacctcaggcacgtatgtttccgccattgcacaggctaaggccagtcaggagggccccctgcctgagatcgaagacgaggtgttcaggaaacgaaacttgacaataatggatctacatccggggtctggaaagactcggcgctacctgccagcgattgtcagagaagccatcaagaggaaactccggaccttaatcctggcacccacacgagtggtagctagcgagatggccgaagctcttaagggtatgcctattagatatcaaaccactgcagtgaaatccgagcacaccggcaaggagatcgttgacctgatgtgtcatgccacatttacgatgcgcctcttgtcaccagtcagggtgcccaattacaacatgataattatggatgaagcccacttcactgacccttctagcatcgctgcgcgtgggtatattagtacccgggtgggaatgggcgaggcagccgctatctttatgacagccaccccgcccggttccgtcgaagcattcccacagagcaatgccgtaatacaggatgaggaaagagacattcctgagaggtcttggaactcagggtacgagtggatcactgattttcccggaaaaacagtgtggttcgttccatccatcaagagtggcaatgacattgctaactgcctgcgcaagaatggcaaacgagtgatccagctcagcagaaagacctttgatacggaatatcagaagactaagaacaacgactgggactacgtcgtgacaaccgatatttcggagatgggggcgaatttccgggccgacagggttatagatcctcgccgttgcctgaaacccgtgatccttaaggacggaccagaaagagtcattctagcaggtccgatgcctgtgaccgtagcttctgccgcacagcggaggggccgcatcgggcgaaaccataataaggagggagatcagtacatctatatgggccagcccctgaacaatgacgaggatcacgcccactggactgaagctaaaatgttgttagacaacattaatacaccagagggtataatccccgccctgtttgaacctgagagagaaaagtccgcggcaattgatggggagtaccggctcaggggcgaggcccgcaaaaccttcgtggaactgatgagaaggggagaccttccagtttggctgagctataaggtcgcttcagagggcttccaatacagtgatcggcgttggtgttttgacggggaacgcaacaatcaggtgctcgaggaaaacatggatgtggagatctggacaaaagagggagaacgaaagaaattgagacccaggtggctggacgcccggacttattctgaccctctagctctgcgcgagttcaaggaatttgcagccggtagaaggtccgtcagcggcgatctcattcttgagatcgggaagctgccgcagcatttaacgcagcgggctcaaaatgccttggacaacctggttatgctccacaattcagaacagggaggccgagcatacagacatgcgatggaggagctgccagataccatagaaacacttatgctgctcgccttgatcgctgtgctgactggtggggtaaccttattctttctaagtggccgcggactgggcaaaacaagcattgggctcctttgcgtgatggcctcctctgtcctgttgtggatggcaagcgtggagccccactggatcgctgcctccattatcctggagttctttctcatggttctgcttatacctgagcccgacaggcagcggaccccacaggataaccaactcgcatatgtggtcattggactgttgttcatgatcctgactgtagccgctaatgagatgggtttactagaaacgaccaagaaagacctgggcattgggcacgtggcggttgagaaccatcaccatgccacaatgctcgatgtggaccttcaccctgcatcagcttggactctgtacgccgtcgccaccacaatcataacccccatgatgcgtcatactatcgaaaacacaacggcaaatatttctttgaccgctatcgccaaccaggcggctattctgatgggactcgataagggctggccaatcagtaaaatggacataggtgtgcctctgcttgccttagggtgttactcgcaggtcaatccgctgactctcacagcagccgtgttgatgctggttgctcactatgcaattatcggccccggactacaagccaaggcgaccagagaggctcagaagaggaccgccgcaggcatcatgaaaaacccaacagtggatgggattgtagccatcgacctggatcctgtggtctacgacgctaagtttgaaaaacagctcggacagataatgcttctgattttgtgcactagccaaatcctgctcatgcgcacgacctgggccctgtgtgagtccattacattagcaactggcccccttaccacactgtgggagggttctccagggaagttctggaataccactatcgctgtttcaatggccaacatatttcggggaagctatctcgcgggcgccggtctagcattctccctgatgaaaagtttgggcgggggacgaagaggcacgggggctcagggagaaacactgggcgagaagtggaagaggcagctcaatcagctttctaaaagcgaatttaacatctacaagcgctcaggtattatggaggtggaccggtccgaagccaaagaggggctgaagagaggagagaccactcgtcacgcagtcagtaggggcaccgctaaattgcggtggttcgtggaacgcaatctggtaaagcctgagggtaaggtgatcgatctcggctgcgggcgaggaggctggagctattactgtgccgggctaaagaaggttacagaagtgaaaggatatactaagggcggtcccgggcatgaggaaccgattccaatggccacctacggatggaacctggtcaaacttcactctggcaaggacgtgttctttacacctcccgagaaatgcgatacgctgctatgtgacatcggcgagtcctcaccaaatcccaccattgaagaggggagaactctcagggtcctgaagatggtggaaccttggttgcggggaaaccaattctgcatcaagatactgaatccgtacatgcccagcgttgtagagacactcgagcagatgcagcgcaaacatggtggcatgcttgtgagaaacccactgtcgagaaattctacccacgaaatgtattgggtcagttgtgggactggaaacattgtgtccgcggttaatatgacaagccgaatgttactgaaccggtttaccatggctcaccgtaagcctacgtacgagaaagatgtggacttgggcgcaggtaccagacatgtcgccgtggaacccgaggtagctaacctcgatatcatcgggcagcgcattgaaaatataaagcacgagcataaatcaacatggcactatgacgaggataacccttacaagacttgggcctatcatggatcctacgaagtgaagccatctggcagcgcaagttccatggttaatggcgtcgtgaaactgctaaccaagccctgggacgtgatccctatggtcacacaaattgccatgactgataccacaccattcgggcagcagagggtttttaaagagaaggtggacacccggactcccaaagctaagagaggaacggtacaaatcatggaagtgacagcgcgctggctttggggtttcctgagcaggaacaagaaaccgcgaatttgcacccgggaggaatttactagaaaggtcaggtctaatgccgcaatcggcgctgtgttcgttgacgagaaccagtggaactcagccaaagaggcagtggaagatgagcgcttttgggacctcgtcaagaaagaacgtgagctgcacaagcaggggaagtgcgccacctgtgtgtataacatgatgggaaaacgggaaaagaaattgggcgagttcggtaaggctaaagggagtagagccatatggtacatgtggctgggagcgaggtttctcgagttcgaagcacttggctttatgaatgaggatcactggttctcccgcgaaaacagcctgtctggcgtagagggggagggattacataagctgggttacatcttgcgagacatttcgaaaatccctggcgggaatatgtatgccgatgacacagctggatgggatacgcggattaccgaagacgatctccagaacgaggccaagatcactgacataatggaaccagagcacgcactgctagctacatcaattttcaaacttacctaccaaaataaagttgtgagagtccagaggcccgccaagaacggcactgtgatggatgtgatcagccgcagagaccagcggggttccgggcaggtcggaacatatggcctgaatacctttacaaacatggaagctcaactcatcaggcagatggagagtgagggcattttcctgccttctgaattggagactccaaacttagccgaacgtgttctggattggctcgagaaatacggggtggaacgacttaagcgcatggcaataagcggagacgactgcgtagtgaaacccatcgatgacagatttgcgaccgccctgacggctctaaatgatatgggtaaggtccggaaggacattccgcagtgggagccttccaaaggctggaacgattggcagcaagtgcccttctgttcacatcactttcaccagctgatcatgaaggacgggagggagattgttgtgccatgccgcaatcaggatgaactcgtcggaagggcacgggtgagtcagggcgcaggttggtctttgagggagaccgcttgtctggggaaaagctatgcccaaatgtggcagcttatgtacttccatcgacgtgacctgagactcgcagccaacgcgatctgctccgctgtacctgttgattgggtgcccacatcacgcactacctggagcatacacgcccatcaccagtggatgacaactgaagacatgttatctgtctggaatcgggtgtggatcgaggaaaacccatggatggaggataagacccatgtttccagttggggagacgtgccctatctgggcaaaagggaggaccaatggtgtggcagcttgattgggctgacggcaagagccacatgggcttcgaatatccaggtcgccattaaccaggtgcgccggctcatcggaaatgaaaactaccttgattacatgacctccatgaagaggtttaagaatgagggtgaccctgaaggcgcactgtggtga

SEQ ID NO: 13939 - RNA, 9879 nt, synthetic construct
  misc_feature 1..9879: note = derived and/or modified CDS sequence (opt3) from DENV-1__GU131767__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagttggtgtgaacatgtgcacactaattgcaatggacctcggcgagttctgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggccttggtctggagactagaaccgaaacatggatgtcctctgagggggcatggaaacagatccagagggttgaaacttgggccttgcggcaccctggatttaccgtgattgctctcttcctggcacatgccatcggcacatcgattacccagaagggcatcatatttatcctgctcatgttagtcacgccatcaatggctatgcgctgcgtggggattggaagcagagatttcgtagagggtctgagtggcgccacttgggttgacgtggtccttgagcacgggtcctgtgtgacaaccatggcgaaggataaacccactttggacatcgaactgctaaagacagaggtgaccaaccctgcagtcctcaggaaactgtgcattgaagccaagatctctaatacgaccacagatagccggtgtccaactcaaggagaggctacccttgttgaagagcaggacgccaactttgtgtgccgccgaacattcgtagatagaggctggggtaatgggtgtggactgtttggcaaaggctccttgataacttgcgcaaagttcaagtgcgtgaccaaactcgaggggaagattgtccagtacgaaaacctgaaatattcagtgatcgttacagtgcacaccggagaccagcatcaagtcggtaatgagagtactgaacacggcacgacagctaccattactccccaggcccctagcaccgagatccagttaacagactacggggcgctgaccctcgattgttctccaaggactggacttgactttaacgaaatggtgctgttgacaatgaaggagaaatcctggctagtacataagcagtggttcctggatctcccgctgccctggacgtcaggcgccagcaccagtcaagagacttggaatcggcaggaccttctggttacatttaaaaccgcacacgctaagaagcaggaagtggtcgtgttgggttctcaagagggggccatgcacacagctctcactggcgccaccgaaatccagacgtccggaaccacaactattttcgcaggccatctgaaatgccgtttaaagatggataaactgaccctaaaggggatgagctatgtcatgtgtacaggatcgttcaaactcgagaaggaagtggccgagactcagcacggtaccgttctggtgcagataaagtacgagggcacggacgctccttgcaaaatcccattttctacacaagatgaaaagggggtaacccagaacggacgccttattactgcgaatcccatcgtcacagacaaagagaagcctgtgaacatagaagcagagccacccttcggcgagtcctatattgttatcggtgccggggaaaaagctttgaagctgtcatggtttaagaaaggcagtagcatcggaaagatgttcgaggccaccgcaagaggcgccaggcggatggctattctcggggatactgcctgggactttggatccatcggtggcgtgttcacctctgtcgggaaactggtgcatcagatttttggaacagcatacggcgtacttttcagcggtgtgtcatggacgatgaagatagggatcggcgttctgttgacctggctcggactgaatagtcgatccactagcttatctatgacatgtattgcggtcggcctggtgaccctatacctcggggtgatggtccgcgctgattcaggatgcgttatcaactggaaaggcagagaactgaagtgtggtagtgggatctttgtgacaaatgaggtgcacacttggaccgaacagtataagttccaagccgacagcccgaaaaggctttccgcagccattggaaaggcttgggaggagggcgtatgcggtatacggtctgccacgcgcttggaaaacatcatgtggaaacagatttcgaacgagctgaatcatatcctcctggaaaacgacatgaagttaacagtcgtggttggcgatgtggcagggattctggctcagggaaaaaagatgatcagacctcagcccatggagtacaaatatagctggaagtcctggggcaaggccaaaataatcggggcggacgtccaaaataccacttttattatcgatggaccaaacacccctgaatgtcccgacgatcagagggcctggaatatttgggaggtggaggactacggcttcggtatctttacaactaacatatggcttaagttgcgtgattcatatacccaggtttgcgaccaccggctcatgagtgctgcaattaaagattctaaggccgtgcacgctgacatggggtactggatcgaaagcgagaaaaatgaaacatggaagctggcccgagcatccttcattgaggtaaagacgtgtatctggccaaaatcacataccctatggagcaacggagtcctggaatctgagatgataatccccaagatttatggcggtcctatctcccagcacaattacagaccaggctacttcactcaaacagcggggccgtggcatctcggaaaactggagcttgattttgacttgtgcgaaggcaccactgtggtggtcgatgagcactgcgggaacaggggacccagtctgcgcacaaccacggttactggcaagattatccacgaatggtgttgccggagctgtaccttacctccactcagattcaaaggtgaggacgggtgctggtatggaatggagataaggcccgtgaaggaaaaggaggaaaatctggtaaaatctatggtgtccgccggctcaggtgaggtcgacagttttagccttggcctgttgtgtatttcgatcatgatcgaagaggtgatgcgctcccgatggtctcggaagatgctcatgacagggaccctggctgttttctttctactgattatgggacagctcacttggaacgatctgatccgtctttgcattatggtgggcgccaatgcaagcgacagaatggggatgggaacaacctacttggctctgatggccacattcaaaatgaggcctatgtttgcagtcggcttactcttccgccggctgacttcaagagaggtgcttctgctaaccataggtctcagtctggttgcctccgtggaattgccaaactctctggaggaattaggggatggactcgctatgggcatcatgattctgaagcttctgacggactttcagagccatcaattgtgggcgacactcctgtccctaaccttcatcaggactaccttttcactgcactatgcctggaaaacaatggcaatggtccttagcattgtaagtctcttccccctgtgtttgtctactacctcccagaagacgacatggctgccggtgttactcggcagcctggggtgcaagcctcttaccatgtttctgatcgctgagaataaaatatggggacgaaagtcgtggccattgaacgaaggtatcatggccgttggcattgtgtcaatcctcctgtctagtctactgaaaaacgatgtcccccttgccgggcctctcattgctggaggcatgctgatcgcatgttacgtgatatccggtagctctgccgacttgagcttagagaaggcggctgtagtgtcctgggaggaagaggccgaacattcaggggcaagtcacaatattctggtcgaggttcaggatgacggaactatgaaaatcaaggatgaagagcgcgacgatacactcaccatcctgcttaaagccactctgttggctgtgagcggcgtgtatcccctatctattccagcaacactgttcgtctggtacttctggcagaagaagaaacaacggtccggcgtgctctgggacaccccttcacccccagaggttgaaagagccgtactggatgacgggatatataggatcatgcagcgtggacttttaggtcgcagtcaggtgggcgtcggggtgtttcaggagaacgttttccatacgatgtggcacgtgactcggggagcggtcctgatgtaccaaggcaagagactcgaaccgagctgggcttccgtgaaaaaggacttgatttcttacggtgggggatggaggctgcagggctcgtggaataccggcgaggaggtacaggtcatcgccgtggaacctgggaaaaaccccaagaatgttcagacagcaccaggaacctttaagacaagcgagggtgaagtgggcgccattgctctcgatttcaaacccgggacttcaggatcccctatcgtcaaccgagagggcaagatagtgggtctgtatgggaatggagttgtgaccacgagtggcacatacgtctctgccatcgcacaagctaaagccagccaggaaggcccacttcccgagattgaggacgaagtgtttcggaagcgcaacctgactatcatggatttgcaccctgggtccggaaaaaccagaaggtatctaccggcgattgtacgggaggccatcaagcgaaagctgagaacactcatattagcaccaacccgcgtggttgcttcagaaatggccgaggctctgaaaggtatgcccattaggtaccagactaccgcagtcaagtctgaacatacaggcaaagagatcgtggaccttatgtgccacgccacgttcactatgcgtctgctcagccctgtgcgggtcccaaattataacatgatcattatggatgaggcccattttaccgaccccagttccatcgctgcgagagggtacataagcacaagggtaggaatgggcgaagcagccgctattttcatgaccgccactcctccgggttctgtggaggcatttccccaatcaaatgccgttatccaggatgaagagcgcgacattccagaacgatcctggaacagtgggtatgagtggatcacagatttccctggaaagaccgtgtggtttgtccccagcataaaatcgggcaatgacattgctaactgtttgagaaagaatggcaagcgggtgatccagctgtctaggaaaacgttcgatactgagtaccagaagacaaaaaacaacgactgggactacgttgtgaccaccgatatctccgaaatgggggcgaatttccgcgccgaccgtgtcattgatccaagacggtgcctcaagcctgtgatcctgaaagacggacccgagagggtaattcttgcaggtccaatgccggtgactgttgctagcgccgcacaacgccgaggcagaatagggcggaaccacaataaggaaggagatcagtatatctacatgggccagcctctaaacaatgacgaggatcatgcccactggacagaggctaagatgctgttggacaacattaatacccccgaaggtatcatcccagccttatttgagcccgaaagggagaaatcagcggcaattgatggggaatatcgcctgagaggcgaggccaggaagacattcgtcgagctcatgcggcgtggagacctgcctgtgtggcttagttacaaagtggcttctgaaggctttcagtattccgatcgccgatggtgcttcgacggggagagaaacaatcaagtcctggaagagaacatggatgttgaaatatggactaaggagggagagaggaaaaagctccggccacgctggttggacgccagaacgtacagcgaccccctggctctaagggaatttaaagagttcgcagccggtcggcgatcagtgagtggcgatctgatcctcgaaattgggaagcttcctcagcacctgacccagagagctcagaatgccttagacaacttggtaatgctgcataatagcgagcaaggaggccgcgcatataggcacgcgatggaagagctcccggatacaatcgagactctgatgcttctggccctcattgctgtgttgaccggtggggtcacactgtttttcttatccggccggggactaggcaagacctctatcgggctgctctgtgtgatggccagctccgttcttctgtggatggcatcagtggaaccacattggatagctgcctctatcattttggagtttttcctgatggtcctcctgatccccgaacctgaccgtcagagaactccccaggataaccagcttgcatacgtagtgattggactcctgtttatgatcttgacggttgccgctaatgagatgggtctgttagagaccacaaaaaaggacctaggcatagggcacgtggcggtcgaaaaccaccatcacgccgcaatgctggatgtggacctccatccagctagtgcctggactctttacgccgtcgcaaccacaattatcacccctatgatgaggcacactattgagaacacaacggctaatatctcgctgaccgccatagcgaaccaagctgccatcttgatgggactggataaaggctggcccattagcaagatggacatcggtgtgccactcctggcacttgggtgctattcccaggttaatcctttaactctgacagccgctgtgctcatgttggtagcacattacgccattatcggcccgggactgcaggcgaaagctacccgcgaagcccaaaagcggaccgcagccggcataatgaagaaccccacagtggatgggattgtcgctatcgacctagatccagttgtgtatgacgccaaattcgagaagcagctgggacagatcatgctccttattctgtgtacttctcagatcttgctgatgcgaacgacctgggcactctgcgaatcaataacactggctactggccctttaaccacactttgggagggtagccccgggaaattttggaataccactattgccgtctccatggcgaacatcttcagaggaagttacctggccggcgcaggtctcgctttctctctaatgaagagcctgggcgggggaaggcgcggcacgggggcccaaggagagacattgggcgaaaaatggaagcggcagctgaatcagctctcaaagtccgagtttaacacctataaaagaagtggtattatggaagtggaccgtagcgaggcaaaggaagggcttaaaaggggagagactaccaagcacgctgtatctcggggcacagccaaactgcgctggttcgtggagcgaaatttggttaagccagaaggtaaggtgatcgatctgggctgtgggagaggaggctggtcctactattgcgccgggctcaaaaaggtcactgaggtgaaaggatacaccaagggcggtcctgggcacgaagagcccataccgatggcgacatacggatggaacttagtcaaactgcattcaggcaaggacgtgtttttcatcccacctgaaaaatgtgatacgcttctgtgcgacattggcgagagctcgcccaatccaaccatcgaggaagggaggactctacgggttctcaagatggtagagccctggctgcgcggaaaccagttttgtattaagatcttgaatccttatatgccgtctgtggtcgaaacactggagcaaatgcagagaaaacacggtggcatgctcgtgaggaacccccttagtcgaaattccacccatgagatgtactgggttagctgcgggactggaaacattgtgtcagctgtcaatatgacatcccggatgctgttaaaccgtttcaccatggcacacagaaagccaacgtatgaacgcgatgtggacctgggcgccggtaccaggcacgtagctgtggagcctgaagttgccaacttggatatcatagggcagcggattgagaatatcaaacatgaacacaagtctacatggcattacgacgaggataacccctataaaacttgggcataccacggaagctatgaggtcaagcctagtggctccgccagctctatggtgaatggcgtggtcaagctcctgaccaaaccatgggacgttatccccatggtgacacagattgctatgactgataccacaccttttgggcaacagagagtattcaaggaaaaagtggacacccgcactccaaaggcgaaaaggggaacggcccagataatggaggtcacagcaaagtggctatggggttttctttcacgaaacaagaaaccccggatctgtaccagagaagagttcactaggaaggtgcgcagtaatgctgccattggcgcagtttttgtggacgaaaaccaatggaattccgccaaagaggctgtcgaggatgaacgtttctgggacctggtgcatcgggagagagaactccacaagcaggggaaatgcgccacctgcgtatacaacatgatgggaaagagggagaagaaactgggcgaatttggtaaggcgaaagggagccgcgcaatctggtacatgtggttgggagcccgattcctggagttcgaggctctcggctttatgaatgaagatcactggttctctcgggagaactcgctttcaggcgttgaaggggagggactgcataagttaggttatattctgagagacatcagcaaaataccgggcgggaatatgtacgccgatgacacagcaggatgggatacgaggatcaccgaggacgatttgcagaacgaagctaagattactgacatcatggagcctgaacacgccctcctggctaaatccatttttaagctaacatatcagaataaggtggtccgcgtgcaaagaccagccaaaaacggcaccgtgatggatgtcatcagtcggagggaccagcgtggttctgggcaggttggaacttacggccttaatacattcaccaacatggaggcacagctgatacgacaaatggaaagcgagggcattttttccccctcagagctcgaaacacctaacctggcggggcgcgtgttggattggttagagaagcatggagtagaaagactgaaacggatggccatcagtggtgacgactgtgtggtcaagccaatcgatgacaggttcgctactgccctcaccgcacttaatgatatgggcaaagtgcgcaaggacattccccagtgggagccgtctaaggggtggaacgattggcagcaggttcctttttgcagccaccacttccatcaactgataatgaaagacggaagagaaatcgtggtcccctgtcggaatcaggatgagctagtgggcagggctcgagtatcccagggtgccgggtggtcactgcgtgagacggcatgcctcggaaagagctatgcccagatgtggcaattgatgtactttcacagacgcgacctgcggcttgcggctaacgccatttgttctgcagttccagtggattgggtccctacctccaggacaacttggagtatccatgcccaccatcagtggatgaccacagaagacatgctgagcgtgtggaatagagtttggattgaggaaaacccctggatggaggataaaactcacatctcgtcctggggcgacgtgccatatctcggcaagcgcgaagaccagtggtgcgggtctttaataggactgaccgctcgggccacgtgggcaacaaatatccaagtcgctattaaccaggtgaggcgattgctgggtaatgagaactacctcgattacatgacctcaatgaaaagattcaagaatgagagcgaccccgaaggcgccctttggtga

SEQ ID NO: 13940 - RNA, 9879 nt, synthetic construct
  misc_feature 1..9879: note = derived and/or modified CDS sequence (opt3) from DENV-1__HM181967__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacgctaattgccatggacctcggcgaactgtgtgaagatactatgacctacaaatgcccacggattacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagacccttctagcatcgcggcaagggggtacataagtacccgcgtgggaatgggcgaggccgctgccattttcatgactgcaacaccgcccggttccgtcgaagcctttccacagagcaatgctgtaatccaggatgaggaacgagacattcctgagagatcttggaactcagggtatgagtggatcaccgatttccccggaaagacggtgtggtttgttccatccataaaaagtggcaatgacattgcgaactgtttgcggaagaatggcaaaagggtgatccagctgagccgcaagactttcgatacagaataccaaaagaccaaaaacaacgactgggactacgtcgtgaccactgatatctcggagatgggggccaatttccgtgcagacagagttattgatcctcggaggtgcctcaagcccgtgatcctgaaagacggaccagaacgcgtcattcttgctggtccgatgcctgtgacagtagcctctgcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttatttgaacctgagcgcgaaaagtccgcagccattgatggggagtatagactgaggggcgaggctcggaagactttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatatggacgaaggagggagaacggaaaaagctccgccccagatggttggacgctaggacctactctgaccctctggcactacgggagtttaaagagttcgccgctggtcgaagatccgtcagcggcgatctgatcctcgagattgggaaacttccgcagcacctgacacagcgcgcccaaaatgcattagacaacttggttatgctgcataattcagaacagggaggcagggcgtatcggcacgccatggaggagctcccagatactatcgaaaccctgatgcttctggctctcattgccgtgttgacaggtggggtaaccctgtttttcttaagtggccgtggactaggcaaaactagcatcgggctgctctgtgtgatggcatcctctgtccttctgtggatggctagcgtggagccccattggatagccgcatccatcattttggaatttttcctgatggttctcctgatccctgagcccgacagacagaggacgccacaggataaccaacttgcctacgtggtcattggactcctgtttatgatcttgaccgtagctgcgaatgagatgggtctgttagaaacaactaagaaggacctaggcatagggcacatggccgtggagaaccaccatcacgcagctatgctggatgttgacctccatcctgcctcagcctggaccctttacgcagtggctacaaccattatcactcccatgatgcgccacacaattgaaaacacgaccgccaatatctctctgactgcgatagctaaccaggccgcaatcttgatgggactggataaaggctggccaattagtaagatggacatcggtgtccctctcctggcccttgggtgctatagccaggtgaatccgttaacactgaccgctgcagtcctcatgttggtggcccattacgcgattatcggccccggactgcaagctaaagccacccgggaggcacagaagcgaacagccgctggcataatgaaaaacccaactgttgatgggattgtggccatcgacctagatcctgtagtgtatgacgcaaagttcgaaaagcagctgggacagatcatgctccttattctgtgtacgagccaaatcttgctgatgagaaccacatgggctctctgcgagtccataactctggccaccggccccttaacaaccctttgggagggttctccagggaaattttggaatactacgattgcggtctcaatggccaacatcttcaggggaagctacctggcaggcgctggtctcgccttctccctaatgaagagtctgggcgggggacgccggggcacaggggcacagggagaaaccttgggcgagaaatggaagagacagctgaatcagctctctaaaagcgaatttaacacttataagcgttcaggtattatggaggttgacaggtccgaagctaaggaggggcttaaacggggagagaccacaaagcacgccgtgagtcgcggcactgccaaactgcgatggttcgtcgaaagaaatttggtgaagcctgagggtaaagtaatcgatctgggctgtgggaggggaggctggagctactattgcgcggggctcaagaaggtgaccgaagttaaaggatacacaaagggcggtcccgggcacgaggaaccgataccaatggctacgtacggatggaacttagtgaaactgcattctggcaaggacgtctttttcatccctcccgagaaatgtgatacccttctgtgcgacattggcgagtcctcaccaaatcccactatcgaagaggggcggacactacgcgtgctcaagatggtcgaaccttggctgagaggaaaccaattttgtattaaaatcttgaatccgtatatgcccagcgtggttgagaccctggagcagatgcagaggaagcacggtggcatgctcgtacgaaacccactttcgagaaattctactcatgaaatgtactgggtgagttgcgggacaggaaacattgtctccgcagtgaatatgaccagccgtatgctgttaaacagattcacgatggcccaccgcaagcctacctatgagagggatgttgacctgggcgctggtacacggcacgtggccgtcgaacccgaggtggcaaacttggatatcatagggcagagaattgaaaatatcaaacatgagcacaagtcaacttggcattacgacgaggataacccttataaaacctgggcctaccacggatcctatgaagtaaagccatctggcagcgctagttccatggtgaatggcgttgtcaaactcctgacaaagccctgggacgtgatccctatggtgactcaaattgcgatgaccgatacaaccccatttgggcagcagcgcgtcttcaaggagaaagttgacactaggacgcccaaggccaaacgaggaacagcacaaataatggaagtgaccgctaagtggctatggggttttcttagccggaacaaaaagccgagaatctgtactagggaggagttcacccgcaaggtacgttctaatgccgcaattggcgccgtgtttgtcgacgagaaccagtggaactcagctaaagaggccgtggaagatgagcggttctgggacctggttcatagagaaagggagctccacaagcaggggaaatgcgcgacatgcgtgtacaacatgatgggaaagcgcgagaagaagctgggcgagtttggtaaggcaaaagggagtcgagccatctggtacatgtggttgggagctcggttcctggagttcgaagccctcggctttatgaatgaggatcactggttctccagagaaaacagcctttctggcgtcgagggggagggactgcataagttaggttatattctgagggacatctcgaaaatacctggcgggaatatgtacgcagatgacacggctggatgggatacccgcatcactgaagacgatttgcagaacgaggccagaattacagacatcatggaaccagagcacgctctcctggccaagtcaatttttaaactaacctatcaaaataaggtggtacgggttcagaggcccgccaaaaatggcactgtgatggatgtcatcagccgtcgagaccagcgcggttccggacaggtgggaacatacggccttaataccttcacaaacatggaagcgcaactgataagacagatggagagtgagggcatattttctcctagcgaactcgagactccaaacctggccgaacgggtgttggattggttagagaagtatggggtcgaaaggctgaagcgcatggctatctccggagacgactgtgttgtgaaacccatcgatgacagattcgccaccgcactcacggctcttaatgatatgggtaaggtacggaaagacattccgcagtgggagccttcaaagggctggaacgattggcagcaagtgcccttttgcagtcatcacttccaccagctgataatgaaagacgggagggagatcgtcgtgccatgtcgaaatcaggatgagctagttggacgtgccagagtgtctcagggcgcaggttggagcctgcgcgagaccgcctgcctcgggaagtcctacgcgcaaatgtggcagttgatgtattttcatcggagggacctgagacttgctgccaacgcaatttgttcagccgtccctgtggattggatccccacaagccgcactacctggtctattcacgctcatcaccagtggatgacaactgaagacatgctgtccgtatggaatcgggtttggatcgaggaaaacccatggatggaggataagacccatataagtagctggggagacgtgccctacctcggcaaaagggaggaccaatggtgcggctcgttaatcgggctgacggcccgagcaacatgggctaccaatattcaggtcgccatcaaccaggtgagacggttgattggaaatgaaaactacctggattatatgacttccatgaagaggttcaaaaatgagtctgaccctgaaggtgcgctctggtga

SEQ ID NO: 13941 - RNA, 9879 nt, synthetic construct
  misc_feature 1..9879: note = derived and/or modified CDS sequence (opt3) from DENV-1__GU131768__SS-prME
  source 1..9879: mol_type = other RNA
agcgtgaccatgctgctcatgcttatgcccaccgccctggctttccacttgactacgagaggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaagcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtaactggccaaaatcccacactctatggtcaaatggagtcctggaaagcgagatgattatccccaagatatacggcggtcctatctctcaacataactatcgaccaggctacttcacacagaccgcggggccgtggcacctcggaaaactggagcttgattttgacttgtgcgaaggcactacagtggtggtcgatgagcactgcgggaatagaggaccctccctgaggaccacgactgttaccggcaagattatccatgaatggtgttgccgcagttgtacattacctccactccggttcaaaggtgaggacgggtgctggtacggaatggagattagacccgtgaaggaaaaggaggaaaacctggtaaaaagcatggtgtctgccggctccggtgaggtcgactcatttagtcttggcctgttgtgtatcagcataatgattgaagaggtgatgaggtcgcgctggtcccgaaagatgctcatgaccgggactctggctgttttcctactgctcatcatgggacagctgacatggaatgatcttatccggttgtgcattatggtgggcgccaacgcatctgaccgtatggggatgggaaccacatatctggctttaatggccacttttaaaatgagacctatgttcgcagtcggcctcctgtttaggcgccttaccagccgggaggtgctgctactcacgatcggtctgtcattggttgccagtgtggaactgccaaattccttagaggaactcggggatggactggctatgggcattatgatacttaagctgttgacagacttccaatctcaccagctctgggcgaccctgctaagcctgacttttatcaaaaccacactttccctccattacgcctggaagactatggcaatggtcctgtcaattgtcagcttgttccccctgtgtttaagtaccacgtctcagaagacaacctggctcccggtgctgcttggctccctggggtgcaaacctttgactatgtttctcatcacagagaacaagatttggggaagaaaaagctggccactgaacgaaggtatcatggctgttggcgtggtctcgatactactgtcatctcttctcaagaatgatgtgcccctggccgggcctttgatcgccggaggcatgttaattgcttgttatgtaatcagtggttccagcgcagacctgtctctcgagaaagccgcggaggtgagctgggaagaggaagctgagcactccggggcctcacataacattctggtcgaagttcaggatgacggaaccatgaagatcaaagatgaggagagggacgatactcttacaatactgttgaaggcaaccctactggccgtgagtggcgtgtaccccctcagcattccagctacgctgttcgtctggtatttttggcaaaagaaaaagcagcgatctggcgtgctttgggacactccttcacccccagaagttgagcgcgcagtattagatgacgggatctaccggatcatgcagagaggactgctcggtaggagccaggtgggcgtcggggtgttccaagaaaatgttttccacaccatgtggcacgtgacacgtggagccgtcttgatgtatcagggcaaacgcctggagccgagttgggcgagcgtgaagaaagacctcatttcctacggtgggggatggcggctgcagggctcttggaacaccggcgaggaagtacaggtcatagctgtggagcctgggaagaatcccaagaacgttcaaacagccccaggaacttttaaaacccccgaaggtgaggtgggcgcaatcgcccttgatttcaagcctgggacgtcgggaagcccaattgtcaatagagaaggcaaaatcgtgggtctgtacgggaacggagttgtgacaacttcaggcacctatgtctccgctattgcccaggcaaaggctagtcaggagggccccttgcctgagatcgaagacgaggtgtttaggaaacgaaatctaacaataatggatctgcatccggggtctggaaagacccggcgctacctcccagccatcgtaagagaagcgattaagaggaaattacggactctgatccttgcccccacccgagtggttgcaagcgagatggctgaagccctgaagggtatgcctattagatatcaaacaacggctgtcaaatccgagcacactggcaaggagatcgtggacctcatgtgccatgcaaccttcacaatgcgcttgctgtcaccagtgagggtccccaactacaatatgataattatggatgaagcccactttaccgacccttctagcatcgccgctcgtgggtatatcagtactcgggtaggaatgggcgaggcggcagccattttcatgacagctaccccgcccggttccgtggaagcctttccacagagcaacgcagttatccaggatgaggaaagagacatacctgagaggtcttggaactcagggtacgagtggattacggatttccccggaaaaactgtgtggtttgtcccatccatcaagagtggcaacgacattgccaattgtctccgcaagaacggcaaacgagtgatccagctgagcagaaagacattcgataccgaatatcagaaaaccaagaacaatgactgggactacgttgtgactacagatatatcggagatgggggctaactttcgggcggacagggtcattgatcctcgccgttgccttaaacccgtgatcctaaaggacggaccagaaagagtaatcctggccggtccgatgcctgtgaccgttgcatctgctgcccagcggaggggccgcattgggcgaaatcataacaaggagggagatcagtacatctatatgggccagcccttgaataacgacgaggatcacgcacactggacagaagccaaaatgttactggacaatattaacactccagagggtataatccccgctctcttcgaacctgagagagaaaagtccgccgcgattgatggggagtaccggctgaggggcgaggcacgcaaaacgttcgtcgaacttatgagaaggggagacctgccagtgtggctcagctataaggtggcctcagagggctttcaatacagtgatcggcgttggtgcttcgacggggaacgcaataaccaggtcttggaggaaaatatggatgttgagatctggaccaaagagggagaacgaaagaaactgagacccaggtggctagacgctcggacatattctgaccctctggccctccgcgagtttaaggagttcgctgcaggtagaaggtccgtgagcggcgatcttatcctggagattgggaagttaccgcagcatttgactcagcgggcccaaaacgctctggacaatctcgtaatgctgcacaactcagaacagggaggccgagcctacagacatgcaatggaggagcttccagataccatagaaacactgatgctcttggcgctgatcgccgtgttaaccggtggggtcactctatttttcctgagtggccgcggactcggcaaaacgagcattgggcttctgtgtgtgatggcttcctctgttttgctgtggatggccagcgtggagccccactggatcgcagcttccattatcctcgaatttttcctgatggtccttctcatacctgagcccgacaggcagcggaccccacaggataatcaactggcctatgtagtgatcggattgctgtttatgattttaacagttgcagccaacgagatgggtctactggaaactaccaagaaagacctcggcatcgggcacgtggctgtcgagaaccatcaccatgcgacaatgcttgatgtggacctgcaccctgcctcagcatggaccttgtacgctgtcgccactacaattatcacgcccatgatgcgtcataccatagaaaatactacagccaacatttctctgaccgcaatcgctaatcaggccgcgattctcatgggactggataagggctggccaatcagtaaaatggacataggtgtgcctcttttagctctggggtgctactcgcaggttaacccgctcaccttgacagccgcagtgctgatgctagtagcccactatgctatcattggccccggactgcaagcaaaggccactagagaggcgcagaagaggacggctgccggcatcatgaaaaatccaaccgtggatgggattgtcgcaatcgacctcgatcctgttgtgtacgacgccaagttcgaaaaacagcttggacagataatgctgttgattctgtgtacaagccaaatcctcctgatgcgcactacctgggctttatgcgagtccatcacacttgccaccggccccctgactacgctctgggagggttctccagggaagttttggaacacaaccattgcagtctcaatggctaatatcttccggggaagctatctagccggcgcgggtctggccttttccttgatgaaaagtctgggcgggggacgaagaggcactggggcacagggagaaaccctcggcgagaagtggaagaggcagcttaaccagctgtctaaaagcgagttcaatatatacaagcgctcaggtattatggaggtggaccggtccgaagctaaagaggggttgaagagaggagagacaactcgtcacgccgtaagtaggggcaccgcaaaactgcggtggttcgtggaacgcaacctcgttaagcctgagggtaaggtgatcgatttaggctgtgggcgaggaggctggagctattactgcgctgggctgaaaaaggtcacagaagtgaaaggatatacgaagggcggtcccgggcatgaggaaccgattccaatggccacctacggatggaatcttgtcaaactgcactctggcaaggacgtgtttttcactcctcccgagaaatgtgatacactactctgcgacatcggcgagtcctcaccaaaccccaccatagaagaggggagaactctgagggttttgaagatggtagaaccttggctgcggggaaatcaattttgtatcaagattctcaacccgtacatgcccagcgtggtcgagacacttgagcagatgcagcgcaaacatggtggcatgctggtgagaaatccattatcgaggaactctacccacgaaatgtattgggttagttgcgggacgggaaatatcgtgtccgccgtcaacatgaccagccgaatgctgttgaaccggttcacaatggcgcaccgtaagcctacttacgagagagatgtggacctcggcgctggtacccgccatgtagcagtggaacccgaggttgccaatctggatattatcgggcagaggattgaaaacatcaaacacgagcataagtcaacatggcactatgacgaggataatccttacaaaacttgggcttatcatggatcctacgaagtcaagccatctggcagcgccagttccatggtgaacggcgtggtcaagctacttaccaaaccctgggacgttatacctatggtgacacaaattgcaatgaccgatactacgccatttgggcagcagcgggtattcaaggagaaagtggacacaagaacccccaaggccaaacgcggaactgctcaaatcatggaagtcaccgcgaggtggctgtggggttttctcagccgaaataagaagccgcggatctgtacaagagaggagttcacgaggaaagtgcgctctaacgccgcaattggcgctgtttttgtggacgagaatcagtggaactcagccaaggaggcagtcgaagatgagcgtttctgggacctggtgaaaaaggaacgggagttgcacaaacaggggaagtgcgcaacctgcgtatataatatgatgggaaagagagagaaaaagctgggcgagtttggtaaagctaaggggagtagggccatatggtacatgtggctcggagcgcgcttccttgagtttgaagcactgggcttcatgaacgaggatcactggttctcccgagaaaatagcttatctggcgttgagggggagggactgcataaattgggttacatcctccgggacatttcgaagatccctggcgggaacatgtatgccgatgacactgctggatgggatacaagaattaccgccgacgatctgcagaatgaagcaaaaatcactgacataatggagccagaacacgctctacttgccacatcaatctttaagctgacctaccaaaacaaggtggtcagggtgcagcgccccgctaaaaatggcacagtgatggatgtcattagcagacgggaccagaggggttccgggcaggttggaacttatggcctcaacaccttcacgaacatggaggcccaactgatccgtcagatggaaagtgagggcatatttttgccttctgagttagaaaccccaaatctggcagagcgagtgctcgattggcttgaaaagtacggggtagagcgcctgaaaagaatggcgatcagcggagacgactgtgtggtcaagcccatagatgaccggttcgccacagctctaactgccctgaacgatatgggtaaagtgaggaaggacattccgcagtgggaaccttccaagggctggaatgattggcagcaagttcccttttgctcacatcacttccaccagctcatcatgaaagacgggcgcgagatcgtggtcccatgtagaaaccaggatgagttggtgggacgggcaagggtaagtcagggcgctggttggtctctgcgagaaaccgcctgccttggaaagagctatgcacaaatgtggcagctgatgtactttcatcgtagagacctccgcttagccgcgaatgctatttgttccgccgttcctgtggattgggtccccacatcacggactacctggagcatacacgcacatcaccagtggatgacgacagaggacatgctgtctgtgtggaacagggtttggatcgaagagaatccatggatggaagataaaacccatgtgtccagttggggagacgtcccctatttgggcaagagagaggaccaatggtgcggcagcctgattgggctcactgcccgcgctacatgggcctcgaacatccaggtggcaattaatcaggtacggaggcttatcggaaacgagaattacctggattacatgacctccatgaaacgattcaagaacgaaggtgaccctgagggcgctctatggtga

SEQ ID NO: 13942 - RNA, 9879 nt, synthetic construct
  misc_feature 1..9879: note = derived and/or modified CDS sequence (opt3) from DENV-1__GU131770__SS-prME
  source 1..9879: mol_type = other RNA
agcgtgaccatgctgctcatgcttatgcccaccgccctggctttccacttgactacgagaggcggggaacctcatatgatcgtctccaagcaggaaaggggaaagtctttactgtttaagacctcagccggtgttaatatgtgcacgctaattgccatggacctcggcgaactgtgtgaagatactatgacctacaagtgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctccgcgggatgtcctatgtgatgtgtaccgggagcttcaagctggagaaagaagtcgccgagacgcagcacggtacagtgcttgttcagataaagtacgagggcaccgacgctccttgcaagatcccattctcgactcaagatgaaaaaggggtgacacagaacggaagattgattaccgcgaatcccatcgtaactgacaaggagaaacctgtcaacatagaagcagagccaccctttggcgagtcttatattgtgatcggtgccggggaaaaggctctgaaactctcctggttcaagaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagtacaagtattcgtggaaaagctggggcaaggccaagataatcggggcggacgtgcagaataccacatttattatcgatggaccaaacactcctgaatgtcccgacgatcagagggcctggaatatttgggaggtcgaggactacggcttcggtatctttaccacaaacatatggcttaaattgcgtgattcctatacacaggtgtgcgaccaccggctcatgtcagctgcaattaaggatagtaaagccgttcacgctgacatggggtactggatcgaatctgagaagaatgaaacctggaaactggcccgagcatccttcattgaggtgaagacttgtatctggccaaagtcccatacactatggtcaaacggagtactggaaagcgagatgataatccccaaaatttatggcggtcctatctctcaacacaattacagaccaggctacttcacccagactgcggggccgtggcatctcggaaagctggagcttgattttgacttgtgcgaaggcacaaccgtcgtggtggatgagcactgcgggaacaggggaccctccctgcgcacgactaccgtcacaggcaaaattatccacgaatggtgttgccggagttgtaccttacctccactcagattcaggggtgaggacgggtgctggtatggaatggagatacgccccgttaaggaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattatgggacagctcacctggaacgatctgatcagactttgcattatggttggcgccaatgcatctgacaggatggggatgggaacaacttacttggctctgatggccaccttcaaaatacgccctatgtttgcagtgggcttactcttccggagactgacgagcagggaggtccttctgctaacaatcggtctctcactggtggccagtgttgaattgccaaactccctggaggaattaggggatggactcgctatgggcattatgatcctgaaacttctgaccgactttcaatctcatcagttgtgggcgactctcctgagcctaaccttcattaaaacaactttttccctgcactgtgcctggaagaccatggcaatggtgctttcaatcgtcagcctcttccccctgtgcttgagtacgacatctcagaaaaccacttggctgccggtattactcggctccctggggtgtaagcctcttacaatgtttctgatagctgagaataagatctggggacgacgcagctggccattgaacgaaggtattatggccgtgggcatcgtttcgattctcctgtcatctctactgaaaaacgatgtgccccttgccgggcctctcatcgctggaggcatgctgatagcatgctatgtcattagtggttccagcgccgacttgtctttagagaaggcggctgaggtgagctgggaagaggaagccgagcattccggggcatcacacaatatcctggtagaagtgcaggatgacggaaccatgaaaatcaaggatgaggagcgggacgatactctcacaattctgcttaaagccaccctgttggctgtcagtggcgtttaccccctaagcataccagcaacgctgttcgtgtggtatttctggcaaaagaaaaagcagagatctggcgtgctctgggacactccttcacccccagaagtcgagagggccgtgctggatgacgggatctaccgtattatgcagcgcggacttttaggtcggagccaggttggcgtaggggtgtttcaagaaaacgtcttccataccatgtggcacgtgacaagaggagcggttctgatgtatcagggcaagaggctcgagccgagttgggctagcgtgaaaaaggacttgatctcctacggtgggggatggcgactgcagggctcttggaataccggcgaggaagtccaggtgattgccgtagagcctgggaaaaaccccaagaatgtccaaacagcaccaggaacttttaaaacccccgaaggtgaggtgggcgccatcgctctcgatttcaagcctgggacgtcgggaagcccaatagttaaccgggaaggcaagatcgtgggtctgtacgggaatggagtcgtgacaacttcaggcacctatgtttccgccattgcacaggctaaagccagtcaggagggcccccttcctgagatcgaagacgaggtgtttcgcaagagaaacctgacaattatggatttgcacccggggtctggaaaaaccaggcggtacctaccagcgatcgtccgagaagccataaagagaaaactgcgcactctcattttagcacccaccagggtggtagctagcgagatggccgaagctctgaagggtatgcctatccgttatcaaacaacggcagtgaagtccgagcatactggcaaagagatcgttgaccttatgtgtcacgccaccttcacaatgcggctgctctcaccagtcagagtgcccaattacaacatgattatcatggatgaagcccattttaccgacccttctagcatagctgcgagggggtatattagtactcgcgtgggaatgggcgaggcagccgctatcttcatgacagccaccccgcccggttccgtcgaagcatttccacagagcaatgccgtaattcaggatgaggaacgagacatccctgagagatcttggaactcagggtacgagtggataacggatttccccggaaagactgtgtggtttgttccatccattaaaagtggcaatgacatcgctaactgcttgcggaagaatggcaaaagggtgatccagctgagccgcaagacattcgataccgaatatcaaaagaccaaaaacaacgactgggactacgtcgtgactacagatatttcggagatgggggcgaatttccgtgccgacagagttatcgatcctcggaggtgcctcaagcccgtgattctgaaagacggaccagaacgcgtcatacttgcaggtccgatgcctgtgaccgtagcttctgccgcacagcgaagaggccggatcgggaggaaccacaataaggagggagatcagtacatttatatgggccagcccctaaacaatgacgaggatcatgcccactggacagaagctaaaatgctgttggacaacatcaatactccagagggtatcattcccgccttatttgaacctgagcgcgaaaagtccgcggcaatagatggggagtacagactgaggggcgaggcccggaagacgttcgtggaactcatgcgtcgcggagacctgccagtttggcttagctataaagtcgcttcagagggctttcaatacagtgatcgaagatggtgtttcgacggggaaaggaacaatcaggtgctggaggaaaacatggatgtggagatctggaccaaggagggagaacggaaaaagctccgccccagatggttggacgccaggacatattctgaccctctggctctacgggagtttaaagagttcgcagccggtcgaagatccgtcagcggcgatctgattctcgagatcgggaaacttccgcagcacctgactcagcgcgctcaaaatgccttagacaacttggttatgctgcataattcagaacagggaggcagggcataccggcacgcgatggaggagctcccagataccattgaaacactgatgcttctggccctcatcgctgtgttgaccggtggggtaactctgtttttcttaagtggccgtggactaggcaaaacgagcatagggctgctctgcgtgatggcctcctctgtccttctgtggatggcaagcgtggagccccattggatcgctgcctccattatcttggaatttttcctgatggttctcctgattcctgagcccgacaagcagagaaccccacaggataaccaacttgcatatgtggtcatcggactcctgtttatgatattgacagtagccgctaatgagatgggtctgttagaaactaccaagaaagacctaggcattgggcacgtggcggttgagaaccaccatcacgccgcaatgctggatgtggacctccatcctgcttcagcctggacactttacgccgtcgcaaccactatcattacacccatgatgaggcacacgatcgaaaacaccactgctaatatatctctgacagccatcgcgaaccaggctgccattttgatgggactggataagggctggccaatcagtaaaatggacattggtgtgcctctcctggcacttgggtgttactcgcaggtcaatccgttaaccctgaccgccgctgtgctcatgttggttgcacattatgccatcataggccccggactgcaagcgaaggctacacgcgaggcccagaaacggactgcagccggcattatgaagaacccaacggtggatgggatcgtagctatcgacctagatcctgtggtctacgacgccaagttcgaaaaacagctgggacagattatgctccttatcctgtgcaccagccaaatattgctgatgcgaacaacttgggcactctgtgagtccattaccctggctacaggccccttaaccactctttgggagggttctccagggaagttttggaatacgacaatcgccgtttcaatggcgaacattttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtatcatggaggtggaccgttccgaagcaaaagaggggcttaagaggggagagacaactaaacacgctgtcagtcggggcaccgccaagctgcgctggttcgtggaacgaaatttggtaaaacctgagggtaaggtgatagatctgggctgcgggagaggaggctggagctattactgtgccgggctcaagaaagttacagaagtgaagggatatacgaaaggcggtcccgggcacgaggaaccgatcccaatggcgacctacggatggaacttagtcaagctgcattctggcaaagacgtgtttttcattcctcccgagaagtgcgatactcttctgtgtgacatcggcgagtcctcaccaaatcccacaattgaagaggggaggaccctacgggtcctcaaaatggtggaaccttggctgcgcggaaaccaattttgcatcaagattttgaatccgtacatgcccagcgttgtagagactctggagcagatgcagagaaagcacggtggcatgctcgtgaggaacccactttcgcgaaattctacacatgaaatgtattgggtcagttgtgggaccggaaacatcgtgtccgctgttaatatgacgagccggatgctgttaaaccgtttcaccatggcacacagaaaacctacatacgagcgcgatgtggacctgggcgccggtactaggcacgtcgctgtggaacccgaggtagccaacttggatataattgggcagcggatcgaaaatatcaagcatgagcacaaatcaacctggcattatgacgaggataacccttacaagacatgggcatatcacggatcctacgaagtgaaaccatctggcagcgccagttccatggttaatggcgtcgtgaagctcctgactaagccctgggacgtgattcctatggtcacccaaatagctatgacagataccactccatttgggcagcagagagttttcaaagagaaggtggacacgcgcacacccaaagcgaagaggggaaccgcccaaatcatggaagtaactgcaaaatggctatggggttttcttagccgaaacaagaagccgcggatttgcaccagagaggagttcacaaggaaagtgcgctctaatgctgccatcggcgcagtctttgtggacgagaaccagtggaactcagccaaggaggctgttgaagatgagcgtttctgggacctggtgcatcgggaaagagagctccacaaacaggggaagtgcgccacgtgtgtctataacatgatgggaaaaagggaaaagaagctgggcgagtttggtaaagcgaaggggagtcgcgcaatttggtacatgtggttgggagcccgattcctggagttcgaagctctcggctttatgaatgaggatcactggttctcccgggaaaacagcctttctggcgtggagggggagggactgcataaattaggttacatcctgagagacatatcgaagatccctggcgggaatatgtatgccgatgacaccgcaggatgggatactaggattacagaagacgatttgcagaacgaggctcgcatcaccgacattatggaaccagagcacgccctcctggctaaatcaatctttaagctaacttaccaaaataaagtagttagagtgcagcggcccgccaagaacggcacagtcatggatgtgataagcaggcgtgaccagcgaggttccggacaggtgggaacctatggccttaatacattcactaacatggaagcacaactgattcgccagatggagagtgagggcatcttttctcctagcgaactcgagaccccaaacctggcggaaagagtcttggattggttagagaagtacggggttgaacggctgaaaaggatggccatctccggagacgactgcgtggtaaagcccattgatgaccgcttcgctacggccctcaccgcacttaatgatatgggtaaagtgagaaaggacataccgcagtgggagccttcaaaaggctggaacgattggcagcaagtccccttttgtagtcatcacttccaccagctgatcatgaaggacgggcgggagattgtggttccatgcaggaatcaggatgagctagtgggacgagctcgtgtctctcagggcgccggttggagcctgagagagacagcatgtctcgggaagtcctatgcccaaatgtggcagttgatgtactttcatcgccgggacctgaggcttgcggctaacgccatctgctcagcagtgcctgtagattggattcccactagcagaaccacatggtctatccacgcccatcaccagtggatgactaccgaagacatgctgtccgtttggaatcgcgtgtggatagaggaaaacccatggatggaggataaaacgcatatcagtagctggggagacgtcccctatctcggcaagcgggaggaccaatggtgtggctcgttaattgggctgacagctagggccacctgggcaactaatatccaggtggctattaaccaggttcgaagattgatcggaaatgaaaactacctggattacatgacatccatgaaacggttcaagaatgagtctgaccctgaaggtgccctctggtga

SEQ ID NO: 13943 - RNA, 9879 nt, synthetic construct
  misc_feature 1..9879: note = derived and/or modified CDS sequence (opt3) from DENV-1__GU131773__SS-prME
  source 1..9879: mol_type = other RNA
agcgtgacaatgctgctcatgcttatgcccacagcactggctttccacttgactacgagaggaggggagcctcatatgatcgtctccaagcaggaaaggggaaaatctttactgtttaagacctcagccggtgttaacatgtgcacactgattgcaatggacctcggcgagctgtgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctactcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcatgaccaaattagaagggaagatagtacagtacgagaacctgaaatattcagtgattgtcacagtgcacaccggagatcagcatcaagttggtaatgaaagtactgagcacggcacgacagccaccatcactccccaggcgcctaccacagaaattcagctcaccgactacggggcccttactctggactgtagcccaaggacaggattggatttcaacgagatggtgctactgacgatgaaggagaaatcttggctcgtccataagcagtggtttctggaccttccgctgccctggacctccggcgcatcaactagccaagaaacatggaatcggcaggatttgctcgtgaccttcaaaacagctcacgccaagaagcaggaggtagttgtgctgggtagtcaagaaggggctatgcacactgccttaaccggcgcaacggagatccagacctctggaacaactaccatctttgccggccatctgaaatgccgtctaaagatggacaaactcacactgaaggggatgtcctatgtcatgtgtactggtagcttcaaacttgaaaaggaggtggctgagacccagcacggaacggtcttggtgcagattaagtacgaaggcacagatgcgccttgcaaaataccattctcgacccaagacgagaagggggttactcagaacggacgcctgatcacagcaaatcccattgtgaccgataaagaaaagcctgtaaacatcgaggccgagccaccctttggcgaatcttatatagtcattggtgctggggagaaagccctcaagctgtcctggttcaagaaaggctcaagtatcggaaagatgtttgaagcaactgccagaggcgctaggcggatggccatccttggggacaccgcatgggatttcggaagcattggtggcgtgtttacatccgttgggaaactggtgcatcagatcttcggaacggcgtacggcgtcttgttttctggtgtgagctggaccatgaagattgggataggcgtactcctgacttggttaggactaaattcacgaagtacatccctaagcatgacctgtatcgctgtgggcctcgttacactgtaccttggggtcatggtgcaggccgactctggatgcgtgattaactggaaaggccgcgagttgaagtgtggttcagggatcttcgtcactaatgaagttcacacctggacggagcaatataagtttcaggcagatagtccgaaaagactgagcgccgctatcggaaaggcctgggaggaaggcgtgtgcggtattaggtccgcaacacggctcgagaacataatgtggaaacagatctctaacgaactgaatcatattttactggagaacgacatgaagttcaccgtggtagtcggcgacgtggctgggatccttgttcagggcaagaagatgattcgccctcaacccatggaatacaaatattcgtggaagtcctggggcaaggccaaaatcataggggcggatgtgcaaaattccacttttatcattgacggaccaaacacccctgagtgtcccgatgaccagagagcctggaatatctgggaggtcgaagattacggcttcggtatttttacaactaacatctggttgaagctcagggactcatatacccaggtgtgcgatcaccgtctgatgagtgctgcaataaaagactctaaggccgttcacgctgatatggggtactggattgagagcgagaagaatgagacatggaagctagcccgggcatccttcatcgaagtgaagacgtgtatttggccaaaatcacataccctgtggagcaacggagtactcgagtctgagatgatcatacccaagatccacggcggtcctatttcccaacataattatcgaccaggctacttcactcagacagcggggccgtggcacctgggaaaacttgaattggactttgatctgtgcgagggcaccactgtcgtggtggacgaacactgcgggaacagaggacccagtttaaggacaaccacggtcactggcaagatcattcatgagtggtgttgccgcagctgtaccctccctccactgcggttcagaggtgaggatgggtgctggtacggaatggaaatcaggcccgttaaagagaaggaagagaatcttgtgaagtctatggtatccgccggctcaggtgaagtggacagttttctgttgggcctcctgtgtataagcattatgatcgaggaggtcatgcgctcgcgatggtcccggaaaatgctaatgacagggaccctggctgtgttctttctcctgatcatgggacagcttacttggaacgacttgattcgtctgtgcatcatggttggcgccaatgcatctgatagaatggggatgggaacaacctatttagctctcatggccacattcaagatgaggcctatgtttgcagtgggcctgcttttccgccggctgactagcagagaagtcctactcctgaccattggtttgtcactggtggccagtgttgagttaccaaactccctcgaagaactgggggacggacttgctatgggcataatgatcctgaaattgctcacggattttcaatcttaccagctgtgggcgacactactgagccttaccttcattaagactaccttttccctccactatgcctggaaaacaatggcaatggtgctgtcaatcgtcagcttgttccccctgtgtttaagtactacctctcagaagacgacatggctcccggtactgcttggctccctggggtgcaagcctttgaccatgtttctcattgctgaaaataaaatctggggaagaaagagctggccactgaacgagggtataatggccgtgggcatcgtttcgattctactgtcatctcttctcaaaaacgacgtgcccctggccgggcctttgatcgctggaggcatgttaattgcatgttacgtcatcagtggttccagcgccgatctgtctctcgagaaggcggctgaagtgagctgggaggaagaggccgaacattccggggcatcacacaatatactggtagaggtgcaggacgatggaactatgaaaattaaggacgaggaacgagatgacacacttaccatcctgttgaaagccactctactggctgtcagtggcgtttatcccctcagcatcccagcaacactgttcgtgtggcatttctggcaaaagaagaaacagcgctctggcgtgctttgggataccccttcacccccagaggtcgaacgggccgtgttagacgatgggatttacagaataatgcagaggggactgctcggtcgtagccaggttggcgtaggggtgtttcaagagaacgtcttccacacgatgtggcacgtgactcgcggagcggttttgatgtatcagggcaagcggctggagccgagttgggctagcgtgaaaaaggacctcatctcctacggtgggggatggagatttcagggctcttggaataccggcgaagaggtccaggtgattgccgtagaacctgggaaaaaccccaagaatgtccaaacagcaccaggaaccttcaagacacccgagggtgaagtgggcgccatcgctctggactttaaacctgggacttcgggaagcccaattgttaacagggagggcaagatcgtgggtctttacgggaatggagtcgtgaccacgtcaggcacatatgtttccgccatagcacaggctaaagccagtcaggagggccccctgcctgaaatcgaggatgaagtgttccgaaagcggaacttgactattatggacctacatccggggtctggaaaaacccgcagatacctgccagcgatcgtcagggaggccattaagcggaagctccgaacattaatcctggcacccaccagagtggtagctagcgaaatggccgaggctcttaaaggtatgcctatacgctatcaaactaccgcagtgaagtccgagcacacaggcaaagaaattgttgatctgatgtgccatgccacgtttactatgaggctcttgtcaccagtccgtgtgcccaattacaacatgatcatcatggacgaggcccacttcaccgatccttctagcattgctgcgcgggggtatatcagtacaagagtgggaatgggcgaagcagccgctatatttatgaccgccactccgcccggttccatggaggcattcccacagagcaatgccgtcattcaggacgaagagagggatatccctgagcgctcttggaactcagggtacgaatggattacagactttcccggaaagaccgtatggttcgtgccatccatcaaagctggcaatgatatagcgaactgtctgcgaaagaatggcaagagagttattcagctcagtcggaaaacgttcgacactgagtatcaaaagaccaaaaataacgattgggactacgtggtcaccaccgacatcagcgaaatgggggccaattttagggcagatcgcgtgatcgaccctcgtagatgcctgaagcccgttattcttaaagatggaccagagcgggtgatcctagctggtccgatgcctgtcactgtggcctcggcagcccagaggcgcggccgaattgggagaaaccataataaggagggagaccagtacatatatatgggccagcccctgaacaatgatgaagaccacgctcactggacagaggccaagatgttgttagataacatcaataccccagaaggtattatccccgcgctgttcgagcctgaacgggagaaatctgcagccatcgacggggagtacaggctccgcggcgaagctagaaagacatttgtagagctgatgaggcggggagatcttccagtgtggctgtcctataaagttgccagcgaaggcttccaatactcagaccgtcgctggtgctttgatggggagcgaaacaatcaggtcctcgaagagaacatggacgtggagatttggactaaggaaggagagaggaaaaagttgaggccccggtggctggatgctcgcacgtatagtgaccctctagcactgagagagttcaaagagtttgccgctggtaggcggtctgtgtccggcgacctcatacttgaaatcgggaagctgccgcagcatttaacccagcgagcccaaaatgcattggataacctggtcatgctccacaatagcgagcagggaggcagagcgtaccgccatgccatggaggaactgccagacacaattgagactcttatgctgctcgctttgatcgccgttctgaccggtggggtgacattattctttctatcaggcaagggactgggcaaaaccagtattgggctcctttgtgtaatggcaagctccgtgctgttgtggatggcttctgtcgaaccccactggatcgccgcaagcataatcctggagttctttctcatggtgctgcttattcctgagcccgataggcagcggactccacaggacaaccaactcgcctatgttgtgatcggactgttgttcatgattctgacggtcgctgcgaatgaaatgggtttactagagaccacaaagaaagatctgggcatcgggcacgtagccgtggaaaaccatcaccatgcagctatgctcgacgttgatcttcaccctgcctccgcctggactctgtacgcagtggctaccacaataattacccccatgatgcgtcatactatcgagaacacaacggccaatatttcattgaccgcgatcgctaaccaggccgcaatactgatgggactcgacaagggctggccaatctctaaaatggatattggtgtccctctgcttgccttagggtgctacagtcaggtgaatccgctgactctcacagctgcagtcttgatgctggtggcccactatgcgatcattggccccggactacaagctaaggccaccagagaagcacagaagaggaccgccgctggcatcatgaaaaacccaacaatagacgggattgttgccatcgatctggaccctgtggtatacgatgcaaagtttgagaaacagctcggacagatcatgcttctgattttgtgtacttcgcaaatcctgctcatgcgcacgacctgggctctgtgcgagagcataacattagccactggcccccttaccacactgtgggaaggttccccagggaagttctggaataccactattgcggtgtctatggccaacatcttccggggatcatatctcgcaggcgctggtctagcctttagcctgatgaaatccttgggcgggggacgaagaggcacgggggcacagggagagacactgggcgaaaagtggaagaggcagctcaatcagcttagtaaatctgagttcaacacctacaagcgcagcggtattatggaagtcgaccggtcagaggctaaagaggggctgaagagaggagaaactaccaaacacgccgtttcccgtggcacagccaagttgaggtggtttgtggagcggaatctggtcaagcctgaaggtaaagtgatcgacctcggctgtgggcgcggaggctggagttattactgcgcggggttaaagaaagtaactgaggtgaagggatataccaaaggcggtcccgggcatgaagaaccgataccaatggctacatacggatggaacctggttaaacttcacagcggcaaagatgtgttctttatccctcccgagaagtgtgacacgctgctatgcgatattggcgaatcttccccaaatcccaccatcgaggaagggcgaactctcagagtcctgaagatggtggagccttggttgaggggaaaccaattctgtattaaaatcctgaatccgtacatgccctcagtcgtggagacactcgaacagatgcagcggaagcatggtggcatgcttgttcgcaacccactgagcagaaattcgacccacgagatgtattgggtatcttgcgggactggaaacattgtgagtgcagtcaatatgacatccaggatgttactgaaccgatttaccatggcccaccggaaacctacgtacgaacgtgacgtggatttgggcgctggtaccagacatgttgccgtggagcccgaagtcgcaaacctcgacatcatagggcagcgcattgagaatatcaagcacgagcataaaagcacatggcactatgatgaagacaacccttacaagacttgggcctatcatggatcatacgaggtgaagccatccggctctgctagcagtatggtaaatggcgtggttaaactgctaaccaagccctgggatgtcatccctatggtgacacaaattgcgatgactgacaccacaccattcgggcagcagagggtgtttaaagaaaaggtcgatacccggactcccaaagccaagagaggaacggcacaaataatggaggttacagctcgctggctttggggtttcctgtccaggaacaagaaaccgcgaatctgtacccgggaagagtttactagaaaggtgaggagcaatgccgcaattggcgccgtattcgtggacgagaaccagtggaactctgctaaagaagccgtcgaggacgatcgcttttgggacctcgtgcaccgtgaacgggagctgcacaagcaggggaaatgcgcgacctgcgtttataacatgatgggaaagagagaaaagaaattgggcgagttcggtaaggcaaaagggtcaagggccatctggtacatgtggctgggagctcgcttcctcgagtttgaagcccttggcttcatgaatgaggatcattggtttagtcgagaaaactccctgagcggcgtggagggggagggattacacaagctgggttacattttgcgggacatctctaaaatacctggcgggaatatgtatgcagatgacacagctggatgggatacgagaatcaccgaagacgatctccagaacgaggccaagattactgacatcatggaaccagagcatgctctgctagccaaatcgattttcaaacttacataccaaaataaggtcgtgagggtacagcgccccgccaaaaacggcaccgttatggatgtgatctcaagacgggaccagaggggtagcgggcaggtcggaacttatggcctgaatacatttaccaacatggaagcgcaactcatacgtcagatggagtccgagggcattttcctgcctaacgaattggagacaccaaatttagccgggcgagtgctggattggctcgaaaagtacggagtggagcgccttaaaagaatggctatcagtggtgacgactgtgtcgttaagcccatcgatgaccggtttgccactgcactgaccgctctaaacgatatgggcaaagtgaggaaggacattccgcagtgggaaccttctaaggggtggaatgattggcagcaagtacccttctgcagccaccactttcatcagctgataatgaaagacggacgcgagatcgtggtcccatgtagaaaccaggatgagctcgtgggccgggccagggtttcccagggtgcagggtggtcattgcgagaaacggcctgcctgggaaagagttatgcgcaaatgtggcagcttatgtacttccaccgtagagacctgcgcctcgctgccaatgcaatttgttctgccgtgcctgtcgattgggtgcccaccagccggacaacttggtccatccatgctcaccatcagtggatgaccacagaggacatgttatcagtatggaacagggtttggattgaagagaatccatggatggaagataaaactagaatcagctcttgggaggacgtgccctatctgggcaagcgcgaggaccaatggtgcggctccttgatagggctgaccgcccgggcaacgtgggctacaaacatccaggtcgccattaatcaggtgaggcgactcatcggaaacgaaaattacagtgattacatgaccagcatgaaaagatttaagaacgagtcggaacctgagggtgcgctttggtga

SEQ ID NO: 13944 - RNA, 9879 nt, synthetic construct
  misc_feature 1..9879: note = derived and/or modified CDS sequence (opt3) from DENV-1__GU131775__SS-prME
  source 1..9879: mol_type = other RNA
agcgtgaccatgctgctcatgcttatgcccaccgccctggctttccacttgactacgaggggaggggagcctcatatgatcgtcaccaagcaggaaaggggaaaatccttactgtttaagacatctgccggtgttaatatgtgcactctgattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggttgacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtggtcgtgaccgttcacactggagaccagcatcaagtgggtaatgagtcaacggaacacggcacaaccgccactatcacaccccaggcgcctacaagtgagattcagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatctttgccggccatttaaaatgccgtctgaagatggataaactaacactcaaggggatgtcctatgtgatgtgtactggatcgttcaaactggagaaggaagtcgctgagacccagcacggtacggtgcttgttcagattaagtacgagggcacagacgcgccttgcaaaataccattctcgacccaagatgaaaagggggtgactcagaacggacgcttgatcacagcaaatcccattgtaaccgacaaagagaagcctgtcaacatcgaagccgagccaccctttggcgagtcttatatagtgattggtgctgggggcaaagccctgaagctctcctggttcaagaaaggatcaagtatcggcaagatgtttgaagcaactgccagaggggctaggcggatggccatcctgggagataccgcatgggacttcggtagcgttggcggggtgtttacatccgtcggaaaacttgtgcatcagattttcggcacggcgtacggtgtactgttttctggggtgagctggaccatgaagatcggcattggagttttgctcacttggctgggcttaaattcacgaagtacatccctgagcatgacctgtatagctgtcgggctagtgacactctacctgggagtgatggtccaggccgattctggctgcgttatcaactggaaaggtcgcgagcttaagtgtgggtcaggaattttcgtgactaatgaagtgcacacctggacggagcaatataagtttcaggcagacagtccgaaaagattgagcgccgctatcggcaaggcctgggaagagggtgtatgcggcatcaggtccgcaacacggctggagaacattatgtggaaacagatatctaacgaactcaatcatatcctgttagagaacgacatgaagttcaccgtcgtggttggggatgtggtcggcattctggctcagggcaaaaagatgatccgccctcaacccatggaacacaaatactcgtggaaaagctgggggaaggccaagattatcggagcggacgtgcagaatactacctttataatcgatggcccaaacacacctgagtgtcccgacgatcagagagcctggaatatttgggaagttgaggactatggtttcgggatctttactaccaacatttggcttaagttgagggattcctacacacaggtgtgcgaccaccgtctcatgtcagctgcaatcaaagatagtaaggccgtacatgctgacatgggatattggatagagtctgagaaaaatgagacgtggaagctggcccgggcatccttcattgaagtcaagacctgtatctggccaaaatcccacactctatggtcaaacggcgtgctggagagcgaaatgattatccccaagatatacggtggccctatctctcaacataattatcgaccagggtacttcacacagaccgcgggaccgtggcacctcggcaaactggagcttgattttgacttgtgcgaggggactacagtggtcgttgatgaacactgcggaaacagaggcccctccctgaggaccacgactgtgaccggtaagattatccatgagtggtgttgccgcagttgtacattacctccactccggttcaaaggggaagacggatgctggtacggcatggagattagacccgtaaaggagaaggaagagaatctggtgaaaagcatggtctctgccggttccggcgaagtggactcatttagtcttgggctgttgtgtatcagcataatgattgaggaagttatgaggtcgcgctggtcccgaaagatgctcatgaccggaactctggctgtgttcctactgctcatcatgggccagctgacatggaacgatcttatccggttgtgcattatggtcggggccaatgcatctgaccgtatgggaatgggcaccacatatctggctttaatggccacttttaaaatgagacctatgttcgcagtgggtctcctgtttaggcgccttaccagccgggaggttctgctactcacgatcgggctgtcattggtggccagtgtcgagctgccaaactccttagaagaactcggagatggcctggctatgggcattatgatacttaagctgttgacagacttccaatctcaccagctctgggcgaccctgctaagcctgacttttatcaaaaccacactttccctccattacgcctggaagactatggcaatggtactgtcaattgtgagcttgttccccctgtgtttaagtaccacgtctcagaagacaacctggctcccggttctgcttgggtccctgggatgcaaacctttgactatgtttctcatcacagaaaataagatttggggtagaaaaagctggccactgaacgagggcatcatggctgtgggggtcgtgtcgatactactgtcatctcttctcaagaacgatgtacccctggccggacctttgatcgccggcggtatgttaattgcttgttatgtgatcagtgggtccagcgcagacctgtctctcgaaaaagccgcggaggtcagctgggaggaagaggctgaacactccggagcctcacataatattctggttgaggtgcaggatgacggcaccatgaagatcaaagatgaagagagggacgatactcttacaatactgttgaaggcaaccctactggccgtgagtggcgtctaccccctcagcattccagctacgctgttcgtgtggtatttttggcaaaagaaaaagcagcgatctggggttctttgggacactccttcacccccagaggtagaacgcgcagtgttagatgacggaatctaccggatcatgcagagaggtctgctcggcaggagccaggtcggggtgggagttttccaagagaacgtgttccacaccatgtggcacgtcacacgtggcgccgtgttgatgtatcagggtaaacgcctggaaccgagttgggcgagcgtaaagaaagacctcatttcctacgggggaggctggcggctgcagggctcttggaataccggggaggaggtccaggtgatagctgttgaacctggaaagaaccccaagaatgtgcaaacagccccaggtacttttaaaacccccgagggcgaagtcggggcaatcgcccttgatttcaagcctggaacgtcgggcagcccaattgtgaacagagagggtaaaatcgttgggctgtacggaaatggcgtggtcacaacttcaggcacctatgtgtccgctattgcccaggcaaaggctagtcaggaagggcccttgcctgagatcgaggacgaagtatttaggaaacgaaacctaacaataatggatctgcatccgggatctggtaagacccggcgctacctcccagccatcgtgagagaggcgattaagaggaaattacggactctgatccttgcccccacccgagttgtcgcaagcgaaatggctgaggccctgaagggcatgcctattagatatcaaacaacggctgtgaaatccgaacacactgggaaggagatcgtggacctcatgtgccatgcaaccttcacaatgcgcttgctgtcaccagtcagggtacccaattacaacatgataattatggatgaggcccactttaccgacccttctagcatcgccgctcgtggatatatcagtactcgggtgggcatgggtgaagcggcagccattttcatgacagctaccccgcccgggtccgttgaggcctttccacagagcaatgcagtgatccaggatgaagagagagacatacctgaaaggtcttggaactcaggatacgagtggattacggatttccccggcaaaactgtctggtttgtgccatccatcaagagtggcaatgacattgccaactgtctccgcaagaatgggaaacgagttatccagctgagcagaaagacattcgataccgagtatcagaaaaccaagaacaacgactgggactacgtggtcactacagatatatcggaaatgggagctaattttcgggcggacagggtgattgatcctcgccgttgccttaaacccgtaatcctaaaggacggtccagagagagtgatcctggccggcccgatgcctgttaccgtcgcatctgctgcccagcggagggggcgcattggacgaaaccataataaggaaggcgatcagtacatctatatgggtcagcccttgaacaatgacgaggatcacgcacactggacagaggccaaaatgttactggacaacattaatactccagaagggataatccccgctctcttcgagcctgaaagagagaagtccgccgcgattgatggcgaataccggctgaggggagaggcacgcaaaacgttcgtggagcttatgagaaggggcgacctgccagtgtggctcagctataaggtcgcctcagaagggtttcaatacagtgatcggcgttggtgcttcgacggagagcgcaacaatcaggttttggaagagaacatggatgtggaaatctggaccaaagagggtgagcgaaagaaactgagacccaggtggctagacgctcggacatattctgaccctctggccctccgcgaatttaaggagttcgctgcaggcagaaggtccgtaagcggggatcttatcctggaaattggaaagttaccgcagcatttgactcagcgggcccaaaatgctctggacaacctcgtgatgctgcacaattcagagcagggcggtcgagcctacagacatgcaatggaggaacttccagataccatagagacactgatgctcttggcgctgatcgccgtcttaaccgggggcgtgactctatttttcctgagtggacgcggcctcgggaaaacgagcattggacttctgtgtgttatggcttcctctgtgttgctgtggatggccagcgtcgaaccccactggatcgcagcttccattatcctcgagtttttcctgatggtacttctcatacctgaacccgacaggcagcggaccccacaggataaccaactggcctatgtggttatcggtttgctgtttatgattttaacagtggcagccaatgagatgggcctactggagactaccaagaaagacctcgggatcggacacgtcgctgtggaaaaccatcaccatgcgacaatgcttgatgtcgacctgcaccctgcctcagcatggaccttgtacgctgtggccactacaattatcacgcccatgatgcgtcataccatagagaacactacagccaatatttctctgaccgcaatcgctaaccaggccgcgattctcatgggcctggataagggttggccaatcagtaaaatggacataggggttcctcttttagctctgggctgctacagccaggtgaatccgctcaccttgacagccgcagtactgatgctagtggcccactatgctatcattggacccggcctgcaagcaaaggccactagagaagcgcagaagaggacggctgccgggatcatgaaaaacccaaccgtcgatggaattgttgcaatcgacctcgatcctgtggtctacgacgccaagttcgagaaacagcttggccagataatgctgttgattctgtgtacaagccaaatcctcctgatgcgcactacctgggctttatgcgaatccatcacacttgccaccggtcccctgactacgctctgggaggggtctccaggaaagttttggaatacaaccattgcagtgtcaatggctaacatcttccggggcagctatctagccggtgcgggcctggccttttccttgatgaaaagtctagggggaggccgaagagggactggagcacagggcgagaccctcggtgaaaagtggaagaggcagcttaatcagctgtctaaaagcgagttcaacatatacaagcgctcagggattatggaagtagaccggtccgaggctaaagaaggattgaagagaggcgagacaactcgtcacgccgtgagtaggggtaccgcaaaactgcggtggttcgttgagcgcaatctcgtgaagcctgaaggcaaggtcatcgatttagggtgtggacgaggcgggtggagctattactgcgctggactgaaaaaggtgacagaggtcaaaggctatacgaagggtgggcccggacatgaggagccgattccaatggccacctacggctggaaccttgtgaaactgcactctggcaaggacgtatttttcactcctcccgaaaaatgtgatacactactctgcgacatcggggagtcctcaccaaatcccaccatagaggaaggaagaactctgagggtattgaagatggtggagccttggctgcggggtaaccaattttgtatcaagattctcaatccgtacatgcccagcgtcgtggaaacacttgagcagatgcagcgcaaacatggcgggatgctggttagaaacccattatcgagaaattctacccacgagatgtattgggtgagttgcggaacgggcaacatcgtctccgccgtgaatatgaccagccgaatgctgttgaaccggttcacaatggcgcaccgtaagcctacttacgaaagagatgtagacctcggtgctgggacccgccatgtggcagttgagcccgaagtcgccaacctggatattatcggacagaggattgagaatatcaaacacgaacataagtcaacatggcactatgacgaggataacccttacaaaacttgggcttatcatggctcctacgaggtgaagccatctggcagcgccagttccatggtgaatggggtcgttaagctacttaccaaaccctgggacgtgatacctatggtaacacaaattgcaatgaccgatactacgccatttggacagcagcgggtgttcaaggaaaaagtcgacacaagaacccccaaggccaaacgcggtactgctcaaatcatggaggtgaccgcgaggtggctgtggggctttctcagccgaaacaagaagccgcggatctgtacaagagaagagttcacgaggaaagttcgctctaatgccgcaattggggctgtgtttgtcgacgaaaaccagtggaactcagccaaggaggcagtggaggatgaacgtttctgggacctggtacagaaagagcgggaattgcacaagcagggaaaatgcgcaacctgcgtttataacatgatgggcaagagagagaagaaactgggtgaatttgggaaggctaaaggaagtagggccatatggtacatgtggctcggcgcgcgcttccttgagtttgaggcactgggcttcatgaatgaagatcactggttctcccgagagaacagcttatctggggtggaaggagagggtctgcataagttgggctacatcctccgggacatttcgaaaatccctgggggaaatatgtatgccgatgacactgctggctgggatacaagaattaccgaggacgatctgcaaaacgaagccaagatcactgacataatggagccagaacacgcactacttgctacatcaatctttaaactgacctaccagaataaggtcgtgagggtgcagcgccccgccaagaacggtacagtcatggatgttattagcagacgggaccagagggggtccggacaagtgggcacttatggcctcaataccttcacgaacatggaggctcagctgatccgtcagatggaaagtgaggggatatttttgccttctgagttagaaaccccaaacctggccgagcgagtactcgattggcttgaaaaatacggagtggagcgcctgaagagaatggcaatcagcggtgacgactgtgtcgtgaaacccatagatgaccggttcgcgacagccctaactgctctgaatgatatgggcaaggttaggaaagacattccgcagtgggaaccttccaaggggtggaacgattggcaacaggtgcccttttgctcacatcacttccaccagctcatcatgaaggacggacgcgagatcgtcgtgccatgtagaaatcaggatgagttggtaggccgggccagggttagtcaaggtgcagggtggtctctgcgagaaaccgcttgccttggaaaaagctatgcccagatgtggcagctgatgtactttcatcgtagagacctccgcttagcagccaacgcgatttgttccgctgtgcctgtcgattgggtgcccacatcacggactacctggagcatacacgcccatcaccaatggatgacgacagaggacatgctgtctgtttggaatagggtgtggatcgaagagaacccatggatggaagataagacccatgtctccagttggggcgacgtgccctatttgggcaaaagagaggaccagtggtgcgggagcctgattggactcactgcacgcgccacatgggcttcgaatatccaggtagccattaaccaggtgcggaggcttatcggtaatgagaactacctggattacatgacctccatgaagcgattcaaaaatgaaggcgaccctgagggggcactatggtga

SEQ ID NO: 13945 - RNA, 9879 nt, synthetic construct
  misc_feature 1..9879: note = derived and/or modified CDS sequence (opt3) from DENV-1__GU131777__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaagacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaagcccctaccaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggtagcttcaaactggagaaggaagtggccgagacgcagcacggaacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgccagtgtggaactgccaaactccttagaggaactcggggatggactggctatgggcattatgatccttaaactgttgaccgacttccaatctcatcagctctgggcgactctgctaagcctgacctttattaagacaactttctcccttcactatgcctggaaaaccatggcaatggttctctcaatcgtgagcctgtttcccttgtgtctgagtacgacatctcagaagaccacttggttaccggtcctcctgggctcccttgggtgcaagcctctgacaatgttcttgatagctgagaataaaatctggggaaggcgaagctggccactcaacgaaggtattatggccgtaggcatcgtgtcgattctgctatcatctctgcttaagaacgatgttcccctcgccgggcctctgatcgctggaggcatgttgatagcatgttacgtgattagtggttccagcgccgacttatctctggagaaagcggctgaggtcagctgggaagaggaagccgagcattccggggcatcacacaatatcctcgtggaagtacaggatgacggaaccatgaagatcaaagatgaggagcgcgacgatactctgacaattcttctgaaggccaccttgctagctataagtggcgtgtatcccctgagcatcccagcaacgctctttgtctggtacttctggcagaagaagaagcagcggtctggcgttctgtgggacactccttcacccccagaagtggagagagccgtgcttgatgacgggatttataggatcatgcagcgtggattactgggtcgcagccaggtcggcgtgggggttttccaagaaaacgtatttcataccatgtggcacgtgacacggggagcggtcctcatgtaccagggcaaaagattggagccgagttgggctagcgtgaagaaagacctgatttcctacggtgggggatggaggctccagggctcttggaataccggcgaggaagttcaggtgatcgccgtcgagcctgggaagaaccccaaaaatgtgcaaacaactccaggaaccttcaagacgcccgaaggtgaggtaggcgcaatagccctggattttaagcctgggacatcgggaagcccaatcgtcaaccgagaaggcaaaattgtgggtctttatgggaatggagttgtgactacctcaggcacatacgtctccgctatcgcccaggcaaaggctagtcaggagggccccctgcctgagattgaagacgaggtgttccggaaacgcaacttgaccatcatggatctacacccggggtctggaaagactagaaggtatctgccagccatagttcgggaagcgattaaacgaaagctcagaaccttaatcctggcccccacacgcgtggtcgcaagcgagatggctgaagcccttaagggtatgcctatcaggtaccaaacgactgctgtgaaatccgagcataccggcaaggagattgtagacctgatgtgccacgcaacatttaccatgcgtctcttgtcaccagtgcgggttcccaattataacatgatcataatggatgaagcccatttcactgacccttctagcattgccgctagagggtacatcagtacaagggtcggaatgggcgaggcggcagccatttttatgaccgctacgccgcccggttccgtggaagccttcccacagagcaatgcagtgatccaggatgaggaacgcgacatacctgagcgatcttggaactcagggtatgagtggattactgattttcccggaaaaacagtctggttcgtaccatccatcaagagtggcaatgacatcgccaactgtctgaggaaaaatggcaagcgggtgattcagctcagcaggaagacctttgataccgaataccagaaaactaagaacaacgactgggactacgttgtgacaaccgatatctcggagatgggggctaatttccgcgcggaccgtgtcattgatcctagacggtgcctgaaacccgtgatacttaaggacggaccagaaagggttatcctagccggtccgatgcctgtgacagtcgcatctgctgcccagcgccgaggcagaattgggcggaaccacaataaagagggagatcagtatatctacatgggccagcccctgaacaatgacgaggatcatgcacactggactgaagccaagatgttgttagacaacatcaatacgccagagggtattatacccgctctgttcgaacctgagagggaaaagtccgccgcgatcgatggggagtatcgcctcagaggcgaggcaaggaaaacctttgtggaactgatgcggcgtggagaccttccagtatggctgagctacaaggtggcctcagagggcttccaatatagtgatcgccgatggtgctttgacggggaaagaaacaatcaggttctcgaggaaaacatggatgtcgagatttggacaaaagagggagaaaggaagaaattgcggccccgctggctggacgctagaacttactctgaccctctagccctgagggagttcaaggaatttgctgcaggtcggcgatccgtgagcggcgatctcatccttgagattgggaaactgccgcagcacttaacccagagagcccaaaatgctttggacaacctggtgatgctccataattcagaacagggaggccgcgcctataggcacgcaatggaggagctgccagatacaatcgaaacccttatgctgctcgcgttgatagccgtcctgactggtggggttacgttattctttctaagtggccggggactgggcaagaccagcatcgggctcctttgtgtgatggcttcctctgtactgttgtggatggccagcgtggagccccattggattgcagcttccatcattctggagttctttctcatggtcctgcttatccctgagcccgaccgtcagagaacaccacaggataaccaactcgcctacgtggttataggactgttgttcatgattctgactgtggcagccaatgagatgggtttactagaaaccacaaagaaagacctgggcatcgggcacgtcgctgtaggaaaccaccatcacgcggccatgctcgatgtggaccttcatcctgcatcagcttggaccctgtacgccgttgccactacaattatcacgcccatgatgaggcacaccatagagaacactacagcaaatatctctttgaccgctattgccaaccaggcggctatcctgatgggcctcgataagggttggccaattagtaaaatggacatcggggtgcctctgcttgccttaggctgctattcgcaggtcaatccgctgaccctcacagcagccgtgttgatgctggtcgctcattacgcaataattggacccggcctacaagccaaggcgactcgcgaagctcagaaacggacggccgcagggatcatgaagaacccaaccgtggatggaatcgttgccattgacctggatcctgtggtatatgacgctaagtttgagaaacagctcggccagatcatgcttctgatattgtgtacaagccaaattctgctcatgcgaactacctgggccctgtgcgaatccatcacattagcaaccggtccccttactacgctgtgggaggggtctccaggaaagttctggaatacaaccattgctgtgtcaatggccaacatctttagaggcagctacctcgcgggtgccggcctagcattctccctgatgaaaagtctagggggaggcaggcgcgggactggagctcagggcgagaccctgggtgaaaagtggaaacggcagctcaatcagctttctaagagcgagttcaacacatataagagatcagggataatggaagtcgaccgttccgaggccaaagaaggactgaagaggggcgagactaccaaacacgcagttagtcggggtacagctaagttgcgctggtttgtggagcgaaatctggtcaaacctgaaggcaaggtgatcgatctcgggtgtggaagaggcgggtggagctactattgcgccggattaaagaaagtaacggaggtgaagggctacaccaaaggtgggcccggacacgaagaaccgattccaatggccacttacggctggaacctggttaaacttcattctggcaaagacgtgttctttatccctcccgaaaagtgtgatacactgctatgcgacattggggagtcctcaccaaatcccaccatcgaggaaggaaggactctccgggtcctgaaaatggtggagccttggttgcgcggtaaccaattctgtattaagatcctgaatccgtatatgcccagcgtcgtggaaacactcgagcagatgcagagaaagcacggcgggatgcttgttaggaacccactgtcgcgaaattctacccatgagatgtactgggtaagttgcggaacgggcaacatagtgtccgcggtcaatatgaccagccggatgttactgaaccgttttacaatggctcacagaaaacctacttatgaacgcgatgtggacttgggtgcagggaccaggcacgttgccgtggagcccgaagtcgctaacctcgatattatcggacagcggatcgagaatattaagcatgaacacaaatcaacatggcattacgacgaggataacccttataagacttgggcctaccacggctcctatgaggtgaaaccatctggcagcgcaagttccatggtaaatggggtggttaagctgctaaccaagccctgggacgtcatacctatggtgacacaaatcgccatgaccgatactacgccattcggacagcagagagtgtttaaagaaaaggtcgacacacgcacccccaaagctaagaggggtactgcgcaaattatggaggttaccgccaaatggctttggggcttcctgagccgaaacaagaagccgcggatctgtacaagagaagagtttacgaggaaagtgcgctctaatgcagctattggggccgtattcgtggacgaaaaccagtggaactcagcaaaggaggccgtcgaggatgaacgtttttgggacctcgtgcatcgggagagagaactgcacaaacagggaaagtgcgctacctgcgtttacaacatgatgggcaaaagggagaagaagttgggtgagttcgggaaagccaagggaagtcgcgcgatctggtacatgtggctgggcgcacgatttctcgagttcgaggcccttggcttcatgaatgaagatcactggttttcccgggagaacagcctgtctggggtggaaggagagggtttacataaactgggctatatattgagagacatctcgaagattcctgggggaaatatgtacgctgatgacactgccggctgggatacaaggatcaccgaggacgatctccagaacgaagcacgcattactgacatcatggagccagaacacgctctgctagccaaatcaatattcaaacttacatatcaaaataaagtcgtgagagtacagcggcccgctaagaacggtaccgttatggatgtgattagcaggcgtgaccagcgagggtccggacaggtcggcacatacggcctgaatacttttaccaacatggaggcccaactcatccgccagatggaaagtgaggggatcttctctcctagcgagctggaaacgccaaacttggcagagagagtgttagattggctggaaaagtatggagtggagcggctcaaaaggatggcgatttccggtgacgactgtgtcgttaagcccatagatgaccgctttgccaccgctcttacagccctgaatgatatgggcaaagtgagaaaggacatcccgcagtgggaaccttcaaaagggtggaacgattggcagcaagtacccttctgcagtcatcactttcaccagctaattatgaaggacggacgggagatcgtggtcccatgtaggaatcaggatgagctggtgggccgagcacgtgtttctcagggtgctgggtggagcctcagagaaactgcctgcttgggaaagtcctacgcacaaatgtggcagctgatgtatttccatcgccgggaccttaggctggccgcgaacgctatttgttcagccgtgcctgtcgattggatccccaccagcagaacaacttggtctatacacgcacatcaccagtggatgaccacggaggacatgctctccgtgtggaatcgcgtatggatcgaagagaacccatggatggaagataaaacacatattagtagctggggcgacgttccctacttaggcaagcgggaggaccaatggtgcgggtcgctgatcggattgaccgccagggctacttgggccacaaatattcaggtggcaatcaaccaggtccgaagactgattggtaatgagaactacctcgattatatgacctccatgaaacggtttaagaatgaatctgaccctgagggcgctctttggtga

SEQ ID NO: 13946 - RNA, 9879 nt, synthetic construct
  misc_feature 1..9879: note = derived and/or modified CDS sequence (opt3) from DENV-1__GU131778__SS-prME
  source 1..9879: mol_type = other RNA
agcgtgaccatgctgctcatgcttatgcccaccgcactggctttccacttgactacgaggggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccacgatcacatactctgtggagcaacggagtactagaatctgagatgatcatacccaagatctatggcggtcctatttcccagcacaattacagaccaggctactttacacaaaccgccgggccgtggcatctgggaaaactcgagctggatttcgacctttgcgaaggcactacagtcgtggtggatgagcactgcgggaacaggggacccagtttgcgcaccacgactgtcaccggcaagatcattcacgaatggtgttgccggagctgtacactgcctccattaagatttaaaggtgaggacgggtgctggtatggaatggagatcaggcccgttaaggaaaaggaggaaaatctcgtgaaatctatggtatccgctggctcaggtgaggtggacagtttcagcctgggccttctgtgtatatcgattatgatcgaagaggtcatgcgctcccgatggtctcggaagatgttgatgaccgggactctcgccgtgtttttcctgctaatcatgggacagctgacatggaacgatctcattcgtctgtgcatcatggttggcgcaaatgctagcgacagaatggggatgggaaccacataccttgccttgatggcaacttttaaaatgaggcctatgttcgccgtgggcctgttatttcgccggctcacctcaagagaggtcctgcttctgacgattggtctaagtctcgtggcttccgttgaactgccaaactctttggaggaactgggggatggattagcgatgggcataatgatcctcaagctgcttacagacttccagagccatcaactgtgggccaccttgctctccctgacttttattaaaaccacattctcactacactatgcatggaagactatggctatggtgctgagcatcgtcagtctttttcccctctgtctgtctaccacgtcccagaagacaacctggttgccggtactgttaggcagcctcgggtgcaaacctctgactatgttccttattgccgagaataagatctggggaaggaaatcgtggccactgaacgaaggtataatggccgtgggcatcgtttcaattttgctctctagtctgctaaagaacgatgtgcccctggctgggcctcttatcgcaggaggcatgctcattgcctgttacgtcatctccggtagctctgcggacctgagcttggagaaagctgccgaggtgtcctgggaagaggaagcagagcattcaggggccagtcacaatatattagtagaagtgcaggatgacggaacaatgaagattaaagatgaggagcgagacgataccctgactatcctcctgaaggctacacttctggcagtcagcggcgtttatcccttgtctatcccagccaccctattcgtgtggtacttttggcagaagaaaaagcaacgctccggcgtgctgtgggacattccttcacccccagaagtcgagcgggcggtgctcgatgacgggatatatagaatcatgcagaggggactgcttggtcgtagtcaggttggcgtaggggtgttccaggaaaacgtctttcatacgatgtggcacgtgactcgcggagctgttttaatgtaccaaggcaaacggctggagccgagctgggcctccgtgaagaaagacctcatttcttacggtgggggatggagattgcagggctcgtggaataccggcgaggaagtccaggtgatcgcagtagagcctgggaagaaccccaagaatgtccagacagccccaggaaccttcaaaacaagcgaaggtgaggtgggcgctattgccctggattttaagcccgggacttcaggatcccctatcgttaacagggaaggcaaaatagtgggtctctatgggaatggagtcgtgaccacgagtggcacatacgtttctgcaatcgctcaagccaaggcgagccaggagggcccactgcccgagattgaagacgaggtgttccgaaaacggaaccttactatcatggatctgcaccctgggtccggaaagacccgcagatatttgccggccattgtcagggaagcaatcaagcggaaactacgaacactgatactcgctccaaccagagtggtagcctcagagatggctgaagcattaaagggtatgcccattcgctaccagactaccgccgtgaaatctgagcatacaggcaaggagatcgttgacctgatgtgccacgccacgtttactatgaggcttctgagccctgtccgtgtgccaaattataacatgatcattatggatgaagctcatttcaccgaccccagttccatcgcggcacgggggtacataagcacaagagtgggaatgggcgaggccgctgccatttttatgaccgcaactcctccgggttctgtcgaagccttcccccaatcaaatgctgtaatccaggatgaggaaagggacattccagagcgctcctggaacagtgggtatgagtggatcacagattttcctggaaaaaccgtgtggttcgttcccagcataaagtcgggcaatgacattgcgaactgtctccgaaagaatggcaaaagagtgatccagttgtctcggaagacgttcgatactgaataccagaaaacaaagaacaacgactgggactacgtcgtgaccaccgatatctccgagatgggggccaattttagggcagaccgcgttattgatccacgtagatgcctgaaacctgtgatcctcaaggacggacccgaacgggtcattctggctggtccaatgccggtgactgtagccagcgcagcccaaaggcgcggccgaatagggagaaaccacaataaggagggagatcagtatatctacatgggccagcctcttaacaatgacgaggatcatgctcactggacagaagccaaaatgctactggacaacattaatacccccgagggtatcatcccagcgttgttcgaacccgagcgggaaaagtcagcagccattgatggggagtataggttacgcggcgaggctagaaaaacatttgtggaactgatgaggcggggagacctccctgtttggctgagttacaaggtcgcctctgagggcttccagtattccgatcgtcgctggtgctttgacggggaacgaaacaatcaagtgcttgaggaaaacatggatgtggagatatggactaaagagggagaaagaaagaaactgaggccacggtggctcgacgctcgcacgtacagcgaccccttggcactgagagagttcaaggaatttgccgctggtaggcggtcagtcagtggcgatctaatcctggagattgggaagctccctcagcaccttacccagcgagcccagaatgcactggacaacttagttatgttgcataatagcgaacaaggaggcagagcgtatcgccacgccatggaggagctgccggatacaatcgaaactctcatgctgcttgctctgattgccgtgctcaccggtggggtaacattgttctttctgtccggcaggggattaggcaaaacctctatcgggctactgtgtgtgatggcaagctccgtcctcctttggatggcttcagtggagccacattggatagccgcatctatcattctggagttctttttgatggttctgctcatccccgagcctgaccggcagcgtactccccaggataaccagctggcctacgtggtcattggacttctcttcatgatcctgacggtagctgcgaatgagatgggtttgctggaaaccacaaagaaagacttaggcatagggcacgtggccgttgagaaccaccatcacgcagctatgctagatgtggacctgcatccagccagtgcctggactctctacgcagtcgctaccacaattatcacccctatgatgagacacactattgaaaacacaacggccaatatctcgcttaccgcgatagctaaccaagccgcaatcctgatgggattggataagggctggcccattagcaaaatggacatcggtgtgccactgctcgccctggggtgctattcccaggtcaatcctcttactttaacagctgcagtgctgatgctcgttgcccattacgcgattatcggcccgggattgcaggctaaggccaccagggaggcacaaaagcgcaccgccgctggcataatgaaaaaccccacagtggatgggattgtagccatcgacctggatccagtggtctatgacgcaaagtttgaaaaacagctaggacagatcatgctgctcattctttgtacttctcagatcctgttgatgcggacgacctgggctctgtgcgagtcaataacactcgccactggccctctgaccacattatgggagggtagccccgggaagttctggaataccactattgcggtttccatggccaacatcttccgaggaagttaccttgcaggcgctggtctggccttttctctcatgaaaagcctaggcgggggaagaaggggcacgggggcacaaggagaaacactgggcgagaagtggaagcgccagttgaatcagctgtcaaaatccgagttcaacacctataagcggagtggtattatggaggtggacagaagcgaagctaaagaggggctcaagcgtggagagactaccaaacacgccgtctctaggggcacagccaaacttcggtggtttgtggaacgcaatctggtaaagccagagggtaaagtgatcgatttgggctgtgggcgaggaggctggtcctactattgcgcggggctgaagaaagttactgaagtgaagggatacaccaaaggcggtcctgggcacgaggaacccataccgatggctacatacggatggaacctcgtcaagttacattcaggcaaagacgtgttctttatcccacctgagaagtgtgatacgctgctttgcgacattggcgagagctcgcccaatccaaccatcgaagaggggagaactctgagggtcctaaagatggtggaaccctggctccggggaaaccagttctgtattaaaatcctgaatccttatatgccgtctgttgtagagacattggagcaaatgcagcgcaagcacggtggcatgctggtgagaaaccccctcagtagaaattccacccatgaaatgtactgggtcagctgcgggactggaaacattgtgtcagcagttaatatgacatcccgaatgcttctgaaccggtttaccatggcccaccgtaaaccaacgtatgagagagatgtggacttaggcgctggtacccgccacgtcgccgtggaacctgaggtagcaaacctggatatcatagggcagaggattgaaaatatcaagcatgagcacaaatctacatggcattacgacgaggataacccctataagacttgggcctaccacggaagctatgaagtgaagcctagtggctccgctagctctatggttaatggcgtcgtgaaattgctcaccaagccatgggacgtgatccccatggtcacacagattgcgatgactgataccacacctttcgggcaacagcgggtttttaaagagaaggtggacaccagaactccaaaagccaagcgcggaacggcacagataatggaagtaacagctaagtggctgtggggtttcctatcaaggaacaaaaagccccgaatctgtacccgggaggaatttactagaaaagtgaggagtaatgccgcaattggcgccgtcttcgtggacgagaaccaatggaactccgctaaggaggccgttgaagatgagcgcttttgggaccttgtgcatcgtgaacgggagctgcacaaacaggggaagtgcgcgacctgcgtctacaacatgatgggaaagagagagaagaagctcggcgagttcggtaaagcaaaggggagcagggccatctggtacatgtggctgggagctcgcttcttggagtttgaagccctgggcttcatgaatgaggatcactggttttctcgagaaaactcgctctcaggcgtggagggggagggacttcataaactgggttatattttacgggacatcagcagaataccgggcgggaatatgtacgcagatgacacagctggatgggatacgaggatcaccgaagacgatctgcagaacgaggccaagattactgacatcatggaacctgagcacgctttgctcgccaaatccattttcaagctgacatatcagaataaggtagttcgcgtgcaaagaccagccaaaaatggcaccgtcatggatgtgatcagtcggagggaccagcgtggttctggacaggtgggaacttacggcctaaatacatttaccaacatggaagcgcagcttatacgacaaatggagagcgagggcattttctccccctcagaactggagacacctaacctcgccgggcgcgtcctggattggttggaaaagcatggagttgagagattaaaacggatggctatcagtggtgacgactgtgtggtaaagccaatcgatgacaggtttgccactgcactgaccgctctcaatgatatgggcaaagtgcgcaaggacattccccagtgggaaccgtctaaggggtggaacgattggcagcaggtccctttctgcagccaccactttcatcaacttataatgaaagacggaagagagatcgtggttccctgtcggaatcaggatgagctggtgggcagggcccgagtctcccagggtgcagggtggtcactacgtgaaacggcctgcctgggaaagagctatgcgcagatgtggcaactcatgtacttccacagacgcgacttgcggctggctgccaacgcaatttgttctgccgtgccagtagattgggttcctacctccaggacaacttggagtatccatgctcaccatcagtggatgaccacagaggacatgcttagcgtgtggaatagagtctggattgaagagaacccctggatggaagataaaactcacatctcgtcctggggcgacgtgccatatctgggcaagcgcgaggaccagtggtgcgggtctctcataggattaaccgcccgggcaacgtgggctacaaatatccaagttgccattaaccaggtgaggcgactgatcggtaatgagaactacttggattacatgacctcaatgaaaagatttaagaatgaaagcgaccccgagggcgcgctgtggtga

SEQ ID NO: 13947 - RNA, 9879 nt, synthetic construct
  misc_feature 1..9879: note = derived and/or modified CDS sequence (opt3) from DENV-1__GU131779__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaagacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaagcccctaccaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggtagcttcaaactggagaaggaagtggccgagacgcagcacggaacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcctccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgtgagtgttgaactgccaaactccttagaggaactcggggatggactggccatgggcattatgatccttaaactgttgaccgacttccaatctcatcagctctgggctactctgctaagcctgacctttattaagacaactttctcccttcactatgcgtggaaaaccatggccatggtgctctcaatcgtcagcctgtttcccttgtgtctgagtacgacatctcagaagaccacttggttaccggtactcctgggctcccttgggtgcaagcctctgacaatgttcttgatagcagagaataaaatctggggaaggcgaagctggccactcaacgaaggtattatggctgtgggcatcgtttcgattctgctatcatctctgcttaagaacgatgtgcccctcgccgggcctctgatcgccggaggcatgttgatagcttgttacgtcattagtggttccagcgcagacttatctctggagaaagccgcggaggtgagctgggaagaggaagctgagcattccggggcctcacacaatatcctcgtagaagtgcaggatgacggaaccatgaagatcaaagatgaggagcgcgacgatactctgacaattcttctgaaggcaaccttgctagccgtcagtggcgtttatcccctgagcataccagctacgctctttgtgtggtacttctggcagaagaagaagcagcggtctggcgtgctgtgggacactccttcacccccagaagtcgagagagcagtgcttgatgacgggatctataggattatgcagcgtggattactgggtcgcagccaggttggcgtaggggtgttccaagaaaacgtctttcataccatgtggcacgtgacacggggagccgttctcatgtaccagggcaaaagattggagccgagttgggcgagcgtgaagaaagacctgatctcctacggtgggggatggaggctccagggctcttggaataccggcgaggaagtccaggtgattgctgtagagcctgggaagaaccccaaaaatgtccaaacaactccaggaaccttcaagacgcccgaaggtgaggtgggcgccatcgcactggattttaagcctgggacatcgggaagcccaatagttaaccgagaaggcaaaatcgtgggtctttatgggaatggagtcgtgactacctcaggcacatacgtttccgccattgctcaggccaaggcaagtcaggagggccccctgcctgagatcgaagacgaggtgttccggaaacgcaacttgaccattatggatctacacccggggtctggaaagactagaaggtatctgccagctatcgtccgggaagccataaaacgaaagctcagaaccttaattctggcgcccacacgcgtggtagccagcgagatggcagaagctcttaagggtatgcctatcaggtaccaaacgactgccgtgaaatccgagcataccggcaaggagatcgttgacctgatgtgccacgctacatttaccatgcgtctcttgtcaccagtccgggtgcccaattataacatgattatcatggatgaagcacatttcactgacccttctagcatagccgccagagggtacattagtacaagggtgggaatgggcgaggctgcggcaatctttatgaccgccacgccgcccggttccgtcgaggctttcccacagagcaatgccgtaattcaggatgaggaacgcgacatccctgagcgatcttggaactcagggtatgagtggataactgattttcccggaaaaacagtgtggttcgttccatccattaagagtggcaatgacatcgcaaactgtctgaggaaaaatggcaagcgggtgatccagctcagcaggaagacctttgataccgaataccagaaaactaagaacaacgactgggactacgtcgtgacaaccgatatttcggagatgggggccaatttccgcgctgaccgtgttatcgatcctagacggtgcctgaaacccgtgattcttaaggacggaccagaaagggtcatactagcgggtccgatgcctgtgacagtagcctctgcagctcagcgccgaggcagaatcgggcggaaccacaataaagagggagatcagtatatttacatgggccagcccctgaacaatgacgaggatcatgcccactggactgaagcaaagatgttgttagacaacatcaatacgccagagggtatcattcccgccctgttcgaacctgagagggaaaagtccgctgccatagatggggagtatcgcctcagaggcgaggcgaggaaaacctttgtggaactgatgcggcgtggagaccttccagtttggctgagctacaaggtcgcatcagagggcttccaatatagtgatcgccgatggtgctttgacggggaaagaaacaatcaggtgctcgaggaaaacatggatgtggagatctggacaaaagagggagaaaggaagaaattgcggccccgctggctggacgccagaacttactctgaccctctagctctgagggagttcaaggaatttgccgctggtcggcgatccgtcagcggcgatctcattcttgagatcgggaaactgccgcagcacttaacccagagagcacaaaatgccttggacaacctggttatgctccataattcagaacagggaggccgcgcttataggcacgccatggaggagctgccagatacaattgaaacccttatgctgctcgcattgatcgcggtgctgactggtggggtaacgttattctttctaagtggccggggactgggcaagaccagcatagggctcctttgtgtgatggcctcctctgtcctgttgtggatggctagcgtggagccccattggatcgccgcatccattatcctggagttctttctcatggttctgcttattcctgagcccgaccgtcagagaacaccacaggataaccaactcgcttacgtggtcatcggactgttgttcatgatactgactgtagccgcaaatgagatgggtttactagaaaccacaaagaaagacctgggcattgggcacgtggccgttggaaaccaccatcacgctgcgatgctcgatgtggaccttcatcctgcctcagcatggaccctgtacgctgtcgccactacaatcattacgcccatgatgaggcacaccatcgagaacactacagccaatatatctttgaccgcaatcgctaaccaggccgcgattctgatgggcctcgataagggttggccaatcagtaaaatggacattggggtgcctctgcttgctttaggctgctattcgcaggtcaatccgctgaccctcacagccgcagtgttgatgctggttgcccattacgctatcataggacccggcctacaagcaaaggccactcgcgaagcgcagaaacggacggctgccgggattatgaagaacccaaccgtggatggaatcgtagcaatcgacctggatcctgtggtctatgacgccaagtttgagaaacagctcggccagattatgcttctgatcttgtgtacaagccaaatactgctcatgcgaactacctgggctctgtgcgaatccattacattagccaccggtccccttactacgctgtgggaggggtctccaggaaagttctggaatacaaccatcgcagtttcaatggctaacatttttagaggcagctacctcgccggtgcgggcctagccttctccctgatgaaaagtctagggggaggcaggcgcgggactggagcacagggcgagaccctgggtgaaaagtggaaacggcagctcaatcagctttctaagagcgagttcaacacatataagagatcagggatcatggaagtggaccgttccgaggctaaagaaggactgaagaggggcgagactaccaaacacgccgtcagtcggggtacagcaaagttgcgctggtttgtggagcgaaatctggtaaaacctgaaggcaaggtgatagatctcgggtgtggaagaggcgggtggagctactattgcgctggattaaagaaagttacggaggtgaagggctacaccaaaggtgggcccggacacgaagaaccgatcccaatggccacttacggctggaacctggtcaaacttcattctggcaaagacgtgttctttattcctcccgaaaagtgtgatacactgctatgcgacatcggggagtcctcaccaaatcccaccattgaggaaggaaggactctccgggtcctgaaaatggtggagccttggttgcgcggtaaccaattctgtatcaagattctgaatccgtatatgcccagcgttgtagaaacactcgagcagatgcagagaaagcacggcgggatgcttgtgaggaacccactgtcgcgaaattctacccatgagatgtactgggtcagttgcggaacgggcaacatcgtgtccgccgttaatatgaccagccggatgttactgaaccgttttacaatggcgcacagaaaacctacttatgaacgcgatgtggacttgggtgctgggaccaggcacgtcgcagtggagcccgaagtagccaacctcgatataattggacagcggatcgagaatatcaagcatgaacacaaatcaacatggcattacgacgaggataacccttataagacttgggcttaccacggctcctatgaggtgaaaccatctggcagcgccagttccatggttaatggggtcgtgaagctgctaaccaagccctgggacgtgattcctatggtcacacaaatagcaatgaccgatactacgccattcggacagcagagagtttttaaagaaaaggtggacacacgcacccccaaagccaagaggggtactgctcaaatcatggaggtaaccgcgaaatggctttggggcttcctgagccgaaacaagaagccgcggatttgtacaagagaagagtttacgaggaaagtgcgctctaatgccgcaatcggggctgtcttcgtggacgaaaaccagtggaactcagccaaggaggcagttgaggatgaacgtttttgggacctcgtgcatcgggagagagaactgcacaaacagggaaagtgcgcaacctgcgtctacaacatgatgggcaaaagggagaagaagttgggtgagttcgggaaagctaagggaagtcgcgccatttggtacatgtggctgggcgcgcgatttctcgagttcgaggcacttggcttcatgaatgaagatcactggttttcccgggagaacagcctgtctggggtggaaggagagggtttacataaactgggctatatcttgagagacatatcgaagatccctgggggaaatatgtacgccgatgacactgctggctgggatacaaggattaccgaggacgatctccagaacgaagcccgcatcactgacattatggagccagaacacgcactgctagctaaatcaatcttcaaacttacatatcaaaataaagtagttagagtgcagcggcccgccaagaacggtaccgtcatggatgtgataagcaggcgtgaccagcgagggtccggacaggtgggcacatacggcctgaatacttttaccaacatggaggctcaactcattcgccagatggaaagtgaggggatcttctctcctagcgagctggaaacgccaaacttggccgagagagtcttagattggctggaaaagtatggagttgagcggctcaaaaggatggcaatctccggtgacgactgtgtggtaaagcccattgatgaccgctttgcgaccgcccttacagctctgaatgatatgggcaaagtgagaaaggacataccgcagtgggaaccttcaaaagggtggaacgattggcagcaagtccccttctgcagtcatcactttcaccagctaatcatgaaggacggacgggagattgtggttccatgtaggaatcaggatgagctggtgggccgagcccgtgtctctcagggtgcagggtggagcctcagagaaactgcttgcttgggaaagtcctacgcccaaatgtggcagctgatgtatttccatcgccgggaccttaggctggcagccaacgcgatctgttcagctgtgcctgtagattggattcccaccagcagaacaacttggtctatccacgcccatcaccagtggatgaccacggaggacatgctctccgtttggaatcgcgtgtggatagaagagaacccatggatggaagataaaacacatatcagtagctggggcgacgtcccctacttaggcaagcgggaggaccaatggtgcgggtcgctgattggattgaccgcaagggccacttgggctacaaatatccaggtggccattaaccaggttcgaagactgatcggtaatgagaactacctcgattatatgacctccatgaaacggtttaagaatgaatctgaccctgagggcgcactttggtga

SEQ ID NO: 13948 - RNA, 9879 nt, synthetic construct
  misc_feature 1..9879: note = derived and/or modified CDS sequence (opt3) from DENV-1__GU131780__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcaccccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcactagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcagcggccatctgaagtgccgtttaaaaatggataagctgacactaaaagggatgtcgtatgtgatgtgtactggatctttcaagctcgagaaggaagtcgccgagacccagcacggtacggtgctggttcagattaaatacgagggcacagacgctccttgcaagataccattttccacccaggatgaaaaaggggtgactcaaaacggacgccttatcacagcgaatcccattgtaaccgacaaggagaaacctgtcaacatcgaagcagagccacccttcggcgagtcatatatagtgattggtgccggggaaaaggctttgaagctgagttggtttaaaaagggcagctccatcggaaaaatgttcgaggccactgcaagaggcgccaggcggatggctatcctcggggataccgcctgggactttggatctattggtggcgttttcacaagcgtggggaagctggtccatcagatctttggaacggcatacggcgtgcttttctcaggtgtaagttggaccatgaaaattgggataggcgtgctgttgacttggctcggactgaattcccgaagcacatctttatcaatgacctgtatcgcggttggcctggtcacactatacctcggggtgatggtgcaggctgatagtggatgcgtcattaactggaagggccgcgaactgaagtgtggtagcgggatctttgttactaatgaggtgcacacctggacggaacagtataaattccaagccgactccccgaagagactttctgcagccatcggaaaagcttgggaggagggcgtgtgcggtattaggtcggccacacggttggaaaacataatgtggaagcagatcagcaacgagctgaatcatattctcctggaaaacgacatgaaatttaccgtagtcgtgggcgatgttgcagggatcttagctcagggaaagaaaatgattcgccctcagcccatggagtacaagtattcctggaagtcatggggcaaagccaagatcataggggcggacgtgcaaaatactaccttcatcattgatggaccaaacacacctgaatgtcccgacgatcagagagcctggaatatctgggaggtcgaggactacggctttggtattttcactaccaacatctggctgaaacttagggatagttatacacaggtgtgcgaccaccgtttgatgtctgctgcaataaaggatagcaaagccgttcacgctgacatggggtactggattgaatccgagaagaatgaaacgtggaagctcgcccgggcatcattcatcgaggtgaaaacctgtatttggccaaagagccatactctgtggtctaacggagtactagaatccgagatgatcatacccaaaatctatggcggtcctattagtcagcacaattaccgaccaggctactttacacaaaccgcggggccgtggcatctgggaaagctcgagctggatttcgacctttgcgaaggcactacagtcgtggtggatgagcactgcgggaacagaggacccagcttgaggaccacgactgtcaccggcaaaatcattcacgaatggtgttgccgctcttgtacactgcctccattacggtttaagggtgaggacgggtgctggtatggaatggagatcagacccgttaaggaaaaagaggaaaatctcgtgaagtccatggtatcagccggcagtggtgaggtggacagcttctcgctgggccttctgtgtatatccattatgatcgaagaggtcatgaggtctcgctggagccgaaaaatgttgatgaccgggactctcgctgtgtttttcctgctaatcatgggacagctgacatggaacgatctcattcggctgtgcatcatggttggcgccaatgcatcagaccgtatggggatgggaaccacataccttgctttgatggccacttttaagatgagacctatgttcgcagtgggcctgttatttaggcgcctcaccagtcgggaggtcctgcttctgacgattggtctatccctcgtggcctctgttgaactgccaaacagcttggaggaactgggggatggattagctatgggcataatgatcctcaaactgcttacagacttccagtcccatcaactgtgggcgaccttgctctcactgacttttattaagaccacattcagcctacactatgcctggaagactatggcaatggtgctgagtatcgtctctctttttcccctctgtctgtccaccacgagccagaaaacaacctggttgccggtactgttaggctcgctcgggtgcaagcctctgactatgttccttattgctgagaataaaatctggggaagaaagtcatggccactgaacgaaggtataatggccgtgggcatcgtttctattttgctcagttccctgctaaaaaacgatgtgcccctggccgggcctcttatcgctggaggcatgctcattgcatgttacgtcatcagcggttctagcgccgacctgtccttggagaaggcggctgaggtgtcatgggaagaggaagccgagcatagtggggcaagccacaatatattagtagaagtgcaggatgacggaacaatgaaaattaaggatgaggagagggacgataccctgactatcctcctgaaggccacacttctgaccgtctctggcgtttatcccttgtccatcccagctacgctattcgtgtggtacttttggcagaaaaagaaacaacgatcaggcgtgctgtgggacactcctagtcccccaaaggtcgaacgcgcagtgctcgatgacgggatttatcggataatgcagagaggactgcttggtaggagccaggttggcgtaggggtgttccaggagaacgtctttcataccatgtggcacgtgacacgtggagccgttttaatgtaccaaggcaaacgcctggaaccgtcctgggcgtctgtgaagaaggacctcatctcgtacggtgggggatggcggttgcagggcagctggaataccggcgaggaggtccaggtgattgctgtagaacctgggaaaaaccccaagaatgtccagacagccccaggaactttcaaaacctcagagggtgaagtgggcgcaatcgccctggattttaagcccgggacgtccggaagtcctattgttaacagagagggcaaaatcgtgggtctctatgggaatggagtcgtgacaacttctggcacctacgttagcgctatagcccaagcaaaggcttcccaggaaggcccactgcccgagatcgaggacgaagtgttcaggaagcgaaaccttacaattatggatctgcaccctgggtcaggaaaaacccggcgctatttgccggccatcgtcagagaggcgattaagaggaaactacggactctgatcctcgccccaacccgagtggtagcatctgaaatggctgaggccttaaagggtatgcccataagataccagacaacggctgtgaaaagcgaacatactggcaaggagattgttgacctgatgtgccacgcaacctttacaatgcgccttctgagtcctgtcagggtgccaaattataacatgatcatcatggatgaggcccatttcaccgacccctccagcattgccgctcgtgggtacatctctactcgggtgggaatgggcgaagcggcagccatatttatgacagctacccctccgggttcagtcgaggccttcccccaatccaatgcagtaattcaggatgaagagagagacatcccagaaaggagttggaacagcgggtatgagtggattacggattttcctggaaagactgtgtggttcgttccctcgatcaaatctggcaatgacatagccaactgtctccgcaagaatggcaaacgagtgattcagttgtccagaaagacattcgataccgagtaccagaaaaccaagaacaacgactgggactacgtcgtgactacagatatcagcgaaatgggggctaattttcgggcggacagggttatcgatccacgccgttgcctgaagcctgtgattctcaaagacggacccgagagagtcatcctggccggtccaatgccggtgaccgtagcatcagctgcccaacggaggggccgcattgggcgaaaccacaataaggaaggagatcagtatatatacatgggccagcctcttaacaatgacgaggatcatgcacactggacagaggccaaaatgctactggacaacatcaatactcccgaaggtattatcccagctttgttcgagcccgaaagagagaagagtgccgcgatcgatggggaatatcggttaaggggcgaggcacgcaaaacgtttgtggagctgatgagaaggggagacctccctgtttggctgtcttacaaggtcgcctccgaaggcttccagtatagcgatcggcgttggtgctttgacggggagcgcaacaatcaagtgcttgaagagaacatggatgtggaaatttggaccaaagagggagagcgaaagaagctgagaccaaggtggctcgacgctcggacatactcagaccccttggccctgcgcgaattcaaagagtttgctgcaggtagaaggagtgtcagcggcgatctaatactggaaatcgggaagctccctcagcaccttactcagcgggcccagaatgctctggacaacttagttatgttgcataattccgagcaaggaggccgagcctatagacacgcaatggaagagctgccggataccattgagacaatgatgctcctggcgcttatcgccgtgctgaccggtggggtaactctcttctttttgtctggccgcggactgggcaaaacgagcattgggttactatgtgtgatggcttcctcagtcctgctctggatggcctctgtggaaccacattggatcgcagctagtataatccttgagttctttctgatggttttgctgattcccgaacctgacaggcagcggaccccccaggataaccagctcgcctacgtggtcatcggactgcttttcatgattctcacagtagcagccaatgagatgggtctgttggagactaccaagaaagacctgggcatcgggcacgtggctgttgaaaaccaccatcacgcggccatgttagatgtggacctacatccagcatcggcttggacactgtacgccgtcgccaccactataattacacctatgatgcgtcacacgatcgagaacaccactgcaaatattagcctcacagctatcgccaaccaagcggctatacttatgggactggataagggctggcccatctccaagatggacattggtgtgccattgctggccctcgggtgctattctcaggtcaatcctctgacccttaccgcagccgtgttaatgctggttgctcattacgcaatcattggcccgggactccaggccaaagcgacaagagaagctcaaaagaggactgccgcaggcatcatgaaaaaccccacggtggatgggatagtagccattgacttggatccagtggtctatgacgctaagtttgagaaacagctgggacagatcatgctactgatcctctgtacctcacagattcttctgatgcgcacaacttgggccttgtgcgaaagcatcaccctggcaacaggccctctcaccactctgtgggagggttcccccgggaagttctggaatacgacaatagctgttagtatggccaacattttccggggatcttacttagcgggcgccggtcttgcatttagcctgatgaagtcactcggcgggggacgaagaggcaccggggctcaaggagagactctaggcgaaaaatggaagaggcagctgaatcagttgtccaaaagtgagttcaacacctataagcgcagcggtatcatggaagtggaccggtctgaggccaaagaagggctgaagagaggagagacaactaagcacgcagtctcccgtggcaccgctaaactcaggtggtttgtggagcggaatcttgtaaagccagaaggtaaagtgattgatctgggctgtgggcgcggaggctggtcatactattgcgccgggttgaagaaagttacagaggtgaagggatacacgaaaggcggtcctgggcacgaagagcccatcccgatggccacctacggatggaacctggtcaagctccatagcggcaaggacgtgttctttataccacctgaaaaatgtgatactttactgtgcgacatcggcgagtcgtctcccaatccaacaattgaggaagggcgaacccttagagtcctgaagatggtggagccctggctaaggggaaaccagttctgtatcaaaattctcaatccttatatgccgagtgttgtagaaactctggagcaaatgcagcggaagcacggtggcatgttggtgcgcaaccccctgtccagaaatagcacacatgagatgtactgggtctcatgcgggaccggaaacatcgtgtccgcggttaatatgacgtctaggatgctccttaaccgatttaccatggctcaccggaaaccaacatatgaacgtgatgtggacctgggcgcaggtactagacacgtcgccgtggagcctgaagtagctaacttagatattatcgggcagcgcatagagaatattaagcatgaacacaagagcacctggcattacgacgaggataacccctataaaacatgggcctaccacggaagttatgaggtgaagccttccggcagcgcatcttcaatggttaatggcgtcgtgaaactgttgactaagccatgggacgtgatccccatggtcacccagatcgccatgacagataccactcctttcgggcaacagagggtttttaaagaaaaggtggacacgcggacaccaaaggctaaaagaggaaccgcgcagattatggaggtaactgccaagtggctctggggtttcctgagtcgcaacaaaaagcccaggatatgtacccgagaagagtttacacggaaagtgagatccaatgcagctatcggcgccgtcttcgtggacgaaaaccaatggaatagcgcaaaggaggccgttgaggatgaaaggttttgggacctagtgcatcgcgagcgtgaacttcacaagcaggggaaatgcgctacgtgcgtctacaacatgatgggaaagcgggagaaaaagctgggcgaattcggtaaagccaaggggtctagagcgatttggtacatgtggctcggagcaaggttcctggagtttgaggccttgggcttcatgaatgaagatcactggttttcgcgcgagaactcactgagcggcgtggaaggggagggactccataaacttggttatatcctgcgagacatttccaagatcccgggcgggaatatgtacgctgatgacaccgccggatgggatactcggataacagaggacgatttacagaacgaagcaaagatcaccgacattatggagcctgaacacgctctgttggccaaaagtatcttcaagctcacttatcagaataaagtagttagagtgcaaaggccagctaagaacggcacagtcatggatgtgatttctcgcagagaccagcggggtagcgggcaggtgggaacctacggcctgaatacatttactaacatggaggcccagctaatcaggcaaatggaatccgagggcatattctcacccagtgagcttgaaacccctaacctggcacgtcgagtcctcgattggctggagaaacatggggttgaacgcttgaagagaatggcgatttctggagacgactgtgtggtaaagccaatcgatgaccggtttgccacggctttaaccgccctgaatgatatgggtaaagtgaggaaggacatcccccagtgggagccgagcaaaggctggaacgattggcagcaggtccctttctgctcccaccactttcatcaactcattatgaaggacgggcgcgaaatagtggttccctgtagaaatcaggatgagcttgtgggacgggcaagggtctcacagggcgctggttggagcctgcgagagacagcctgcctagggaaatcttatgcacagatgtggcaactgatgtacttccaccgtagagacctccgcttggccgcgaacgctatctgttccgccgtgccagtagattgggttcctactagtcggaccacatggagcattcatgcacaccatcagtggatgactaccgaagacatgctgtcggtgtggaatagggtctggatcgaggaaaacccctggatggaggataagacgcacatttcctcttggggagacgtgccatatcttggcaagagagaagaccagtggtgcggctcactgatcgggctcacagcccgcgctacctgggccactaatatacaagttgcaatcaaccaggtgcggaggttaattggaaatgagaactacctggattacatgacaagcatgaaacgatttaagaatgagagtgaccccgaaggtgctttgtggtga

SEQ ID NO: 13949 - RNA, 9879 nt, synthetic construct
  misc_feature 1..9879: note = derived and/or modified CDS sequence (opt3) from DENV-1__GU131781__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagataagcctgtcaacatagaggccgaaccacccttcggcgagtcctatattgtgatcggtgctggggagaaagccttgaagctgtcatggtttaagaaaggcagtagcatcggaaagatgttcgaagcaaccgccagaggcgctaggcggatggccattctcggggacactgcatgggattttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgactcaggatgcgtcgttaactggaaaggccgcgagctgaagtgtggtagtgggatctttgtgacaaatgaagtgcacacttggaccgagcaatataagttccaggcagacagcccgaaaagactttccgccgctatcggaaaggcctgggaagagggcgtatgcggtattaggtctgcaacgcggttggagaacataatgtggaaacagatctcgaacgaactgaatcatattctcctggagaacgatatgaagtttacagtcgtggttggcgacgtggctgggatcttagcccagggaaaaaagatgattcgccctcaacccatggaatacaaatatagctggaagtcctggggcaaggcgaaaatcataggggccgatgtccagaataccactttcatcattgacggaccaaacacccctgagtgtcccgatgaccagagagcttggaatatctgggaagtggaggattacggctttggtattttcacaactaacatctggctgaagcttagggactcatatacccaggtttgcgatcaccgtttgatgagtgcagccataaaagactctaaggctgtgcacgccgatatggggtactggattgagagcgaaaaaaatgagacatggaagctcgcacgggcgtccttcatcgaagtaaagacgtgtatttggccaaaatcacataccctgtggagcaacggagtcctagagtctgaaatgatcatacccaagatctatggcggtcctatttcccaacacaattaccgaccaggctactttactcagacagccgggccgtggcatctgggaaaactcgagctggacttcgatctttgcgagggcaccactgtggtggtcgacgaacactgcgggaacagaggacccagtttgaggacaaccacggttactggcaagatcattcacgagtggtgttgccgcagctgtaccctgcctccattacggtttaaaggtgaagacgggtgctggtatggaatggagatcagacccgtgaaggagaaggaagagaatctcgtaaaatctatggtgtccgctggctcaggtgaagtcgatagtttcagcctgggccttctgtgtatatcgattatgatcgaggaagtgatgaggtcccgctggtctcgaaagatgttgatgacagggaccctcgccgtttttttcctgctaatcatgggacagctgacttggaacgacctcattcggctgtgcatcatggtgggcgcaaatgctagcgatcgtatggggatgggaacaacctaccttgccttgatggcaacatttaaaatgagacctatgttcgccgtcggcctgttatttaggcgcctcacttcacgggaggtgctgcttctgaccattggtctaagtctcgttgcttccgtggagctgccaaactctttggaagagctgggggacggattagcgatgggcataatgatcctcaagctgcttacggatttccaaagccatcagctgtgggccacattgctctccctgacctttattaaaactaccttctcactacactatgcatggaagacaatggctatggtcctgagcatcgtaagtctttttcccctctgtatgtctactacctcccagaagacgacatggctgccggtgttgctgggcagcttagggtgcaaacctctcaccatgttcctgattgccgaaaataagatctggggaagaaaatcgtggccacttaacgagggtataatggccgttggcatcgtgtcaattctgttgtctagtctcctgaagaacgacgtccccctagctgggcctctgatcgcaggaggcatgcttattgcctgttacgtgatctccggtagctctgcggatctcagcctggaaaaagctgccgaggtatcctgggaggaagaggcagaacattcaggggccagtcacaatatattggtggaggtccaggacgatggaactatgaagattaaagacgaagagagggatgacacattaaccatcctgctcaaggctactctgcttgcagttagcggcgtgtatcccctgtctatcccagccacattgttcgtgtggtacttttggcaaaagaaaaagcagcgatccggcgtcctatgggataccccttcacccccagaggtggaacgcgcggttctggacgacgggatttatcggataatgcagagaggactcctgggtaggagtcaggtaggcgtgggggtcttccaagagaacgtgtttcatacgatgtggcacgttactcgtggagctgtgcttatgtaccagggcaaacgcttagaaccgagctgggcctccgtcaagaaagatctgatctcttacggtgggggatggcggctccagggctcgtggaataccggcgaggaggtgcaggtaattgcagtcgaacctgggaagaaccccaagaatgtgcaaacagccccaggaaccttcaaaacaagcgagggtgaagttggcgctatcgccttggactttaagcccgggacttcaggatcccctattgtgaacagagagggcaaaatcgtcggtctgtatgggaatggagtggttaccacgagtggcacatacgtgtctgcaatagctcaggccaaggcgagccaggaaggcccactccccgagatcgaggatgaagtcttcaggaaacgaaacctgactattatggaccttcaccctgggtccggaaagacccggcgctatctgccggccatcgtgagagaggcaattaagaggaaattgcggacactaatcctggctccaacccgagtagtggcctcagaaatggctgaggcactcaagggtatgcccataagataccaaactaccgccgttaaatctgaacatacaggcaaggagattgtcgatttaatgtgccacgccacgtttactatgcgcctgcttagccctgtgagggtgccaaattataacatgatcatcatggacgaggctcatttcaccgatcccagttccattgcggcacgtgggtacatcagcacacgggtcggaatgggcgaagccgctgccatatttatgaccgcaactcctccgggttctgtagaggccttcccccagtcaaatgctgtgattcaggacgaagagagagatatcccagaaaggtcctggaacagtgggtatgagtggattacagactttcctggaaaaaccgtttggttcgtgcccagcatcaagtcgggcaatgatatagcgaactgtctgcgcaagaatggcaaacgagtcattcagctctctagaaagacgttcgacactgagtaccaaaaaacaaagaacaacgactgggattacgtggttaccaccgacatctccgaaatgggggccaattttcgggcagatagggtgatcgacccacgccgttgcttgaaacctgtcattctgaaggatggacccgagagagtgatcctcgctggtccaatgccggtaactgtggccagcgcagcccagcggaggggccgcattgggcgaaaccacaataaggaaggagaccagtatgtttacatgggccagcctctgaacaatgatgaggaccatgctcactggacagaggccaaaatgcttctagataacataaatacccccgaaggtatcattccagcgctgttcgagcccgaaagagagaagtcagcagccatcgacggggaatatcggttgaggggcgaggctcgcaaaacatttgtcgagttaatgagaaggggagatctgcctgtgtggctcagttacaaggtggcctctgaaggcttccaatattccgaccggcgttggtgctttgatggggagcgcaacaatcaggtcctggaagagaacatggacgttgaaatctggactaaagagggagagcgaaagaaacttagaccaaggtggctggacgctcggacgtacagcgatcccctcgcattgcgcgaattcaaggagtttgccgctggtagaaggtcagtgagtggcgacctgattctagaaatagggaagctgcctcagcacctcacccagcgggcccaaaatgcacttgataacctggtaatgttacataatagcgagcagggaggccgagcgtatagacacgccatggaagagttgccggacacaatcgagactctgatgctcctggctcttattgccgtgctgaccggtggggtcacactcttctttttgtccggccgcggactgggcaaaacctctatcgggttactatgtgtgatggcaagctccgttctgctctggatggcttcagtggaaccacattggattgccgcatctatcatacttgagttctttctgatggtcttgctgatccccgaacctgataggcagcggactccccaggacaaccaactcgcctacgtagtgattggactgcttttcatgatcctcacggttgctgcgaatgagatgggtctgttggagaccacaaagaaagatctgggcattgggcacgtggccgtcgaaaaccaccatcacgcagctatgttagacgtggatctacatccagccagtgcctggactctgtacgcagtcgctaccacaatcataacccctatgatgcgtcacactattgagaacacaacggccaatatctcgctcaccgcgattgctaaccaggccgcaatccttatgggactggacaagggctggcccataagcaaaatggatatcggtgtgccattgctggccctcgggtgctattcccaggttaatcctctgactcttacagctgcagtgttaatgctggtagcccattacgcgattatcggcccgggactccaagctaaggccaccagagaagcacagaagaggaccgccgctggcattatgaaaaaccccacagtggacgggatcgtcgccatagatttggacccagttgtgtatgacgcaaagtttgagaaacagctgggacagattatgctactgatcctctgtacttctcaaatccttctgatgcgcacgacctgggctttgtgcgaatcaattacactggccactggccctctcaccacactgtgggagggtagccccgggaagttctggaataccactatcgcggtctccatggccaacatattccggggaagttacttagcaggcgctggtcttgccttttctctgatgaaaagcctcggcgggggacgaagaggcacgggggcacagggagagacactaggcgaaaagtggaagaggcagctgaatcagttgtcaaaatccgagttcaacacctataagcgcagtggtattatggaagtggatcggagcgaggctaaagaagggctgaagagaggagagactaccaaacacgccgtatctcgtggcacagccaagctcaggtggtttgtggagcggaatcttgttaagccagaaggtaaagtgatcgacctgggctgtgggcgcggaggctggtcctactattgcgcggggttgaagaaagtcactgaggtgaagggatacaccaaaggcggtcctgggcacgaagagcccattccgatggctacatacggatggaacctggtcaagctccattcaggcaaagatgtgttctttatcccacctgaaaagtgtgacacgttactgtgcgatataggcgagagctcgcccaatccaaccatcgaggaagggcgaactcttagagttctgaagatggtagagccctggctaaggggaaaccaattctgtattaaaatcctcaatccttatatgccgtctgtggtcgaaacactggagcagatgcagcggaagcacggtggcatgttggtgcgcaaccccctgagtagaaattccacccatgagatgtactgggttagctgcgggactggaaacattgtgtcagcagtcaatatgacatccaggatgctccttaaccgatttaccatggcccaccggaaaccaacgtatgaacgtgacgtggatctgggcgctggtaccagacacgtagccgtggagcctgaagttgcaaacttagacatcattgggcagcgcatcgagaatataaagcatgaacacaaatctacatggcattacgatgaggacaacccctataagacttgggcctaccacggaagctatgaggtcaagcctagtggctccgctagctctatggtgaatggcgtggtcaaactgttgaccaagccatgggatgttattcccatggtgacacaaatcgcgatgactgacaccacacctttcgggcagcagagggtatttaaagaaaaggtggacacccggactccaaaagccaagagaggaacggcacaaatcatggaggtcacagctaagtggctctggggtttcctgtcacgcaacaaaaagcccaggatttgtacccgagaagagtttactcggaaagtgagaagtaatgccgcaataggcgccgttttcgtggatgaaaaccagtggaattccgctaaggaggccgtcgaggacgaaaggttttgggatctagtgcatcgcgagcgtgaacttcacaaacaggggaagtgcgcgacctgcgtatacaacatgatgggaaagcgggagaaaaagctgggcgaattcggtaaagcaaaggggagcagagccatctggtacatgtggctcggagctaggttcctggagtttgaggccttgggcttcatgaatgaagaccactggttttctcgcgagaactcgctgtcaggcgttgaaggggagggactccataaacttggttatattctgcgagatatcagcaagattccgggcgggaatatgtacgcagacgatacagctggatgggacacgcggatcaccgaggatgacttacagaacgaagccaaaataactgatatcatggagcctgaacacgctctgttggccagatccattttcaagctcacatatcaaaataaggtggtcagggtgcagcgcccagcaaaaaacggcaccgtgatggacgtcatcagtagacgggatcagaggggttctgggcaggttggaacttacggcctgaatacatttaccaacatggaggcgcaactaattcgtcagatggaaagcgagggcatcttctccccctcagagcttgaaacacctaacctggccgggcgagtgctcgactggctggagaagcatggagtagaacgcttgaaaagaatggctataagtggtgacgattgtgtggtcaagccaattgacgatcggtttgccactgcattaaccgctctgaatgacatgggcaaagtgaggaaggatatcccccagtgggagccgtctaaggggtggaacgactggcagcaagttcctttctgcagccaccactttcatcagctcatcatgaaagatggacgcgaaattgtggtcccctgtagaaatcaggacgagcttgtgggccgggccagggtatcccagggtgcagggtggtcactgcgagagacggcctgcctaggaaagagctatgcgcaaatgtggcagctgatgtacttccaccgtagagatctccgcttggctgccaacgcaatatgttctgccgttccagtggactgggtccctacctcccggacaacttggagtatccatgctcaccatcagtggatgaccacagaagatatgctgagcgtgtggaatagggtttggattgaggaaaacccctggatggaggacaaaactcacatctcgtcctggggcgacgtgccatatcttggcaagagagaagatcaatggtgcgggtctctgattggactcaccgcccgcgcaacgtgggctacaaatatccaggtcgccataaaccaggtgcggaggttaatcggtaatgagaactacctggactacatgacctcaatgaaacgatttaagaatgagagcgatcccgaaggcgcgttgtggtga

SEQ ID NO: 13950 - RNA, 9879 nt, synthetic construct
  misc_feature 1..9879: note = derived and/or modified CDS sequence (opt3) from DENV-1__GU131782__SS-prME
  source 1..9879: mol_type = other RNA
agcgtgaccatgctgctcatgcttatgcccacagcactggctttccacttgactacgagaggaggggaacctcatatgatcgtcaccaagcaggaaaggggaaaatccttactgtttaagacatctgccggtgttaacatgtgcactctaattgcaatggacctcggagaactgtgtgaagataccatgacatacaaatgcccacggataaccgaagcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggcagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggccagcttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggccttggtgaggtggactccttttcactgggcttgctctgtattagtatcatgatcgaagaggtcatgaggagccgctggtcgcgaaagatgctgatggctgggaccctagccgtgttcctgctcctgattatgggacagcttacttggaacgatttgatccggctgtgcattatggttggcgcaaatgcttccgaccgtatggggatgggaacaacctatttagccctcatggcaacatttaaaatgagacctatgttcgccgtgggcctgctttttaggcgcctgacttctcgggaggtcctactcctgaccataggtttgagcctggtggcttcagttgaattaccaaacagtctcgaggaactgggggatggacttgcgatgggcatcatgattctgaagttgctcacggacttccaaccccaccagctgtgggccacactactgtcccttacctttatcaaaactaccctctctctgcattacgcatggaagacaatggctatggtgttgagcattgtctccctgttcccgttatgtctctcaactaccagccagaagacgacatggctgcctgtacttctgggcagtttggggtgcaaaccactcaccatgtttctgatcgccgagaataagatatggggaagaaaatcttggcccctaaacgaaggtatcatggccgtgggcgttgtgtccattctgcttagctcgctcctgaagaacgatgtccctttggctgggcccttaatcgcaggaggcatgctgattgcctgttatgtgatctcaggttctagtgcggacctctccctggagaaagctgccgaggtaagctgggaagaggaagcagagcactctggggccagccataatatacttgtggaagtccaggatgacggaactatgaagattaaagatgaggagagggacgatacactgaccatcttgctaaaggctactctgctcgcaatctccggcgtttacccactgtcaattcctgccacacttttcgtgtggtatttttggcaaaagaaaaagcagcgaagtggcgtgttatgggacacccccagcccaccggaagtcgagcgcgcggtgctggatgacgggatataccggatcatgcagagaggactcttgggtaggtctcaggttggcgtaggggtgttccaagaaaacgtcttccacacgatgtggcacgtgactcgtggagctgttctgatgtatcagggcaaacgcctcgagccttcctgggcctcagtgaagaaagacctgattagttacggtgggggatggcggcttcagggcagctggaataccggcgaggaagtccaggtgatcgcagtagagcccgggaagaacccaaagaatgtccaaacagcccccggaacctttaaaacacctgaaggtgaggtgggcgctattgccctggatttcaagccagggacttccggatctcccatcgttaacagagaaggcaaaatagtgggtttgtacgggaatggagtcgtgaccacgtcgggcacatatgttagcgcaatcgctcaggccaaggcgtcacaggagggccctctaccggagattgaagacgaggtgtttaggaaacgaaacctgactatcatggatctccatccagggtccggaaagacccggcgctacttacccgccattgtcagagaagcaatcaagaggaaactgcggacacttatactggctcctacccgagtggtagccagtgagatggctgaagcactcaagggtatgccaattagatatcaaactaccgccgtgaaatctgagcacacaggcaaggagatcgttgacttgatgtgccatgccacgttcactatgcgcctgctcagccccgtcagggtgcctaattacaacatgatcattatggatgaagctcactttaccgacccgtcctcaatcgcggcacgtgggtatatatctacacgggtgggaatgggcgaggccgctgccattttcatgaccgcaactcccccaggtagcgtcgaagcctttcctcagagtaatgctgtaatccaggatgaggaaagagacattcccgagaggtcctggaacagcgggtacgagtggatcacagatttcccaggaaaaaccgtgtggtttgttccttctataaagtcaggcaatgacattgcgaactgtctgcgcaagaatggcaaacgagtgatccagctttccagaaagacgttcgatactgaatatcagaaaaccaagaacaacgactgggactacgtcgtgaccaccgatatcagtgagatgggggccaattttcgggcagacagggttattgatccccgccgttgcctaaaaccagtgatcctgaaggacggaccggaaagagtcattttggctggtcctatgcccgtgactgtagccagcgcagcccagcggaggggccgcatagggcgaaaccataataaggagggagatcagtacatctatatgggccagccattaaacaatgacgaggatcacgctcactggacagaagccaaaatgctgctcgacaacattaatacccccgagggtatcatccctgcgctgttcgaaccagagagagaaaagtcggcagccattgatggggagtaccggcttaggggcgaggctcgcaaaacattcgtggaactgatgagaaggggagacctccccgtttggttgtcttataaggtcgcctccgagggctttcaatacagcgatcggcgttggtgcttcgacggggaacgcaacaatcaggtgctggaggaaaacatggatgtggagatatggactaaagagggagaacgaaagaaactaagacctaggtggctggacgctcggacgtattcagacccgctcgcacttcgcgagtttaaggagttcgccgctggtagaaggagtgtctctggcgatctgatcttagagattgggaagttgccacagcatctgacccagcgggcccaaaatgcactcgacaacctggttatgcttcacaattccgaacagggaggccgagcgtacagacatgccatggaggagctgcccgatacaatcgaaactctcatgttgctggctttaattgccgtgctaaccggtggggtaacactgtttttcctcagcggccgcggacttggcaaaacctcaatcgggctgttgtgtgtgatggcaagtagcgtcctgctctggatggcttccgtggagcctcactggatagccgcatctatcattctggaatttttccttatggttctcctgatccccgagccagacaggcagcggactcctcaggataaccaattggcctatgtggtcattggactgttatttatgatcctaacggtagctgcgaatgagatgggtctgctcgaaaccacaaagaaagaccttggcatagggcacgtggccgttgagaaccatcaccatgcaactatgctggatgtggacttgcaccccgctagcgcctggaccctgtacgccgtcgcaacaaccattatcactccaatgatgcgtcatacaattgaaaacacgaccgctaatatctccctcactgccatagcgaaccaggctgccatcctgatgggacttgataagggctggcctatttcaaaaatggacatcggtgtgccgttactggcactcgggtgctactctcaggtcaatcccttgacactgaccgccgctgtgctaatgctggttgcacactatgccattatcggcccaggactccaagcgaaggctaccagagaggcccagaagaggacagcagccggcataatgaaaaaccctactgtggatgggattgtagctatcgaccttgatcccgtggtctacgacgccaagttcgaaaaacagctgggacagatcatgttgctgattctctgtacgagtcaaatcctgttaatgcgcaccacatgggcactttgcgagtcgataactctggctaccggcccactcacaaccctatgggagggtagccctgggaagttttggaatactacgattgccgtttccatggcgaacatcttccggggatcttatctggccggcgcaggtttggctttttcactgatgaaaagcctcggcgggggacgaagaggcacaggggcccagggagaaacccttggcgagaagtggaagaggcagctgaatcagttgtccaaaagtgagttcaacatttacaagcgctctggtatcatggaggtggaccggagcgaagcaaaagaggggctgaagagaggagagactacccgtcacgctgtctcaaggggcacagccaaactccggtggttcgtggaacgcaatttagtaaagcccgagggtaaggtgatagatctgggctgtgggcgaggaggctggtcctattactgcgccgggcttaaaaaggttactgaagtgaaaggatataccaagggcggtccggggcatgaggaaccaatccctatggcgacatacggatggaacctggtcaaactacacagtggcaaggacgtgtttttcacgcccccagagagatgtgataccctcctgtgcgacattggcgagagctctcccaatcctactatcgaagaggggaggacattgcgggtcctgaaaatggtggaaccgtggctccgcggaaaccaattttgtattaagatccttaatccctacatgccatccgttgtagagaccctggagcagatgcagagaaagcatggtggcatgttagtgaggaaccctctgtcacgaaatagcactcacgaaatgtattgggtctcgtgcgggacaggaaacattgtgtctgctgttaatatgaccagtcggatgttgctcaaccgtttcacgatggcacacagaaaacccacctacgagcgcgatgtggacctgggcgccggtacaaggcatgtcgctgtggaacctgaggtagccaacctagatatcatagggcagcggattgaaaatatcaagcacgagcataaatccacttggcactatgacgaggataacccatacaagacctgggcatatcatggaagctacgaagtgaaaccctcaggctccgcctctagcatggttaatggcgtcgtgaaacttctgacaaagccttgggacgtgatcccaatggtcactcaaattgctatgaccgatacaaccccctttgggcagcagagagttttcaaagagaaggtggacactcgcacgccgaaagcgaagaggggaacagcccaaataatggaagtaaccgcacgatggctctggggttttctgagtcggaacaaaaagcctagaatctgtactagggaggagttcacccgcaaggtgcgttccaatgctgccattggcgcagtctttgtggacgagaaccagtggaatagcgccaaagaggctgttgaagatgagcggttctgggacttggtgcagaaggaaagagagctgcacaaacaggggaagtgcgccacatgcgtctataacatgatgggaaaaagggaaaagaagctcggcgagtttggtaaagcgaaggggtctcgcgcaatctggtacatgtggcttggagcccgattcctggagtttgaggctttaggcttcatgaatgaggatcactggttctcacgggaaaacagtctgtccggcgtggagggggagggattgcataaactcggttacattctgagagacatcagcaagataccaggcgggaatatgtatgccgatgacacggcaggatgggataccaggatcactgaagacgatctacaaaacgaggctaaaattacagacatcatggaacccgagcacgcccttctggctacctctatttttaagctcacttaccagaataaagtagttcgcgtgcagagacctgccaagaacggcacagtcatggatgtgatctcgcggagggaccagcgtggttcagggcaagtgggaacctatggcctgaatacattcactaacatggaagcacagttgatacgacagatggagagcgagggcatatttttaccatccgaactggagacccccaacctcgcggaacgcgtccttgattggctggagaagcatggggttgaaagactaaaacggatggccatcagtggagacgactgtgtggtaaagccgatcgatgacaggttcgctacggccctgaccgcactcaatgatatgggtaaagtgcgcaaggacattcctcagtgggagccctctaaaggctggaacgattggcaacaggtcccattttgcagccaccacttccatcagttgataatgaaggacgggagagagatcgtggttccttgtcggaatcaggatgaactggtgggaagggctcgagtctcccaaggcgccggttggtcacttcgtgagacagcatgcctggggaagagttacgcccagatgtggcagctcatgtattttcacagacgcgacttacggctggcggctaacgccatttgttctgcagtgcccgtagattgggttccaactagcaggaccacatggtccatccatgcccaccatcaatggatgactaccgaagacatgttgtcagtgtggaatagagtctggattgaggaaaacccctggatggaggataaaacgcacgtgagctcttggggagacgttccttacctgggcaagcgcgaggaccagtggtgcggctccctcatcgggcttacagctcgggccacctgggcaagtaatatacaggtggctatcaaccaggtcaggcgactgattggaaatgaaaactatctagattacatgactagcatgaaaagattcaagaatgagggtgacccagaaggcgccctgtggtga

SEQ ID NO: 13951 - RNA, 9879 nt, synthetic construct
  misc_feature 1..9879: note = derived and/or modified CDS sequence (opt3) from DENV-1__GU131784__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaagtctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcagacgggggagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacaccatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttatgtcatctccggtagctctgcggacctgagcttggagaaggctgccgaggtgtcctgggaagaggaagcagagcactcaggggccagtcataatatattagtagaagtgcaggatgacggaacaatgaaaattaaggatgaggagagggacgataccctgactatcctcctgaaggctacacttctggcagtcagcggcgtttaccccttgtctatcccagccaccctattcgtgtggtatttttggcagaaaaagaaacaacgatccggcgtgctgtgggacacgccttcacccccagaagtcgagcgcgcggtgctcgatgacgggatttaccggataatgcagagaggactgcttggtaggagtcaggttggcgtaggggtgttccaggaaaacgtctttcacactatgtggcacgtgacccgtggagctgttttaatgtatcaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctacgggaatggagtcgtgacgacaagtggcacttatgtttctgcaatagctcaagccaaagcgagccaggagggcccactgcccgagatcgaagacgaggtgttcaggaagcgaaaccttaccattatggatctgcatcctgggtccggaaagacacggcgctacttgccggccatcgtcagagaagcaattaaaaggaagctacggaccctgatcctcgctccaactcgagtggtagcctcagagatggctgaagcattaaaaggtatgcccataagatatcagaccacagccgtgaagtctgagcacacgggcaaagagattgttgacctgatgtgccatgccacttttaccatgcgccttctgagccctgtcagggtgccaaattacaacatgatcatcatggatgaagctcacttcacagaccccagttccattgcggcacgtgggtatatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtacgagtggattaccgattttcctggaaagacggtgtggttcgttcccagcatcaagtcgggcaatgacatagcgaactgtctccgcaaaaatggcaagcgagtgattcagttgtctagaaaaactttcgatacagaatatcagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccataataaagagggagatcagtacatatatatgggccagcctcttaacaatgacgaggatcacgctcactggaccgaagccaagatgctactggacaacatcaatacacccgagggtattatcccagcgttgttcgaacccgagagagaaaaatcagcagccatcgatggggagtaccggttaaggggcgaggctcgcaagacttttgtggaactgatgagaaggggagacctccctgtttggctgagttataaagtcgcctctgagggcttccagtactccgatcggcgttggtgctttgacggggaacgcaacaatcaagtgcttgaggaaaacatggatgtggagatttggacgaaggagggagaacgaaagaaactgagaccaaggtggctcgacgctcggacctatagcgaccccttggcactgcgcgagttcaaagaatttgccgctggtagaaggtcagtcagtggcgatctaatactggagatcgggaaactccctcagcatcttacacagcgggcccagaatgcactggacaacttagttatgttgcacaatagcgaacaaggaggccgagcgtacagacatgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacactggatcgccgcatctataatcctggagttctttttgatggttctgctcattcccgagcctgacaggcagcggacgccccaggataaccagctggcctatgtggtcatcggacttctcttcatgattctgaccgtagctgcgaatgagatgggtttgctggaaacaactaaaaaggacttaggcatcgggcacgccgcagtggagaaccatcaccatgctgccatgctagatgttgacctgcacccagccagtgcatggaccctctacgctgtggccacaaccataattactcctatgatgcgtcatacaatcgaaaacacgaccgcgaatatttcgcttactgctatcgccaaccaagcagccatactgatgggattggataaaggctggcccatcagcaagatggacattggtgtcccactgctcgctctggggtgctactcccaggtgaatcctcttacattaaccgcagccgtcctgatgctcgtggcgcactatgctatcattggcccgggattgcaggccaaggcaaccagagaggcccagaagaggacagctgccggcatcatgaagaaccccactgttgatgggatagtggcaattgacctggatccagtagtgtacgacgctaaatttgaaaagcagctaggacagatcatgctgctcatcctttgtacgtctcagattctgttgatgcgcaccacatgggccctgtgcgagtcaatcactctcgcgaccggccctctgacaaccttatgggagggtagccccgggaaattctggaatactacgatagccgtctccatggcaaacattttccggggaagttatcttgctggcgccggtctggcattttctctcatgaaaagcctaggcgggggacgaagaggcacaggggctcaaggagaaaccctgggcgagaagtggaaaaggcagttgaatcagctgtcaaagtccgagttcaacacttacaaacgcagtggtatcatggaggttgaccggagcgaagccaaggaggggctcaaaagaggagagaccacaaagcacgccgtgtctcgtggcactgcgaaacttaggtggtttgtcgaacggaatctggtgaaaccagagggtaaggtaattgatttgggctgtgggcgcggaggctggtcctattactgcgctgggctgaaaaaggtgaccgaagttaaaggatatacaaagggcggtcctgggcatgaggaacccatcccgatggcaacgtacggatggaacctcgtgaaattacactcaggcaaggacgtcttctttataccacctgagaagtgtgataccctgctttgcgacatcggcgagagctcgcccaatccaactattgaagaggggcgaacactgagagtgctaaaaatggtcgaaccctggctcaggggaaaccagttctgtatcaagattctgaatccttacatgccgtctgtggttgagaccttggagcaaatgcagcggaaacatggtggcatgctggtacgcaaccccctcagtagaaattccactcacgaaatgtattgggtgagctgcgggacaggaaacatcgtctcagccgtgaatatgacctccaggatgcttctgaaccgatttacgatggctcaccggaagccaacctacgagcgtgatgttgacttaggcgccggtacaagacatgtggcagtcgaacctgaggtggccaacctggatattatcgggcagcgcatagaaaatattaaacacgagcataagtctacttggcactatgacgaggataacccctacaagacctgggcttatcatggaagctacgaagtaaaacctagtggctccgcgagctctatggtgaatggcgttgtcaagttgctcacaaaaccatgggacgtgatccccatggtgactcagatcgccatgaccgatacaacccctttcgggcaacagagggtctttaaggagaaagttgacactcggacgccaaaggcaaagagaggaacagctcagattatggaagtgaccgccaaatggctgtggggtttcctatcacgcaacaagaaacccaggatatgtactcgagaggaatttacccggaaggtaagaagtaatgcagccatcggcgctgtgttcgtcgacgagaaccaatggaactccgccaaagaggcggtggaagatgagaggttttgggaccttgttcaccgcgaacgtgagctgcacaagcaggggaagtgcgcaacatgcgtgtataacatgatgggaaaacgggaaaagaaactcggcgagttcggtaaggccaaagggagcagagctatttggtacatgtggctgggagccaggttcttggagtttgaagcactgggcttcatgaatgaggatcattggttttctcgcgaaaactcgctctcaggcgtcgagggggagggacttcacaagctgggttacatcttacgagacattagcaaaatcccgggcgggaatatgtatgctgatgacacggccggatgggatacccggataactgaagacgatctgcagaacgaggctaagatcacagacattatggaacctgagcatgccttgctcgcaaagtccatcttcaaactgacctaccagaataaggtggtaagagttcaaaggccagcgaaaaacggcactgtgatggatgtcattagtcgcagagaccagcggggttctggacaggtgggaacatatggcctaaatacctttacaaacatggaagcccagcttatcaggcaaatggagagcgagggcatattctccccctcagaactggagactcctaacctcgctcgtcgagtgctggattggttggaaaagcacggggtcgagcgcttaaaaagaatggccattagtggagacgactgtgttgtgaagccaatcgatgaccggtttgcaaccgctctgacggccctcaatgatatgggtaaggtaaggaaagacatcccccagtgggaaccgtctaagggctggaacgattggcaacaggtgcctttctgcagccaccattttcaccaacttattatgaaagacgggcgcgagatagtcgtgccctgtagaaatcaggatgagctggttggacgggcaagggtgtcccagggcgccggttggtcactacgagaaaccgcgtgcctgggaaagagctacgctcagatgtggcaactcatgtatttccatcgtagagacttgcgcctggccgcaaacgccatctgttctgctgtcccagtggattgggtacctacatcccggactacctggagtattcacgcccatcaccagtggatgacaactgaggacatgcttagcgtttggaatagggtgtggatcgaagagaacccctggatggaagataaaacccacatttcgtcctggggagacgtcccatacctgggcaagagagaggaccagtggtgcggctctctcatcgggttaacggcacgcgctacatgggccaccaatatacaagtggcgatcaaccaggttcggaggctgattggaaatgagaactatttggattacatgacttcaatgaagcgatttaaaaatgaaagcgaccccgagggtgctctgtggtga

SEQ ID NO: 13952 - RNA, 9879 nt, synthetic construct
  misc_feature 1..9879: note = derived and/or modified CDS sequence (opt3) from DENV-1__JF937612__SS-prME
  source 1..9879: mol_type = other RNA
agcgtgaccatgctgctcatgcttatgcccacagccctggctttccacttgactacgagaggaggggaacctcatatgatcgtctccaagcaggaaaggggaaaatctttactgtttaagacctcagccggtgttaatatgtgcacactaattgccatggacctcggagaactgtgtgaagatactatgacctacaaatgcccacggattacagaaaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaatgccacctttattatcgatggaccaaacacacctgaatgtcccgacgatcagagagcttggaatatttgggaggtcgaggactacggcttcggtatctttactaccaacatatggcttaagttgagggattcctatacacaggtgtgcgaccaccgtctcatgtcagcagccattcgggatagtaaagctgttcacgccgacatggggtactggatcgaatctgagaagaatgaaacgtggaaactggcacgagcgagcttcattgaggtgaagacctgtatctggccaaagtcccatactctatggtcaaacggagtactggaaagcgagatgataatccccaaaatttatggcggtcctatctctcaacacaattacagaccaggctacttcacacaggccgctgggccgtggcatctcggaaagctggagcttgattttgacttgtgcgaaggcaccactgtcgtggtggatgagcactgcgggaacaggggaccctccctgcgcacaaccacggtcactggcaaaattatccacgaatggtgttgccggagttgtaccttacctccactcagattcaggggtgaggacgggtgctggtatggaatggagatacgccccgttaaggaaaaagaggaaaatctggtgaagtccatggtatctgccggctccggtgaggtggactcatttagtcttggcctgttgtgtattagcatcatgatcgaagaggtcatgcgatcgcggtggtcccgtagaatgctcatgacagggaccctggcagtgttctttctactgattatgggacagctcacttggaacgatctgatcaggctttgcattatggttggcgctaatgcctctgaccgcatggggatgggaacaacctacttggcactgatggccacattcaagatgcggcctatgtttgctgtgggcttactcttcagaaggctgactagccgagaggtccttctgctaaccataggtctctcactggtggcgagtgttgaattgccaaactccctggaggaattaggggatggactcgccatgggcatcatgattctgaaacttctgacggactttcaatctcatcagttgtgggcaacactcctgagcctaaccttcatcaagactaccttttccctgcactatgcttggaaaacaatggccatggtgctttcaattgtcagcctcttccccctgtgtttgagtactacctctcagaagacgacatggctgccggtattactcggctccctggggtgcaaacctcttaccatgtttctgatcgccgagaataagatatggggacgccggagctggccattgaacgaaggtatcatggctgtgggcattgtttcgatcctcctgtcatctctactgaagaacgatgtgccccttgcagggcctctcattgccggaggcatgctgatcgcgtgttacgtcataagtggttccagcgctgacttgtctttagagaaagccgcagaggtgagctgggaagaggaagccgagcattccggggcttcacacaatattctggtagaagtgcaggatgacggaactatgaagatcaaagatgaggagagagacgatacactcaccatcctgcttaaggcaactctgttggccgtcagtggcgtttatcccctaagcattccagcgacactgttcgtgtggtacttctggcagaaaaagaaacagaggtctggcgtgctctgggacaccccttcacccccagaagtcgagcgtgctgtgctggatgacgggatatatcgcatcatgcagcggggacttttaggtagaagccaggttggcgtaggggtgtttcaagaaaacgtcttccatacgatgtggcacgtgactaggggagccgttctgatgtaccagggcaagcgactcgagccgagttgggcaagcgtgaagaaagacttgatttcctacggtgggggatggcggctgcagggctcttggaataccggcgaggaagtccaggtgatcgccgtagagcctgggaagaaccccaaaaatgtccaaacagctccaggaacctttaagacacccgaaggtgaggtgggcgccattgcactcgatttcaaacctgggacttcgggaagcccaatcgttaaccgcgaaggcaagatagtgggtctgtatgggaatggagtcgtgaccacgtcaggcacatacgtttccgctatcgcccaggcgaaggccagtcaggagggcccccttcctgagattgaagacgaggtgtttagaaaaaggaacctgactatcatggatttgcacccggggtctggaaagacccggcgatatctaccagcaattgtcagagaagctatcaaacgcaagctgaggacactcatattagcccccacccgtgtggtagctagcgagatggcagaagccctgaaaggtatgcctattcggtaccaaactaccgccgtgaagtccgagcatacaggcaaggagatcgttgaccttatgtgccacgctacgttcactatgagactgctctcaccagtcagggtgcccaattataacatgatcattatggatgaagcgcattttaccgacccttctagcatcgcagcccgcgggtacataagtacacgagtgggaatgggcgaggctgccgcaattttcatgaccgccactccgcccggttccgtcgaggcttttccacagagcaatgcggtaatccaggatgaggaaagagacattcctgagcggtcttggaactcagggtatgagtggatcacagatttccccggaaaaaccgtgtggtttgttccatccataaagagtggcaatgacattgccaactgtttgaggaaaaatggcaagcgcgtgatccagctgagccgtaaaacgttcgatactgaataccaaaagacaaagaacaacgactgggactacgtcgtgaccaccgatatctcggagatgggggcaaatttcagagctgaccgggttattgatcctaggcgctgcctcaaacccgtgatcctgaaggacggaccagaacgagtcattcttgccggtccgatgcctgtgactgtagcatctgccgctcagagacggggcaggatagggcgcaaccacaataaagagggagatcagtatatctacatgggccagcccctaaacaatgacgaggatcatgcccactggacagaagcgaagatgctgttggacaacattaataccccagagggtatcatccccgcattatttgaacctgagagagaaaaatccgccgctattgatggggagtataggctgcggggcgaggcccgtaagacattcgtggaactcatgcgccgaggagacctgccagtttggcttagctacaaggtcgcttcagagggctttcaatatagtgatagaaggtggtgcttcgacggggaacggaacaatcaggtgctggaggaaaacatggatgtggagatatggactaaagagggagaacgcaagaaactcagacccaggtggttggacgcacggacgtactctgaccctctggccctacgagagtttaaggagttcgctgccggtagacgctccgtcagcggcgatctgatcctcgagattgggaaacttccgcagcacctgacccagagggcacaaaatgcgttagacaacttggttatgctgcataattcagaacagggaggccgggcctatcgtcacgctatggaggagctcccagatacaatcgaaactctgatgcttctggccctcattgcagtgttgaccggtggggtaacactgtttttcttaagtggcagaggactaggcaagaccagcatcgggctgctctgtgtgatggcttcctctgtccttctgtggatggccagcgtggagccccattggatagcagcctccatcattttggaatttttcctgatggttctcctgatccctgagcccgacaggcagcgcactccacaggataaccaacttgcttacgtggtcattggactcctgtttatgatcttgacggtagcggccaatgagatgggtctgttagaaaccaccaaaaaggacctaggcatagggcacgtggcagttgagaaccaccatcacgctgccatgctggatgtggacctccatcctgcctcagcatggactctttacgctgtcgccaccacaattatcacccccatgatgcggcacactattgaaaacacaacggcgaatatctctctgaccgctatagccaaccaggcagccatcttgatgggactggataagggctggccaattagtaaaatggacatcggtgtgcctctcctggctcttgggtgctattcgcaggtcaatccgttaactctgacagcagccgtgctcatgttggttgcgcattacgctattatcggccccggactgcaagccaaggcaacccgagaggcccagaaaagaaccgctgccggcataatgaagaacccaacagtggatgggattgtagcaatcgacctagatcctgtggtctatgacgctaaattcgaaaagcagctgggacagatcatgctccttattctgtgtactagccaaatcttgctgatgaggacgacctgggccctctgcgagtccataacactggcgactggccccttaaccacactttgggagggttctccagggaagttttggaataccactattgccgtttcaatggcaaacatcttccgcggaagctacctggctggcgccggtctcgcattctccctaatgaaaagtctgggcgggggacggagaggcacgggggctcagggagaaacattgggcgagaagtggaaacgtcagctgaatcagctctctaagagcgaatttaacacctataaaaggtcaggtattatggaggtggaccggtccgaagccaaggaggggcttaagcgcggagagactaccaaacacgccgtcagtcgaggcacagcgaagctgagatggttcgtggaaaggaatttggtaaaacctgagggtaaggtgatcgatctgggctgtgggcggggaggctggagctactattgcgctgggctcaaaaaggttactgaagtgaagggatacaccaaaggcggtcccgggcacgaggaaccgataccaatggcaacatacggatggaacttagtcaagctgcattctggcaaagacgtgtttttcatccctcccgagaagtgtgatacgcttctgtgcgacattggcgagtcctcaccaaatcccaccatcgaagaggggcgcactctaagagtcctcaaaatggtggaaccttggctgaggggaaaccaattttgtattaagatcttgaatccgtatatgcccagcgttgtagagacactggagcagatgcagcgaaaacacggtggcatgctcgtgcggaacccactttcgcgtaattctacccatgaaatgtactgggtcagttgcgggactggaaacattgtgtccgccgttaatatgacaagcagaatgctgttaaaccgcttcaccatggctcacaggaagcctacgtatgagcgggatgtggacctgggcgccggtaccagacacgtcgcagtggaacccgaggtagccaacttggatatcatagggcagcgcattgaaaatatcaagcatgagcacaaatcaacatggcattacgacgaggataacccttataagacttgggcttaccacggatcctatgaagtgaaaccatctggcagcgcgagttccatggttaatggcgtcgtgaagctcctgaccaaaccctgggacgtgatccctatggtcacacaaattgccatgactgataccacaccatttgggcagcagagggttttcaaggagaaggtggacacccgaactcccaaagcaaagcggggaacggctcaaataatggaagtaacagccaaatggctatggggttttcttagcagaaacaagaaaccgaggatctgtacccgcgaggagttcactcgtaaggtgcggtctaatgcagccattggcgctgtctttgtggacgagaaccagtggaactcagccaaggaggcggttgaagatgagagattctgggacctggtgcatagggaacgcgagctccacaaacaggggaagtgcgcaacctgcgtctacaacatgatgggaaaacgagaaaagaaactgggcgagtttggtaaggccaaggggagtcgggctatctggtacatgtggttgggagccagattcctggagttcgaagcactcggctttatgaatgaggatcactggttctccagggaaaacagcctttctggcgtggagggggagggactgcataaattaggttatattctgcgcgacatctcgaagatacctggcgggaatatgtacgctgatgacacagccggatgggatacgagaatcaccgaagacgatttgcagaacgaggctcggattactgacatcatggaaccagagcacgccctcctggcaaaatcaatttttaagctaacatatcaaaataaagtagttagggtgcagcgtcccgcgaagaacggcaccgtcatggatgtgatcagccgacgcgaccagagaggttccggacaggtgggaacttacggccttaatacattcaccaacatggaagcccaactgatacggcagatggagagtgagggcatattttctcctagcgaactcgagacaccaaacctggctgaaagggtcttggattggttagagaaatatggggttgaacgcctgaagagaatggccatctccggagacgactgtgtggtaaagcccatcgatgaccggttcgcaactgctctcaccgcccttaatgatatgggtaaagtgaggaaggacattccgcagtgggagccttcaaaaggctggaacgattggcagcaagtccccttttgcagtcatcacttccaccagctgataatgaaggacgggcgagagatcgtggttccatgtcgtaatcaggatgagctagtgggcagagcacgcgtctctcagggcgccggttggagcctgcgggagacggcgtgcctcgggaaatcctacgctcaaatgtggcagttgatgtattttcataggagagacctgcgccttgccgcaaacgccatttgttcagctgtgcctgtagattggatccccaccagccggacaacttggtctattcacgcccatcaccagtggatgaccacagaagacatgctgtccgtttggaatagggtgtggatcgaggaaaacccatggatggaggataagactcatataagtagctggggagacgtcccctacctcggcaagcgagaggaccaatggtgcggctcgttaatcgggctgaccgcaagagctacgtgggccacaaatattcaggtggcgatcaaccaggttcggaggttgattggaaatgaaaactacctggattatatgacctccatgaaacgcttcaagaatgagtctgaccctgaaggtgctctctggtga

SEQ ID NO: 13953 - RNA, 9879 nt, synthetic construct
  misc_feature 1..9879: note = derived and/or modified CDS sequence (opt3) from DENV-1__GU131786__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaccggccagaggcgctaggcggatggccattctcggggcaaccgcgtgggattttggatccatcggtggcgttttcccttctgtggggaaactggtccatcagatttttggaactgcttacggcgtgcttttcagcggtgtatcatggaccatgaagatagggatcggcgtgctgttgacatggctcggactgaatagtcgatccacgagcttatctatgacctgtattgccgttggcctggtcactctatacctcggggtgatggtgcgcgcagactcaggatgcgtcatcaactggaaaggcagagaactgaagtgtggtagtgggatctttgttacaaatgaggtgcacacctggacagaacagtataagttccaagccgatagccccaaaaggctttccgctgccattggaaaggcatgggaggagggcgtgtgcggtatacggtctgctactcgcttggaaaacatcatgtggaaacagatttcgaacgagctgaatcatatcctcctggaaaacgacatgaagttaaccgtagtcgtgggcgacgttgccgggattctggcgcagggaaaaaagatgatcagaccacagcctatggagtacaaatatagctggaagtcctggggcaaggccaaaataatcggggctgatgtgcaaaatacgacatttattatcgacggacccaacaccccagaatgtcccgatgaccagagggcatggaatatttgggaggtcgaggattacggcttcggtatctttactaccaacatatggcttaagttgcgtgactcatatacacaggtgtgcgatcaccggctcatgagtgccgctattaaagactctaaggccgttcacgcagatatggggtactggatcgaaagcgagaaaaatgaaacttggaagctggcgcgagcctccttcattgaggtgaagacctgtatctggcctaaatcacatacactatggagcaacggagtactggaatctgagatgataatcccaaagatttatggcggtccgatctcccagcacaattacagacccggctacttcacgcaaaccgctgggccttggcatctcggaaaactggagcttgactttgatttgtgcgaaggcactacagtcgtggtggacgagcactgcgggaacaggggaccaagtctgcgcaccactacagtcaccggcaagattatccacgaatggtgttgccggagctgtacgttaccccctctcagattcaaaggtgaggatgggtgctggtatggaatggagataaggccagttaaggaaaaggaggaaaatctggtgaaatctatggtatccgccggctcaggtgaggtggacagttttagccttggcctgttgtgtatttcgatcatgatcgaagaggtcatgcgctcccgatggtctcggaagatgctcatgactgggaccctggcagtgttctttctactgattatgggacagctcacatggaacgacctgatccgtctttgcattatggttggcgctaatgccagcgatagaatggggatgggaaccacttacttggcactgatggccacattcaaaatgaggcccatgtttgctgtgggcttactcttccgccggctgacctcaagagaggtccttctgctaacaataggtctcagtctggtggcgtccgttgaattgccgaactctctggaggaattaggggacggactcgccatgggcatcatgattctgaagcttctgactgattttcagagccatcaattgtgggcaaccctcctgtccctaacgttcatcaggacaaccttttcactgcactatgcttggaaaactatggccatggtgcttagcattgtcagtctcttccctctgtgtttgtctaccacatcccagaagactacctggctgccagtattactcggcagcctggggtgcaagccccttacgatgtttctgatcgccgagaataaaatatggggacgaaagtcgtggcctttgaacgaaggtatcatggctgtgggcattgtttcaatcctcctgtctagtctactgaaaaacgacgtgccccttgcagggccactcattgccggaggcatgctgatcgcgtgttacgtcatatccggtagctctgctgatttgagcttagagaaggccgcagtggtatcctgggaggaagaggccgaacattcaggggctagtcacaatattctggtggaggtccaggacgatggaacaatgaaaatcaaggacgaagagcgcgatgacaccctcactatcctgcttaaagcaacactgttggccgttagcggcgtgtatcctctatctattcccgcgaccctgttcgtgtggtacttctggcagaagaagaaacaacggtccggcgtcctctgggatactccatcaccgcctgaggtggaaagagctgttctggacgatgggatatataggatcatgcagcgtggacttttaggtcgcagtcaggtaggcgtgggggtctttcaggagaacgtgttccatacaatgtggcacgttacccggggagccgtgctgatgtaccaaggcaagagactcgaacccagctgggcatccgtcaaaaaggacttgatttcttacggtgggggatggaggctgcagggctcgtggaatacgggcgaggaggtgcaggtaatcgccgtcgaaccagggaaaaaccccaagaatgtgcagactgctcctggaacctttaagacaagcgagggtgaagttggcgccattgcactcgacttcaaaccagggacctcaggatcccccatcgtgaaccgagagggcaagatagtcggtctgtatgggaatggagtggttacaactagtggcacctacgtgtctgctatcgcccaagcgaaagccagccaggaaggccctcttccggagattgaggatgaagtctttcggaagcgcaacctgacgatcatggacttgcacccagggtccggaaaaacaagaaggtatctacccgcaattgtgcgggaggctatcaagcgaaagctgagaactctcatattagcccctacccgcgtagtggcttcagaaatggcagaggccctgaaaggtatgccaattaggtaccagacaaccgccgttaagtctgaacatactggcaaagagatcgtcgatcttatgtgccacgctaccttcacaatgcgtctgctcagccccgtgcgggtgcctaattataacatgatcattatggacgaggcgcattttacggatccgagttccatcgcagccagagggtacataagcactagggtcggaatgggcgaagctgccgcaattttcatgaccgccacacccccaggttctgtagaggcttttcctcaatcaaatgcggtgatccaggacgaagagcgcgatattcccgaacgatcctggaacagtgggtatgagtggatcaccgacttcccaggaaagactgtttggtttgtgcctagcataaaatcgggcaatgatattgccaactgtttgagaaagaatggcaagcgggtcatccagctgtctaggaaaacattcgacaccgagtaccagaagacgaaaaacaacgattgggactacgtggttactacagacatctccgaaatgggggcaaatttccgcgctgatcgtgtgattgaccccagacggtgcctcaagccagtcatcctgaaagatggaccggagagggtgattcttgccggtcctatgcccgtaaccgtggcaagcgccgctcaacgccgaggcagaatagggcggaaccacaataaggaaggagaccagtatatctacatgggccagccactaaacaatgatgaggaccatgcccactggaccgaggcgaagatgctgttggataacattaatactcccgaaggtatcatccctgcattatttgagccagaaagggagaaatcagccgctattgacggggaatatcgcctgagaggcgaggccaggaagacattcgttgagctcatgcggcgtggagatctgcccgtctggcttagttacaaagtggcttctgaaggctttcagtattccgaccgccgatggtgcttcgatggggagagaaacaatcaagtgctggaagagaacatggacgtcgaaatatggaccaaggagggagagaggaaaaagctccggcctcgctggttggatgcaagaacatacagcgacccgctggccctaagggaatttaaagagttcgctgccggtcggcgatcagttagtggcgacctgatcctcgaaattgggaagcttccacagcacctgactcagagagcacagaatgcgttagataacttggtgatgctgcataatagcgagcaaggaggccgcgcctataggcacgctatggaagagctccccgacacgatcgagaccctgatgcttctggccctcattgcagtattgacaggtggggtgactctgtttttcttatccggccggggactaggcaagacctctatcgggctgctctgtgtcatggctagctccgtgcttctgtggatggcctcagttgaacctcattggatagcagcctctatcattttggagtttttcctgatggtgctcctgatccccgaaccagatcgtcagagaacacctcaggacaaccagcttgcttacgtcgtaattggactcctgtttatgatcttgaccgtggcggccaatgagatgggtctgttagagactacgaaaaaggatctaggcatagggcacgttgcagtggaaaaccaccatcacgctgccatgctggacgtcgatctccatcccgccagtgcatggaccctttacgctgtggccacaactattatcaccccaatgatgaggcacacaattgagaacaccactgcgaatatctcgctgacagctatagccaaccaagcagccatcttgatgggactggacaaaggctggcctattagcaagatggatatcggtgtcccgctcctggctcttgggtgctattcccaggtgaatcccttaacgctgaccgcagccgttctcatgttggtggcgcattacgctattatcggcccaggactgcaggccaaagcaactcgcgaagcccaaaagcggacagctgccggcataatgaagaaccctaccgtagacgggattgtggcaatcgatctagaccccgtcgtttatgatgctaaattcgagaagcagctgggacagatcatgctccttattctgtgtacctctcagatcttgctgatgcgaacaacttgggccctctgcgaatcaataacgctggcgaccggcccattaacaactctttgggagggtagccctgggaaattttggaataccacaattgccgtgtccatggcaaacatcttcagaggaagttacctggctggcgccggtctcgcattctctctaatgaagagcctgggcgggggaaggcgcggcaccggggctcaaggagagactttgggcgaaaaatggaagcggcagctgaatcagctctcaaagtccgagtttaacacgtataaaagaagtggtattatggaagtcgaccgtagcgaggccaaggaagggcttaaaaggggagagacaaccaagcacgccgtgtctcggggcactgcgaaactgcgctggttcgtagagcgaaatttggtgaagcccgaaggtaaggttatcgacctgggctgtgggagaggaggctggtcctactattgcgctgggctcaaaaaggtgaccgaggtcaaaggatacacaaagggcggtccggggcacgaagagccaatacctatggcaacttacggatggaacttagtgaaactgcattcaggcaaggatgtctttttcatccccccagaaaaatgtgacacccttctgtgcgatattggcgagagctcgcccaatcctacaatcgaggaagggaggacgctacgggtgctcaagatggttgagccgtggctgcgcggaaaccagttttgtattaagatcttgaatccctatatgccatctgtagtggaaaccctggagcaaatgcagagaaaacacggtggcatgctcgtcaggaaccctcttagtcgaaattccactcatgagatgtactgggtgagctgcgggacaggaaacattgtttcagccgtgaatatgacctcccggatgctgttaaaccgtttcactatggctcacagaaagcccacatatgaacgcgacgtcgatctgggcgccggtaccaggcacgtggcagtagagcctgaagtggccaacttggacatcatagggcagcggattgagaatatcaaacatgaacacaagtctacgtggcattacgatgaggacaacccatataaaacctgggcttaccacggaagctatgaggttaagcccagtggctccgcgagctctatggtcaatggcgtggtgaagctcctgacaaaaccttgggatgtcatcccaatggttactcagattgccatgaccgacacaactccctttgggcaacagagagtgttcaaggaaaaagtagatacccgcacaccgaaggcaaaaaggggaaccgctcagataatggaggtgactgccaagtggctatggggttttctttcacgaaacaagaaacctcggatctgtacgagagaagagttcacaaggaaggtccgcagtaatgcagccattggcgctgtgtttgttgacgaaaaccaatggaattccgccaaagaggcggtggaggacgaacgtttctgggatctggtccatcgggagagagaactccacaagcaggggaaatgcgcaacctgcgtgtacaacatgatgggaaagagggagaagaaactgggcgaatttggtaaggccaaagggagccgcgctatctggtacatgtggttgggagcccgattcctggagttcgaggcactcggctttatgaatgaagaccactggttctctcgggagaactcgctttcaggcgtagaaggggagggactgcataagttaggttatattctgagagatatcagcaaaataccaggcgggaatatgtacgctgacgatactgccggatgggacaccaggatcacagaggatgacttgcagaacgaagctaagattacggatatcatggagcccgaacacgccctcctggcaaaatccatttttaagctaacctatcagaataaggttgtgcgcgtccaaagacctgcgaaaaacggcactgtgatggacgtgatcagtcggagggatcagcgtggttctgggcaggtcggaacatacggccttaataccttcactaacatggaggcccagctgatacgacaaatggaaagcgagggcattttttccccatcagagctcgaaacacccaacctggctgggcgcgttttggactggttagagaagcatggagtggaaagactgaaacggatggccatcagtggtgatgactgtgtagtgaagccgatcgacgataggttcgcaaccgctctcacagcccttaatgacatgggcaaagtccgcaaggatattcctcagtgggagccctctaaggggtggaacgactggcagcaggtgccattttgcagccaccacttccatcaactgataatgaaagatggaagagaaatcgttgtgccttgtcggaatcaggacgagctagtcggcagggcacgagtgtcccagggtgccgggtggtcactgcgtgagactgcgtgcctcggaaagagctatgctcagatgtggcaattgatgtactttcacagacgcgatctgcggcttgccgcaaacgccatttgttctgctgtacccgttgactgggtgccaacctccaggacgacctggagtatccatgcccaccatcagtggatgacaactgaagatatgctgagcgtctggaatagagtgtggattgaggaaaacccctggatggaggacaaaacccacatctcgtcctggggcgatgttccttatctcggcaagcgcgaagaccagtggtgcgggtctttaataggactgacagcacgggctacttgggccaccaatatccaagtggcgattaaccaggtcaggcgattgctgggtaatgagaactacctcgactacatgacgtcaatgaaaagattcaagaatgagagcgatccagaaggcgctctttggtga

SEQ ID NO: 13954 - RNA, 9879 nt, synthetic construct
  misc_feature 1..9879: note = derived and/or modified CDS sequence (opt3) from DENV-1__GU131787__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacggcatgaagttcactgtagtcgtgggggacgttgcaggcattctggctcagggcaaaaagatgatccgccctcaacccatggagtacaaatattcgtggaaaagctgggggaaggccaagataatcggagcggatgtgcagaataccacatttattatcgacggcccaaacactcctgaatgtcccgatgaccagagagcctggaatatttgggaggtcgaggattacggtttcgggatctttaccacaaacatatggcttaagttgagggactcctatacacaggtgtgcgatcaccgtctcatgtcagctgcaattaaagacagtaaggccgttcacgctgatatgggatactggatcgaatctgagaaaaatgaaacctggaagctggcccgggcatccttcattgaggtgaagacttgtatctggccaaaatcccatacactatggtcaaacggcgtactggaaagcgagatgataatccccaagatttatggtggccctatctctcaacacaattaccgaccagggtacttcacccagactgcgggaccgtggcatctcggcaaactggagcttgactttgatttgtgcgaagggacaaccgtcgtggtggacgagcactgcggaaacagaggcccctccctgaggacgactaccgtcacaggtaagattatccacgaatggtgttgccgcagttgtaccttacctccactccggttcagaggggaggatggatgctggtatggcatggagataaggcccgttaaagaaaaggaggaaaatctggtaaagagcatggtatctgccggttccggcgaggtggactcatttagtcttgggctgttgtgtattagcatcatgatcgaagaggtcatgcgctcgcgatggtcccggaaaatgctcatgactggaacactggctgtgttctttctactgattatgggccagctcacctggaacgacctgatccgtctttgcattatggttggggccaatgcatctgatagaatgggaatgggcacaacttacttggctctgatggccaccttcaagatgaggcctatgtttgcagtgggtttactcttccgccggctgacgagcagagaggtccttctgctaacaatagggctctcactggtggccagtgttgaattgccaaactccctggaggaattaggagacggcctcgctatgggcatcatgattctgaaacttctgaccgattttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcgggtccctgggatgcaagcctcttacaatgtttctgatcgctgagaataaaatatggggtaggcgaagctggccattgaacgaaggcatcatggccgtggggattgtttcgatcctcctgtcatctctactgaagaacgacgtgccccttgccggacctctcattgctggcggtatgctgatcgcatgttacgtcataagtgggtccagcgccgatttgtctttagagaaagcggctgaggtgagctgggaagaggaagccgagcattccggagcatcacacaatattctggtagaagtgcaggacgatggcaccatgaagatcaaagacgaggagcgcgatgacactctcacaatcctgcttaaggccaccctgttggctgtcagtggcgtttatcccctaagcattccagcaacgctgttcgtgtggtacttctggcagaaaaagaagcagcggtctggggtgctctgggatactccttcacccccagaagtcgagagagccgtgctggacgatggaatatataggatcatgcagcgtggtcttttaggccgcagccaggttggggtaggagtgtttcaagaaaacgtcttccataccatgtggcacgtgacacggggcgcggttctgatgtaccagggtaaaagactcgagccgagttgggctagcgtgaagaaagacttgatttcctacgggggaggctggaggctgcagggctcttggaataccggggaggaagtccaggtgatcgccgtagagcctggaaagaaccccaaaaatgtccaaacagcaccaggtacttttaagacccccgaaggcgaggtgggggccattgctctcgacttcaagcctggaacgtcgggcagcccaatcgttaaccgagaaggtaaaatagtggggctgtatggaaatggcgtcgtgacaacttcaggcacctacgtttccgccatcgcacaggctaaggccagtcaggaggggccccttcctgagattgaagatgaggtgtttcggaaacgcaacctgacaatcatggacttgcacccgggatctggtaagaccagaaggtatctaccagcgattgtccgggaagccatcaaacgaaagctgagaactctcatattagcacccacccgcgtggtagctagcgagatggccgaagctctgaagggcatgcctattaggtaccaaacaacggcagtgaaatccgagcatactgggaaggagatcgttgatcttatgtgccacgccaccttcacaatgcgtctgctctcaccagtccgggtgcccaattataacatgatcattatggacgaagcccattttaccgatccttctagcatcgctgcgagaggatacataagtactagggtgggcatgggtgaggcagccgctattttcatgacagccaccccgcccgggtccgtcgaagcatttccacagagcaatgccgtaatccaggacgaggaacgcgatattcctgagcgatcttggaactcaggatatgagtggatcacggacttccccggcaaaactgtgtggtttgttccatccataaagagtggcaatgatattgctaactgtttgaggaaaaatgggaagcgggtgatccagctgagcaggaagacattcgacaccgaataccagaaaaccaagaacaacgattgggactacgtcgtgactacagacatctcggagatgggagcgaatttccgcgccgatcgtgttattgaccctagacggtgcctcaaacccgtgatcctgaaggatggtccagaaagggtcattcttgcaggcccgatgcctgtgaccgtagcttctgccgcacagcgccgagggagaataggacggaaccacaataaagagggcgaccagtatatctacatgggtcagcccctaaacaatgatgaggaccatgcccactggacagaagctaagatgctgttggataacattaatactccagaggggatcatccccgccttatttgaacctgagagggaaaagtccgcggcaattgacggcgagtatcgcctgagaggagaggccaggaaaacgttcgtggaactcatgcggcgtggcgatctgccagtttggcttagctacaaggtcgcttcagaggggtttcaatatagtgaccgccgatggtgcttcgatggagaaagaaacaatcaggtgctggaggaaaacatggacgtggagatatggaccaaagagggtgaaaggaagaaactccggccccgctggttggatgccagaacatactctgaccctctggctctaagggagtttaaggagttcgcagccggccggcgatccgtcagcggggacctgatcctcgagattggaaaacttccgcagcacctgactcagagagctcaaaatgccttagataacttggttatgctgcataattcagaacagggcggtcgcgcatataggcacgcgatggaggagctcccagacaccatcgaaacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggagccccattggatagctgcctccatcattttggaatttttcctgatggttctcctgatccctgagcccgatcgtcagagaaccccacaggacaaccaacttgcatacgtggtcattggtctcctgtttatgatcttgacagtagccgctaatgagatgggcctgttagaaactaccaagaaagatctagggataggacacgtggcggttgagaaccaccatcacgccgcaatgctggacgtggatctccatcctgcttcagcctggacactttacgccgtcgcaaccactattatcacacccatgatgaggcacacgattgaaaacaccactgctaatatctctctgacagccatagcgaaccaggctgccatcttgatgggcctggacaagggttggccaattagtaaaatggatatcggggtgcctctcctggcacttggctgctattcgcaggtcaatccgttaaccctgaccgccgctgtgctcatgttggttgcacattacgccattatcggacccggcctgcaagcgaaggctacacgcgaggcccagaaacggactgcagccgggataatgaagaacccaacggtggacggaattgtagctatcgatctagaccctgtggtctatgatgccaagttcgaaaaacagctgggccagatcatgctccttattctgtgtaccagccaaatcttgctgatgcgaacaacttgggcactctgcgagtccataaccctggctacaggtcccttaaccactctttgggaggggtctccaggaaagttttggaatacgacaattgccgtttcaatggcgaacatcttcagaggcagctacctggccggtgcaggcctcgctttctccctaatgaaaagtctagggggaggcaggcgcgggaccggagcccagggcgaaactttgggtgagaagtggaaacggcagctgaatcagctctctaagagcgaatttaacacctataagagatcagggattatggaggtggaccgttccgaagcaaaagagggacttaagaggggcgagacaactaaacacgctgtcagtcggggtaccgccaagctgcgctggttcgtggaacgaaatttggtaaaacctgagggcaaggtgatcgacctggggtgtggaagaggcgggtggagctactattgcgccggactcaagaaagttacagaagtgaagggctacacgaaaggtgggcccggacacgaggaaccgataccaatggcgacctacggctggaacttagtcaagctgcattctggcaaagatgtgtttttcatccctcccgagaagtgtgacactcttctgtgcgatattggggagtcctcaccaaatcccacaatcgaagagggaaggaccctacgggtcctcaaaatggtggaaccttggctgcgcggtaaccaattttgtattaagatcttgaatccgtatatgcccagcgttgtagagactctggagcagatgcagagaaagcacggcgggatgctcgtgaggaacccactttcgcgaaattctacacatgaaatgtactgggtcagttgcggaaccggcaacattgtgtccgctgttaatatgacgagccggatgctgttaaaccgtttcaccatggcacacagaaaacctacatatgagcgcgacgtggatctgggtgccgggactaggcacgtcgctgtggaacccgaggtagccaacttggacatcataggacagcggattgaaaatatcaagcatgagcacaaatcaacctggcattacgatgaggacaacccttataagacatgggcataccacggctcctatgaagtgaaaccatctggcagcgccagttccatggttaatggggtcgtgaagctcctgactaagccctgggatgtgatccctatggtcacccaaattgctatgacagacaccactccatttggacagcagagagttttcaaagagaaggtggatacgcgcacacccaaagcgaagaggggtaccgcccaaataatggaagtaactgcaaaatggctatggggctttcttagccgaaacaagaagccgcggatctgtaccagagaggagttcacaaggaaagtgcgctctaatgctgccattggggcagtctttgtggacgagaaccagtggaactcagccaaggaggctgttgaagacgagcgtttctgggatctggtgcatcgggaaagagagctccacaaacagggaaagtgcgccacgtgcgtctacaacatgatgggcaaaagggaaaagaagctgggtgagtttgggaaagcgaagggaagtcgcgcaatctggtacatgtggttgggcgcccgattcctggagttcgaagctctcggctttatgaatgaggaccactggttctcccgggaaaacagcctttctggggtggagggagagggtctgcataaattaggctatattctgagagatatctcgaagatacctgggggaaatatgtacgccgacgataccgcaggctgggacactaggatcacagaagatgacttgcagaacgaggctcgcattaccgatatcatggaaccagagcacgccctcctggctagatcaatttttaaactaacttatcaaaataaggtagttcgggtgcagaggcccgccaaaaacggtacagtcatggacgtgatcagccgtcgagatcagcgcgggtccggacaggtgggcacctacggccttaatacattcactaacatggaagcacaactgataagacagatggagagtgaggggatattttctcctagcgaactcgagaccccaaacctggcggaacgggtcttggactggttagagaagtatggagttgaaaggctgaagcgcatggccatctccggtgatgactgtgtggtaaaacccatcgacgatagattcgctacggccctcaccgcacttaatgacatgggcaaggtgcggaaagatattccgcagtgggagccttcaaaggggtggaacgactggcagcaagtccccttttgcagtcatcacttccaccagctgataatgaaagatggaagggagatcgtggttccatgtcgaaatcaggacgagctggtgggccgtgctagagtctctcagggtgccgggtggagcctgcgcgagacagcatgcctcggaaagtcctacgcccaaatgtggcagttgatgtattttcatcggagggatctgagacttgcggctaacgccatttgttcagcagtgcctgtagactggatccccactagccgcaccacatggtctattcacgcccatcaccagtggatgactaccgaagatatgctgtccgtttggaatcgggtgtggatcgaggaaaacccatggatggaggacaagacgcatataagtagctggggcgatgtcccctacctcggcaaaagggaggaccaatggtgcgggtcgttaatcggactgacagctcgagccacctgggcaactaatattcaggtggctatcaaccaggttagacggttgattggtaatgaaaactacctggactatatgacatccatgaagaggttcaaaaatgagtctgatcctgaaggcgccctctggtga

SEQ ID NO: 13955 - RNA, 9879 nt, synthetic construct
  misc_feature 1..9879: note = derived and/or modified CDS sequence (opt3) from DENV-1__HM181968__SS-prME
  source 1..9879: mol_type = other RNA
tccgtgaccatgctgctcatgcttatgcccaccgccctggctttccacttgactacgaggggaggggaacctcatatgatcgtcaccaagcaggaaaggggaaaatccttactgtttaagacatctgcgggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggcaactcagaacggacgcttgattacagccaatcccatcgttaccgacaaagagaagcctgtgaacatagaagctgagccaccctttggcgagtcttatattgtaatcggtgccggggaaaaagcactgaagctctcctggttcaagaaaggctcaagtatcggaaagatgtttgaggccactgctagaggcgccaggcggatggcaattctgggggataccgcgtgggacttcggaagcgtcggtggcgtgtttacatccgttgggaaacttgtgcatcagatcttcggaacggcttacggcgtcctgttttctggtgtgagctggaccatgaagattgggataggcgtattgctcacttggctgggattaaattcacgaagtacatccctgagcatgacctgtatcgccgtgggcctagttacactctacctgggggtcatggtgcaggcagattctggatgcgtgattaactggaaaggccgcgaacttaagtgtggttcagggatcttcgtcactaatgaggttcacacctggacggaacaatataagtttcaggccgacagtccgaaaagattgagcgctgccatcggaaaggcatgggaggagggcgtgtgcggtattaggtccgctacacggctggaaaacataatgtggaaacagatctctaacgagctcaatcatattctgttagaaaacgacatgaagttcaccgtggtagtcggcgatgtggttgggatcctggcccagggcaaaaagatgattcgccctcaacccatggagcacaaatactcgtggaaaagctggggcaaggcgaagatcataggggccgacgtgcagaatactacctttatcattgatggaccaaacacacctgaatgtcccgacgatcagagagcttggaatatctgggaggtcgaggactatggcttcggtatttttgcaactaacatctggcttaagttgagggattcctacacccaggtgtgcgaccaccgtctcatgtcagccgctataaaagatagtaaggccgttcatgcagacatggggtattggattgaatctgagaaaaatgaaacatggaagctggcgcgggccagcttcatcgaggtgaagacgtgtatttggccaaaatcccacaccctatggtcaaacggagtactggaaagcgagatgatcatacccaagatctacggcggtcctatttctcaacataattatcgaccaggctacttcactcagacagctgggccgtggcacctcggaaaactggagcttgattttgacttgtgcgaaggcaccactgtcgtggtggatgagcactgcgggaacagaggaccctccctgaggacaaccacggtcactggcaagatcattcatgaatggtgttgccgcagttgtaccttacctccactccggttcaaaggtgaggacgggtgctggtacggaatggagatcagacccgttaaggaaaaggaggaaaatctggtgaaaagcatggtatctgccggctccggtgaggtggactcatttagtcttggcctgttgtgtataagcattatgatcgaagaggtcatgaggtcgcgctggtcccgaaagatgctcatgacagggaccctggcagtgttcctactgctcatcatgggacagctgacttggaacgatcttattcggttgtgcatcatggttggcgctaatgcctctgaccgtatggggatgggaacaacctatctggcattaatggccacatttaaaatgagacctatgttcgctgtgggcctcctgcttaggcgcctgactagccgggaggtcctactcctgaccattggtttgtcactggtggcgagtgttgaattaccaaactccctcgaggaactgggggatggacttgccatgggcataatgatcctgaagttgctcacggactttcaatctcaccagctgtgggcaacactactgagccttaccttcattaaaactaccctctccctgcattacgcttggaagacaatggccatggtgttgtcaatcgtcagcctgtttcccttatgtctcagtactacctctcagaagacgacatggctgccggtacttctgggctccttcgggtgcaaacctttgaccatgtttctcattactgagaataagatctggggaagaaaaagctggccactgaacgaaggtataatggccgtgggcgttgtgtcgatcctactgtcatctcttctcaagaacgatgtccccctggctgggcctttgattgcaggaggcatgttaatcgcctgttatgtgattagtggttccagcgcggacctgtctctcgagaaagctgccgaggtaagctgggaagaggaagcagagcactccggggcctcacataatatcctggtggaagtccaggatgacggaacaatgaagataaaagatgaggagagggacgatacccttactattctgttgaaggctacactactggcagttagtggcgtgtaccccctcagcatcccagccaccctgttcgtgtggtatttttggcaaaagaaaaagcagcgatctggcgtcctttgggacacgccttcacccccagaagtggagcgcgcggttttagatgacgggatctaccggattatgcagagaggactgctcggtaggagccaggtaggcgtgggggtcttccaagaaaacgtgttccacactatgtggcacgttacccgtggagctgtgttgatgtatcagggcaaacgcctggagccgagttgggccagcgtcaagaaagacctcatatcctacggtgggggatggcggctgcagggctcttggaatacaggcgaggaagtgcaggtaatcgcagtcgagcctgggaagaaccccaagaatgtgcaaaccgccccaggaacatttaaaactcccgaaggtgaggttggcgctattgcccttgatttcaagcctgggacctcgggaagcccaatcgtgaacagagaaggcaaaattgtcggtctgtacgggaatggagtggttacgacatcaggcacttatgtgtccgcaatcgctcaggccaaggcgagtcaggagggccccttgcctgagatagaagacgaggtctttaggaaacgaaacctaaccatcatggatctgcatccggggtctggaaagacacggcgctacctcccagccattgtgagagaagcaatcaagaggaaattacggaccctgattcttgctcccactcgagtagtggccagcgagatggctgaagcactgaagggtatgcctatcagatatcaaaccacagccgttaaatccgagcacacgggcaaggagatagtcgacctcatgtgccatgccactttcaccatgcgcttgctgtcaccagtgagggtgcccaattacaacatgattatcatggatgaagctcactttacagacccttctagcatcgcggcacgtgggtatattagtacccgggtcggaatgggcgaggccgctgccatcttcatgactgcaacaccgcccggttccgtagaagcctttccacagagcaatgctgtgatacaggatgaggaaagagacattcctgagaggtcttggaactcagggtacgagtggatcaccgatttccccggaaaaacggtttggtttgtgccatccattaagagtggcaatgacatcgcgaactgtctccgcaagaatggcaaacgagtcatacagctgagcagaaagactttcgatacagaatatcagaaaaccaagaacaacgactgggactacgtggttaccactgatatttcggagatgggggccaattttcgggcagacagggtgatcgatcctcgccgttgccttaaacccgtcatcctaaaggacggaccagaaagagtgattctggctggtccgatgcctgtaacagtggcctctgcagcccagcggaggggccgcatcgggcgaaaccataataaggagggagatcagtacatttatatgggccagcccttgaacaatgacgaggatcacgctcactggaccgaagccaaaatgttactggacaacataaatacaccagagggtatcattcccgcactcttcgaacctgagagagaaaagtccgcagccatcgatggggagtaccggctgaggggcgaggctcgcaaaactttcgttgaacttatgagaaggggagacctgccagtctggctcagctataaggtggcctcagagggctttcaatacagtgatcggcgttggtgcttcgacggggaacgcaacaatcaggtgttggaggaaaacatggatgtcgagatctggacgaaagagggagaacgaaagaaactgagacccaggtggctagacgctcggacctattctgaccctctggcactccgcgagtttaaggagttcgccgctggtagaaggtccgttagcggcgatcttattctggagatagggaagttaccgcagcatttgacacagcgggcccaaaatgcactggacaacctcgtgatgctgcacaattcagaacagggaggccgagcgtacagacatgccatggaggagcttccagatactatcgaaaccctgatgctcttggctctgattgccgtattaacaggtggggtgaccctatttttcctgagtggccgcggactcggcaaaactagcatcgggcttctgtgtgtcatggcatcctctgtgttgctgtggatggctagcgttgagccccactggattgccgcatccatcatactcgaatttttcctgatggtgcttctcatccctgagcccgacaggcagcggacgccacaggataaccaactggcctatgtcgtaattggattgctgtttatgatcttaaccgtggctgcgaatgagatgggtctactggaaacaactaagaaagacctcggcattgggcacgttgccgtggagaaccatcaccatgcaaccatgcttgatgtcgacctgcaccctgcttcagcctggacattgtacgccgtggcaaccactatcataacacccatgatgcgtcatacgattgaaaacaccactgctaatatctctctgacagccattgcgaaccaggctgccatcctcatgggactggataagggctggccaataagtaaaatggacatcggtgtccctcttttagcactggggtgctacagccaggtgaatccgctcaccttgaccgccgctgttctgatgctagtggcacactatgccattatcggccccggactgcaagcgaaggctacaagagaggcccagaagaggactgcagccggcattatgaaaaacccaacggtagatgggatcgtggctatagacctcgatcctgtcgtttacgacgccaagttcgaaaaacagcttggacagattatgctgttgatcctgtgtaccagccaaatcctcctgatgcgcacaacttgggcattatgcgagtccattacccttgctacaggccccctgaccactctctgggagggttctccagggaagttttggaatacgacaatcgccgtgtcaatggcgaacatattccggggaagctatctagccggcgcaggtctggctttttccttgatgaaaagtctgggcgggggacgaagaggcaccggggcccagggagaaactctcggcgagaagtggaagaggcagcttaatcagctgtctaaaagcgagttcaacatttacaagcgctcaggtatcatggaggtcgaccggtccgaagcaaaagaggggttgaagagaggagagaccacacgtcacgctgtgagtaggggcactgccaaactgcggtggttcgtagaacgcaatctcgtgaagcctgagggtaaggttattgatttaggctgtgggcgaggaggctggagctattactgcgccgggctgaaaaaggtgaccgaagtcaaaggatatacaaagggcggtcccgggcatgaggaaccgatcccaatggcgacgtacggatggaaccttgtgaaactgcactctggcaaggacgtctttttcacccctcccgagaaatgtgatactctactctgcgacataggcgagtcctcaccaaatcccacaatcgaagaggggagaaccctgagggtgttgaagatggttgaaccttggctgcggggaaaccaattttgtattaagatcctcaatccgtacatgcccagcgtagtggagactcttgagcagatgcagcgcaaacatggtggcatgctggtcagaaacccattatcgagaaattctacacacgaaatgtattgggtgagttgcgggaccggaaacattgtttccgctgtgaatatgacgagccgaatgctgttgaaccggttcaccatggcacaccgtaagcctacatacgagagagatgtcgacctcggcgccggtactcgccatgtggctgtagaacccgaggtggccaacctggatatcattgggcagaggatcgaaaatataaaacacgagcataagtcaacctggcactatgacgaggataacccttacaaaacatgggcatatcatggatcctacgaagttaagccatctggcagcgccagttccatggtcaatggcgtggtgaagctacttactaaaccctgggacgtcattcctatggttacccaaatcgctatgacagataccactccatttgggcagcagcgggtgttcaaggagaaagtagacacgagaacacccaaggcgaaacgcggaaccgcccaaatcatggaagtgactgcaaggtggctgtggggttttctcagccgaaacaagaagccgcggatttgtaccagagaggagttcacaaggaaagtccgctctaatgctgccataggcgcagtgtttgttgacgagaaccagtggaactcagccaaggaggctgtggaagatgagcgtttctgggacctggtccagaaagaacgggagttgcacaagcaggggaaatgcgccacgtgcgtgtataacatgatgggaaagagagaaaagaaactgggcgagtttggtaaggcgaaagggagtagggcaatctggtacatgtggctcggagcccgcttccttgagtttgaagctctgggcttcatgaatgaggatcactggttctcccgagaaaacagcttatctggcgtagagggggagggactgcataagttgggttacattctccgggacatctcgaaaattcctggcgggaatatgtatgccgatgacaccgcaggatgggatactagaatcacagaagacgatctgcaaaacgaggctaagataaccgacatcatggaaccagagcacgccctacttgctacttcaatttttaaactgacataccagaataaggttgtgagggtccagcgccccgccaagaacggcaccgtgatggatgtgatcagcagacgggaccagaggggttccgggcaagtcggaacatatggcctcaatactttcaccaacatggaagcacagctgattcgtcagatggagagtgagggcatctttttgccttctgaattagagacgccaaacctggcggaacgagttctcgattggcttgagaaatacggggtggaacgcctgaagagaatggccataagcggagacgactgtgtagtgaaacccattgatgaccggttcgctaccgccctaacagcactgaatgatatgggtaaggtcaggaaagacatcccgcagtgggagccttccaagggctggaacgattggcaacaggtgcccttttgctcacatcacttccaccagctcatcatgaaggacgggcgcgagattgttgtgccatgtagaaatcaggatgaattggtcggacgggctagggtgagtcaaggcgccggttggtctctgcgagagactgcatgccttgggaaaagctatgcccagatgtggcagctgatgtactttcatcgtagagacctccgcttagcggctaacgccatatgttccgcagtacctatcgattgggttcccacctcacggacaacttggagcattcacgcccatcaccaatggatgaccacggaagacatgctgtctgtgtggaatagggtctggatcgaggaaaacccatggatggaggataagacacatgtgtccagttggggagacgttccctatttgggcaaaagagaggaccagtggtgcggcagcctgattgggctcaccgctcgcgccacttgggcatcgaatatccaggtggctataaaccaggtccggaggcttatcggaaatgaaaactacctggattacatgacatccatgaagcgattcaaaaatgagggtgaccctgaaggcgccctatggtga

SEQ ID NO: 13956 - RNA, 9879 nt, synthetic construct
  misc_feature 1..9879: note = derived and/or modified CDS sequence (opt3) from DENV-1__GU131789__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaagacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaagcccctaccaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggatcgttcaaactggagaaggaagtggccgagacgcagcacggtacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgccagtgtggaactgccaaactccttagaggaactcggggatggactggctatgggcattatgatccttaaactgttgaccgacttccaatctcatcagctctgggcgactctgctaagcctgacctttattaagacaactttctcccttcactatgcctggaaaaccatggcaatggttctctcaatcgtgagcctgtttcccttgtgtctgagtacgacatctcagaagaccacttggttaccggtcctcctgggctcccttgggtgcaagcctctgacaatgttcttgatagctgagaataaaatctggggaaggcgaagctggccactcaacgaaggtattatggccgtaggcatcgtgtcgattctgctatcatctctgcttaagaacgatgttcccctcgccgggcctctgatcgctggaggcatgttgatagcatgttacgtgattagtggttccagcgccgacttatctctggagaaagcggctgaggtcagctgggaagaggaagccgagcattccggggcatcacacaatatcctcgtggaagtacaggatgacggaaccatgaagatcaaagatgaggagcgcgacgatactctgacaattcttctgaaggccaccttgctagctgtgagtggcgtctatcccctgagcataccagcaacgctctttgtttggtacttctggcagaagaagaagcagcggtctggcgtgctgtgggacactccttcacccccagaagtggagagagccgtccttgatgacgggatctataggattatgcagcgtggattactgggtcgcagccaggtgggcgttggggtattccaagaaaacgtgtttcataccatgtggcacgtcacacggggagcggtgctcatgtaccagggcaaaagattggagccgagttgggctagcgttaagaaagacctgatctcctacggtgggggatggaggctccagggctcttggaataccggcgaggaagtgcaggtcattgccgtggagcctgggaagaaccccaaaaatgtacaaacaactccaggaaccttcaagacgcccgaaggtgaggtcggcgcaatcgccctggattttaagcctgggacatcgggaagcccaatagtgaaccgagaaggcaaaatcgttggtctttatgggaatggagtggtcactacctcaggcacatacgtgtccgctattgcccaggcaaaggctagtcaggagggccccctgcctgagatcgaagacgaggttttccggaaacgcaacttgaccattatggatctacacccggggtctggaaagactagaaggtatctgccagccatcgtgcgggaagcgataaaacgaaagctcagaaccttaattctggcccccacacgcgtcgtggcaagcgagatggctgaagcccttaagggtatgcctatcaggtaccaaacgactgctgtaaaatccgagcataccggcaaggagatcgtggacctgatgtgccacgcaacatttaccatgcgtctcttgtcaccagttcgggtccccaattataacatgattatcatggatgaagcccatttcactgacccttctagcatagccgctagagggtacattagtacaagggtgggaatgggcgaggcggcagccatctttatgaccgctacgccgcccggttccgtggaagccttcccacagagcaatgcagtcattcaggatgaggaacgcgacatccctgagcgatcttggaactcagggtatgagtggataactgattttcccggaaaaacagtatggttcgtgccatccattaagagtggcaatgacatcgccaactgtctgaggaaaaatggcaagcgggttatccagctcagcaggaagacctttgataccgaataccagaaaactaagaacaacgactgggactacgtggtcacaaccgatatttcggagatgggggctaatttccgcgcggaccgtgtgatcgatcctagacggtgcctgaaacccgttattcttaaggacggaccagaaagggtgatactagccggtccgatgcctgtcacagtggcatctgctgcccagcgccgaggcagaatcgggcggaaccacaataaagagggagatcagtatatttacatgggccagcccctgaacaatgacgaggatcatgcacactggactgaagccaagatgttgttagacaacatcaatacgccagagggtatcattcccgctctgttcgaacctgagagggaaaagtccgccgcgatagatggggagtatcgcctcagaggcgaggcaaggaaaacctttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacaaaagagggagaaaggaagaaattgcggccccgctggctggacgctagaacttactctgaccctctagccctgagggagttcaaggaatttgctgcaggtcggcgatccgtgagcggcgatctcattcttgagatcgggaaactgccgcagcacttaacccagagagcccaaaatgctttggacaacctggtcatgctccataattcagaacagggaggccgcgcctataggcacgcaatggaggagctgccagatacaattgaaacccttatgctgctcgcgttgatcgccgttctgactggtggggtgacgttattctttctaagtggccggggactgggcaagaccagcatagggctcctttgtgtaatggcttcctctgtgctgttgtggatggccagcgtcgagccccattggatcgcagcttccattatcctggagttctttctcatggtgctgcttattcctgagcccgaccgtcagagaacaccacaggataaccaactcgcctacgttgtgatcggactgttgttcatgatactgactgtcgcagccaatgagatgggtttactagaaaccacaaagaaagacctgggcattgggcacgtagctgtgggaaaccaccatcacgcggccatgctcgatgttgaccttcatcctgcatcagcttggaccctgtacgccgtggccactacaatcattacgcccatgatgaggcacaccatcgagaacactacagcaaatatatctttgaccgctatcgccaaccaggcggctattctgatgggcctcgataagggttggccaatcagtaaaatggacattggggtccctctgcttgccttaggctgctatagccaggtgaatccgctgaccctcacagcagccgtcttgatgctggtggctcattacgcaatcataggacccggcctacaagccaaggcgactcgcgaagctcagaaacggacggccgcagggattatgaagaacccaaccgttgatggaatcgtggccatcgacctggatcctgtagtgtatgacgctaagtttgagaaacagctcggccagattatgcttctgatcttgtgtacaagccaaatactgctcatgcgaactacctgggccctgtgcgaatccattacattagcaaccggtccccttactacgctgtgggaggggtctccaggaaagttctggaatacaaccatcgctgtctcaatggccaacatttttagaggcagctacctcgcgggtgccggcctagcattctccctgatgaaaagtctagggggaggcaggcgcgggactggagctcagggcgagaccctgggtgaaaagtggaaacggcagctcaatcagctttctaagagcgagttcaacacatataagagatcagggatcatggaagttgaccgttccgaggccaaagaaggactgaagaggggcgagactaccaaacacgcagtgagtcggggtacagctaagttgcgctggtttgtcgagcgaaatctggtgaaacctgaaggcaaggtaatagatctcgggtgtggaagaggcgggtggagctactattgcgccggattaaagaaagtgacggaggttaagggctacaccaaaggtgggcccggacacgaagaaccgatcccaatggccacttacggctggaacctggtgaaacttcattctggcaaagacgtcttctttattcctcccgaaaagtgtgatacactgctatgcgacatcggggagtcctcaccaaatcccaccattgaggaaggaaggactctccgggtgctgaaaatggtcgagccttggttgcgcggtaaccaattctgtatcaagattctgaatccgtatatgcccagcgtggttgaaacactcgagcagatgcagagaaagcacggcgggatgcttgtaaggaacccactgtcgcgaaattctacccatgagatgtactgggtgagttgcggaacgggcaacatcgtctccgcggtgaatatgaccagccggatgttactgaaccgttttacaatggctcacagaaaacctacttatgaacgcgatgttgacttgggtgcagggaccaggcacgtggccgtcgagcccgaagtggctaacctcgatataattggacagcggatcgagaatatcaagcatgaacacaaatcaacatggcattacgacgaggataacccttataagacttgggcctaccacggctcctatgaggtaaaaccatctggcagcgcaagttccatggtgaatggggttgtcaagctgctaaccaagccctgggacgtgattcctatggtgacacaaatagccatgaccgatactacgccattcggacagcagagagtctttaaagaaaaggttgacacacgcacccccaaagctaagaggggtactgcgcaaatcatggaggtgaccgccaaatggctttggggcttcctgagccgaaacaagaagccgcggatttgtacaagagaagagtttacgaggaaagtacgctctaatgcagctatcggggccgtgttcgtcgacgaaaaccagtggaactcagcaaaggaggccgtggaggatgaacgtttttgggacctcgttcatcgggagagagaactgcacaaacagggaaagtgcgctacctgcgtgtacaacatgatgggcaaaagggagaagaagttgggtgagttcgggaaagccaagggaagtcgcgcgatttggtacatgtggctgggcgcacgatttctcgagttcgaggcccttggcttcatgaatgaagatcactggttttcccgggagaacagcctgtctggggtcgaaggagagggtttacataaactgggctatatcttgagagacatatcgaagatccctgggggaaatatgtacgctgatgacactgccggctgggatacaaggattaccgaggacgatctccagaacgaagcacgcatcactgacattatggagccagaacacgctctgctagccaaatcaatcttcaaacttacatatcaaaataaagtggtaagagttcagcggcccgctaagaacggtaccgtgatggatgtcataagcaggcgtgaccagcgagggtccggacaggtgggcacatacggcctgaatacttttaccaacatggaggcccaactcattcgccagatggaaagtgaggggatcttctctcctagcgagctggaaacgccaatcttggcagagagagtgttagattggctggaaaagtatggagtcgagcggctcaaaaggatggcgatttccggtgacgactgtgttgtgaagcccatagatgaccgctttgccaccgctcttacagccctgaacgatatgggcaaagtaagaaaggacatcccgcagtgggaaccttcaaaagggtggaatgattggcagcaagtgcccttctgcagtcatcactttcaccagctaattatgaaggacggacgggagatcgtcgtgccatgtaggaaccaggatgagctggttggccgagcacgtgtgtctcagggtgctgggtggagcctcagagaaactgcctgcttgggaaagtcctacgcacaaatgtggcagctgatgtatttccatcgccgggaccttaggctggccgcgaatgctatttgttcagccgtccctgtggattggatccccaccagcagaacaacttggtctatacacgcacatcaccagtggatgaccacggaggacatgctctccgtatggaaccgcgtttggatcgaagagaatccatggatggaagataaaacacatattagtagctggggcgacgtgccctacttaggcaagcgggaggaccaatggtgcgggtcgctgatcggattgaccgccagggctacttgggccacaaacattcaggtcgcaatcaatcaggtgcgaagactgattggtaacgagaattacctcgattatatgacctccatgaaacggtttaagaacgaatctgaccctgagggcgctctttggtga

SEQ ID NO: 13957 - RNA, 9879 nt, synthetic construct
  misc_feature 1..9879: note = derived and/or modified CDS sequence (opt3) from DENV-1__GU131790__SS-prME
  source 1..9879: mol_type = other RNA
agcgtgaccatgctgctcatgcttgtccccacggccctggctttccacttgactacgagaggaggggaacctcatatgatcgtttccaagcaggaaagaggaaaatctttactgtttaagacctcagccggtgtgaatatgtgcacactaattgccatggacctcggcgagctgtgtgaagatactatgacctacaaatgcccacggataacagagaccgaaccggacgatgtagactgttggtgcaatgcgactgatacatgggtgacctatgggacgtgtagtcaaactggagagcaccgccgagacaagcgtagcgtcgctcttgcaccccatgtgggcctgggtttggagaccagaacagaaacttggatgtcctctgagggggcatggaaacagatccagagggttgaaacctgggccctccggcaccctggattcacagtgattgctctgtttctggcacatgccatcggcacctcgattacgcagaagggcatcatattcatcctcttaatgctggtcactccatcaatggctatgcgctgcgtggggattggaagcagagattttgtagagggtcttagtggcgccacatgggttgacgtggtcttggagcacgggtcctgtgtgaccactatggcgaaggataaacccacactggacatcgaactactcaagaccgaggtgacgaaccctgcagtcctgaggaaactttgcattgaagccaagatctctaataccacaactgatagccggtgtccaacccaaggagaggctacactggttgaagaacaagacgccaacttcgtgtgccgccgaacttttgtagatagaggctggggtaatgggtgtggattgttcggcaaaggctccctcataacctgcgcaaagtttaagtgcgtgacaaaactggaggggaagattgtccagtacgaaaacttaaaatattcagtgatcgttaccgtgcacactggagaccagcatcaagtcggtaatgagagtacggaacacggcacaaccgctactattacaccccaagcccctaccaccgagatccagctgactgactacggggcgctcacacttgattgtagcccaaggacgggactggacttcaacgaaatggtgttgctaaccatgaaggagaaatcttggctggtacataagcagtggtttctcgatctgccgcttccctggacttccggcgcctcaacaagccaagagacctggaatcggcaggacctgttggttacattcaaaactgcacacgctaagaagcaggaagtggtcgtgctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtcatgtgtaccggatcgttcaaactggagaaggaagtggccgagacgcagcacggtacagttcttgtgcagataaagtacgagggcaccgacgctccttgcaaaatcccattctcgactcaagatgaaaagggggtaacacagaacggacgcttgattaccgcgaatcccatcgtcactgacaaagagaagcctgtgaacatagaagcagagccaccctttggcgagtcttatattgttatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtgtttacgtccgtcgggaaacttgtgcatcagattttcggaaccgcatacggcgtactgttttctggtgtgagctggactatgaagatagggatcggcgttttgctcacatggctgggattaaattcacgaagtacctccctgagcatgacatgtattgcggtcggcctagtgactctctacctgggggtgatggtccaggctgattctggatgcgttatcaactggaaaggccgcgaacttaagtgtggttcagggatcttcgtgaccaatgaggtgcacacgtggacagaacaatataagtttcaggccgacagtccgaaaagattgagcgcagccattggaaaggcttgggaggagggcgtatgcggtataaggtccgccacccggctggaaaacatcatgtggaaacagatttctaacgagctcaatcatatcctgttagaaaacgacatgaagttcactgtcgtggttggcgatgtggcagggattctggctcagggcaagaagatgatccgccctcaacccatggagtacaaatattcgtggaagtcctggggcaaggccaaacttataggggcggacgtccagaataccacatttatcattgatggaccaaacactcctgaatgtcccgacgatcagagagcctggaatatctgggaggtggaggactacggcttcggtatttttaccacaaacatctggttgaagctcagggatagctatacgcaggtttgcgaccaccgtctgatgtcagctgcaataaaagatagtaaggccgtgcacgctgacatggggtactggattgaatctgagaaaaatgaaacctggaagctagcccgggcatccttcatcgaggtaaagacttgtatttggccaaaatcccatacactgtggtcaaacggagtcctcgaaagcgagatgatcatacccaagatctatggcggtcctatttctcaacacaattaccgaccaggctacttcacccagactgcggggccgtggcatctgggaaaacttgagttggattttgacctgtgcgaaggcacaaccgtggtggtcgatgagcactgcgggaacagaggaccctccttaaggacgactaccgttacaggcaagatcattcacgaatggtgttgccgcagttgtaccctccctccactgcggttcagaggtgaggacgggtgctggtatggaatggagatcaggcccgtgaaagaaaaggaggaaaatcttgtaaagagcatggtgtctgccggctccggtgaggtcgactcatttagtctgggcttgctctgtataagcattatgatcgaagaggtgatgcgctcgcgatggtcccggaaaatgctgatgactgggacactagctgttttctttctgctcatcatgggacagctgacctggaacgatcttattcgtttgtgcatcatggtgggcgccaatgcatctgacagaatggggatgggaacaacttacctggctttaatggccaccttcaagatgaggcctatgtttgcagtcggcctcctgttccgccggcttacgagcagagaggtgctgctactcacaattggtctgtcattggttgccagtgtggaactgccaaactccttagaggaactcggggatggactggctatgggcataatgatccttaaactgttgaccgactttcaatctcatcagctctgggcgactctgctaagcctgaccttcattaagacaactttttcccttcactatgcctggaaaaccatggcaatggtcctctcaatcgtaagcctgttccccttgtgtctgagtacgacatctcagaagaccacttggttaccggtgctcctgggctcccttgggtgcaagcctctgacaatgtttttgattgctgagaataaaatctggggaaggcgaagctggccactcaacgaaggtataatggccgttggcatcgtgtcgattctgctatcatctctgcttaagaacgatgtccccctcgccgggcctctgatcgctggaggcatgttgattgcatgttacgtgatcagtggttccagcgccgacttatctctggagaaagcggctgaggtaagctgggaagaggaagccgagcattccggggcatcacacaatatactcgtggaagtccaggatgacggaaccatgaagattaaagatgaggagcgcgacgatactctgacaatccttctgaaggccaccttgctagctgttagtggcgtgtatcccctgagcatcccagcaacactcttcgtgtggtacttctggcagaagaagaagcagcggtctggcgtcctgtgggacactccttcacccccagaagtggagagagccgttcttgatgacgggatttataggataatgcagcgtggattactgggtcgcagccaggtaggcgtgggggtctttcaagaaaacgtgttccataccatgtggcacgttacacggggagcggtgctcatgtaccagggcaaaagattggagccgagttgggctagcgtcaagaaagacctgatctcctacggtgggggatggaggctccagggctcttggaataccggcgaggaagtgcaggtaattgccgtcgagcctgggaagaaccccaaaaatgtgcaaacagcaccaggaacttttaagacccccgaaggtgaggttggcgccatcgctctggatttcaagcctgggacgtcgggaagcccaattgtgaaccgagaaggcaaaatcgtcggtctttatgggaatggagtggttacaacttcaggcacctacgtgtccgccatagcacaggctaaggccagtcaggagggccccctgcctgagatcgaagacgaggtctttcggaaacgcaacttgacaattatggatctacacccggggtctggaaagaccagaaggtatctgccagcgatcgtgcgggaagccattaaacgaaagctcagaactttaatcctggcacccacccgcgtagtggctagcgagatggccgaagctcttaagggtatgcctataaggtaccaaacaacggcagttaaatccgagcatactggcaaggagattgtcgacctgatgtgccacgccaccttcacaatgcgtctcttgtcaccagtgcgggtgcccaattataacatgatcatcatggatgaagcccattttaccgacccttctagcattgctgcgagagggtacatcagtactagggtcggaatgggcgaggcagccgctatattcatgacagccaccccgcccggttccgtagaagcatttccacagagcaatgccgtgattcaggatgaggaacgcgacatccctgagcgatcttggaactcagggtatgagtggattacggatttccccggaaaaactgtttggtttgtgccatccatcaagagtggcaatgacatagctaactgtctgaggaaaaatggcaagcgggtcattcagctcagcaggaagacattcgataccgaataccagaaaaccaagaacaacgactgggactacgtggttactacagatatctcggagatgggggcgaatttccgcgccgaccgtgtgatcgatcctagacggtgcctgaaacccgtcattcttaaggacggaccagaaagggtgatcctagcaggtccgatgcctgtaaccgtggcttctgccgcacagcgccgaggcagaattgggcggaaccacaataaagagggagatcagtatatatacatgggccagcccctgaacaatgacgaggatcatgcccactggacagaagctaagatgttgttagacaacatcaatactccagagggtattatccccgccctgtttgaacctgagagggaaaagtccgcggcaatcgatggggagtatcgcctcagaggcgaggccaggaaaacgttcgttgaactgatgcggcgtggagaccttccagtctggctgagctacaaggtggcttcagagggctttcaatatagtgatcgccgatggtgcttcgacggggaaagaaacaatcaggtgctcgaggaaaacatggatgtcgagatttggaccaaagagggagaaaggaagaaattgcggccccgctggctggacgccagaacatactctgaccctctagctctgagggagtttaaggagttcgcagccggtcggcgatccgttagcggcgatctcatacttgagatcgggaaactgccgcagcacttaactcagagagctcaaaatgccttggacaacctggtgatgctccataattcagaacagggaggccgcgcatataggcacgcgatggaggagctgccagataccattgaaacacttatgctgctcgccttgatcgctgtactgaccggtggggtgactttatttttcctaagtggccggggactgggcaagacgagcattgggctcctttgtgtcatggcctcctctgtgctgttgtggatggcaagcgttgagccccattggatcgctgcctccataatcctggaatttttcctcatggtgctgcttattcctgagcccgaccgtcagagaaccccacaggataaccaactcgcatacgtcgtaatcggactgttgtttatgattctgacagtggccgctaatgagatgggtttactagaaactaccaagaaagacctgggcatcgggcacgttgcggtggagaaccaccatcacgccgcaatgctcgatgtcgaccttcatcctgcttcagcctggacactgtacgccgtggcaaccactataattacacccatgatgaggcacacgatcgaaaacaccactgctaatatttctttgacagccatcgcgaaccaggctgccatactgatgggactcgataagggctggccaatcagtaaaatggacattggtgtccctctgcttgcattagggtgctatagccaggtgaatccgctgaccctcaccgccgctgttttgatgctggtggcacattacgccatcattggccccggactacaagcgaaggctacacgcgaggcccagaaacggactgcagccggcatcatgaagaacccaacggtagatgggatagtggctattgacctggatcctgtcgtttatgacgccaagttcgaaaaacagctcggacagatcatgcttctgatcttgtgtaccagccaaattctgctcatgcgaacaacttgggcactgtgcgagtccatcaccttagctacaggcccccttaccactctgtgggagggttctccagggaagttttggaatacgacaatagccgtgtcaatggcgaacattttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtatcatggaggtcgaccgttccgaagcaaaagaggggctgaagaggggagagacaactaaacacgctgtgagtcggggcaccgccaagttgcgctggttcgtagaacgaaatctggtgaaacctgagggtaaggttattgatctcggctgtgggagaggaggctggagctactattgcgccgggttaaagaaagtgacagaagtcaagggatacacgaaaggcggtcccgggcacgaggaaccgatcccaatggcgacctacggatggaacctggtgaaacttcattctggcaaagacgtctttttcatacctcccgagaagtgtgatactctgctatgcgacatcggcgagtcctcaccaaatcccacaattgaagaggggaggaccctccgggtgctgaaaatggttgaaccttggttgcgcggaaaccaattttgtatcaagattctgaatccgtatatgcccagcgtagtggagactctcgagcagatgcagagaaagcacggtggcatgcttgtcaggaacccactgtcgcgaaattctacacatgaaatgtactgggtgagttgcgggaccggaaacatcgtttccgctgtgaatatgacgagccggatgttactgaaccgtttcaccatggcacacagaaaacctacatatgagcgcgatgtcgacttgggcgccggtactaggcacgtggctgtagaacccgaggtggccaacctcgatattatcgggcagcggatagaaaatattaagcatgagcacaaatcaacctggcattacgacgaggataacccttataagacatgggcataccacggatcctatgaagttaaaccatctggcagcgccagttccatggtcaatggcgtggtgaagctgctaactaagccctgggacgtcatccctatggttacccaaatcgctatgacagataccactccatttgggcagcagagagtgttcaaagagaaggtagacacgcgcacacccaaagcgaagaggggaaccgcccaaattatggaagtgactgcaaaatggctttggggttttctgagccgaaacaagaagccgcggatatgtaccagagaggagttcacaaggaaagtccgctctaatgctgccatcggcgcagtgtttgttgacgagaaccagtggaactcagccaaggaggctgtggaagatgagcgtttctgggacctcgtccatcgggaaagagagctgcacaaacaggggaagtgcgccacgtgcgtgtacaacatgatgggaaaaagggaaaagaagttgggcgagtttggtaaagcgaaggggagtcgcgcaatttggtacatgtggctgggagcccgattcctcgagttcgaagctcttggctttatgaatgaggatcactggttctcccgggaaaacagcctgtctggcgtagagggggagggattacataaactgggttatatcttgagagacatttcgaagatccctggcgggaatatgtacgccgatgacaccgcaggatgggatactaggataacagaagacgatctccagaacgaggctcgcatcaccgacattatggaaccagagcacgccctgctagctaaatcaatctttaaacttacttatcaaaataaagttgtgagagtccagcggcccgccaagaacggcacagtgatggatgtgattagcaggcgtgaccagcgaggttccgggcaggtcggaacctacggcctgaatacattcactaacatggaagcacaactcatccgccagatggagagtgagggcatattttctcctagcgaactggagaccccaaacttggcggaaagagttttagattggctggagaagtatggggtgaaacggctcaagaggatggccatttccggagacgactgtgtagtgaaacccatcgatgaccgcttcgctacggcccttaccgcactgaatgatatgggtaaggtcagaaaagacatcccgcagtgggaaccttcaaagggctggaacgattggcagcaagtgcccttttgcagtcatcacttccaccagctaattatgaaggacgggcgggagatagttgtgccatgtaggaatcaggatgagctggtcggacgagctcgtgtgtctcagggcgccggttggagcctcagagaaacagcatgcttggggaaatcctacgcccaaatgtggcagctgatgtattttcatcgccgggaccttaggctggcggctaacgccatctgttcagcagtacctgttgattggattcccactagcagaaccacatggtctatccacgcccatcaccagtggatgactaccgaggacatgctctccgtgtggaatcgcgtctggattgaagagaacccatggatggaagataagacgcatatcagtagctggggagacgtgccctacttaggcaaacgggaggaccaatggtgcggctcgctgatagggttgacagctagggccacctgggcaactaatatccaggttgctattaaccaggtgcgaagactgatcggaaatgagaactacctcgattatatgacatccatgaagcggttcaaaaatgaatctgaccctgagggtgccctttggtga

SEQ ID NO: 13958 - RNA, 9879 nt, synthetic construct
  misc_feature 1..9879: note = derived and/or modified CDS sequence (opt3) from DENV-1__GU131791__SS-prME
  source 1..9879: mol_type = other RNA
agcgtgaccatgctgctcatgcttatgcccacggcactggctttccacttgactacgcggggaggggaacctcatatgatcgtctccaagcaggaaagggggaaatctttactgtttaagacctcagccggtgttaacatgtgcacactaattgcaatggacctcggagaactgtgtgaagatactatgacctacaaatgcccacggataacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggccagcttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggacccatgaaaatcaaggatgaggagcgggacgatacactcaccatcctgcttaaagctactctgttggcagtcagtggcgtttatccactaagcattcctgccacactgttcgtgtggtacttctggcaaaagaaaaagcagagatctggcgtgctctgggacaccccctccccaccggaagtcgagagggcggtgctggatgacgggatatatcgtatcatgcagcgcggacttttaggtcggtcacaggttggcgtaggggtgtttcaagaaaacgtcttccatacgatgtggcacgtgactagaggagctgttctgatgtaccagggcaagaggctcgagcctagttgggccagcgtgaaaaaggacttgatttcctacggtgggggatggcgactgcagggctcttggaataccggcgaggaagtccaggtgatcgcagtagagcccgggaaaaacccaaagaatgtccaaacagcccccggaacctttaaaacacctgaaggtgaggtgggcgctattgccctcgatttcaagccagggacttcgggaagccccatcgttaaccgggaaggcaagatagtgggtctgtatgggaatggagtcgtgaccacgtcaggcacatacgtttccgcaatcgctcaggccaaagcgagtcaggagggccctcttccggagattgaagacgaggtgtttcgcaagagaaacctgactatcatggatttgcacccagggtctggaaaaaccaggcggtatctacccgccattgtccgagaagcaatcaagagaaaactgcgcacactcatattagctcctaccagggtggtagccagcgagatggctgaagcactgaagggtatgccaattcgttaccaaactaccgccgtgaagtccgagcatacaggcaaagagatcgttgaccttatgtgccacgccacgttcactatgcggctgctctcacccgtcagagtgcctaattataacatgatcattatggatgaagctcattttaccgacccgtctagcatcgcggcaagggggtacataagtacacgcgtgggaatgggcgaggccgctgccattttcatgaccgcaactcccccaggttccgtcgaagcctttcctcagagcaatgctgtaatccaggatgaggaacgagacattcccgagagatcttggaactcagggtatgagtggatcacagatttcccaggaaagaccgtgtggtttgttccttccataaaaagtggcaatgacattgcgaactgtttgcggaagaatggcaaaagggtgatccagctgagccgcaagacgttcgatactgaataccaaaagaccaagaataacgactgggactacgtcgtgaccaccgatatctcggagatgggggccaatttccgtgcagacagagttattgatccccggaggtgcctcaagccagtgatcctgaaagacggaccggaacgcgtcattcttgctggtcctatgcccgtgactgtagcctctgcagcccagcgaagaggccggatagggaggaaccacaataaggagggagatcagtatatctacatgggccagccactaaacaatgacgaggatcatgctcactggacagaagccaaaatgctgttggacaacattaatacccccgagggtatcatccctgcgttatttgaaccagagcgcgaaaagtccgcagccattgatggggagtatagactgaggggcgaggctcggaagacattcgtggaactcatgcgtcgcggagacctgcccgtttggcttagctacaaagtcgcctcagagggctttcaatatagtgatcgaagatggtgcttcgacggggaaaggaacaatcaggtgctggaggaaaacatggatgtggagatatggactaaggagggagaacggaaaaagctccgccctagatggttggacgctaggacgtactctgacccgctggcactacgggagtttaaagagttcgccgctggtcgaagatccgtcagcggcgatctgatcctcgagattgggaaacttccacagcacctgacccagcgcgcccaaaatgcattagacaacttggttatcctgcataattcagaacagggaggcagggcgtatcggcacgccatggaggagctccccgatacaattgaaactctgatgcttctggctctcatcgccgtgttgaccggtggggtaacactgtttttcttaagtggccgtggactaggcaaaaccagcatagggctgctctgtgtgatggcatcctctgtccttctgtggatggctagcgtggagcctcattggatcgccgcatccattatcttggaatttttcctgatggttctcctgattcccgagccagacagacagaggactcctcaggataaccaacttgcctacgtggtcatcggactcctgtttatgatattgacggtagctgcgaatgagatgggtctgttagaaaccacaaagaaggacctaggcattgggcacgtggccgttgagaaccaccatcacgcagctatgctggatgtggacctccatcccgcctcagcctggactctttacgcagtcgctaccacaatcattaccccaatgatgcgccacactatcgaaaacacaacggccaatatatctctgaccgcgatcgctaaccaggccgcaattttgatgggactggataaaggctggcctatcagtaagatggacattggtgtgccgctcctggcccttgggtgctattcgcaggtcaatcccttaactctgacagctgcagtgctcatgttggttgcccattacgcgatcataggcccaggactgcaagctaaagccacccgggaggcacagaagcgaaccgccgctggcattatgaaaaaccctacagtggatgggatcgtagccatcgacctagatcccgtggtctatgacgcaaagttcgaaaagcagctgggacagattatgctccttatcctgtgtactagccaaatattgctgatgagaacgacctgggctctctgcgagtccattacactggccactggcccattaaccacactttgggagggttctcctgggaaattttggaataccactatcgcggtttcaatggccaacattttcaggggaagctacctggcaggcgctggtctcgccttctccctaatgaagagtctgggcgggggacgccggggcacgggggcacagggagaaacattgggcgagaaatggaagagacagctgaatcagctctctaaaagcgaatttaacacctataagcgttcaggtatcatggaggtggacaggtccgaagctaaggaggggcttaaacggggagagactaccaagcacgccgtcagtcgcggcacagccaaactgcgatggttcgtggaaagaaatttggtaaagcccgagggtaaagtgatagatctgggctgtgggaggggaggctggagctactattgcgcggggctcaagaaggttactgaagtgaaaggatacaccaagggcggtccggggcacgaggaaccaatccctatggctacatacggatggaacttagtcaaactgcattctggcaaggacgtgtttttcattcccccagagaaatgtgatacgcttctgtgcgacatcggcgagtcctcacccaatcctaccattgaagaggggcggactctacgcgtcctcaagatggtggaaccgtggctgagaggaaaccaattttgtatcaaaattttgaatccctatatgccaagcgttgtagagacactggagcagatgcagaggaagcacggtggcatgctcgtgcgaaaccctctttcgagaaattctacccatgaaatgtactgggtcagttgcgggactggaaacatcgtgtccgcagttaatatgacaagccgtatgctgttaaacagattcaccatggcccaccgcaagcccacgtatgagagggatgtggacctgggcgctggtacccggcacgtcgccgtggaacctgaggtagcaaacttggatataattgggcagagaatcgaaaatatcaaacatgagcacaagtcaacatggcattacgacgaggataacccatataaaacttgggcctaccacggatcctatgaagtgaagccctctggcagcgctagttccatggttaatggcgtcgtgaaactcctgaccaagccttgggacgtgattccaatggtcacacaaatagcgatgactgataccacaccctttgggcagcagcgcgttttcaaggagaaagtggacaccaggactccgaaggccaaacgaggaacggcacaaatcatggaagtaacagctaagtggctatggggttttcttagccggaacaaaaagcctagaatttgtaccagggaggagttcactcgcaaggtgcgttctaatgccgcaatcggcgccgtctttgtggacgagaaccagtggaactcagctaaagaggccgttgaagatgagcggttctgggacctggtgcatagagaaagggagctccacaagcaggggaaatgcgcgacctgcgtctacaacatgatgggaaagcgcgagaaaaagctgggcgagtttggtaaggcaaaagggagtcgagccatttggtacatgtggttgggagctcggttcctggagttcgaagccctcggctttatgaatgaggatcactggttctccagagaaaacagcctttctggcgtggagggggagggactgcataagttaggttatatcctgagggacatatcgaaaatcccaggcgggaatatgtacgcagatgacacagctggatgggatacgcgcattaccgaagacgatttgcagaacgaggccagaatcactgacattatggaacccgagcacgctctcctggccaagtcaatctttaaactaacatatcaaaataaggtagttcgggtgcagaggcctgccaaaaacggcaccgtcatggatgtgataagccgtcgagaccagcgcggttccggacaggtgggaacttacggccttaatacattcaccaacatggaagcgcaactgattagacagatggagagtgagggcatcttttctccaagcgaactcgagacacccaacctggccgaacgggtcttggattggttagagaagtatggggttgaaaggctgaagcgcatggctatctccggagacgactgtgtggtaaaaccgattgatgacagattcgccactgcactcaccgctcttaatgatatgggtaaggtgcggaaagacatacctcagtgggagccctcaaagggctggaacgattggcagcaagtcccattttgcagtcatcacttccaccagctgatcatgaaagacgggagggagattgtggttccttgtcgaaatcaggatgagctagtgggacgtgccagagtctctcagggcgcaggttggagcctgcgcgagacggcctgcctcgggaagtcctacgcgcaaatgtggcagttgatgtattttcatcggagggacctgagacttgctgccaacgcaatctgttcagccgtgcccgtagattggattccaaccagccgcacaacttggtctatccacgctcatcaccagtggatgaccacagaagacatgctgtccgtttggaatcgggtgtggatagaggaaaacccctggatggaggataagactcatatcagtagctggggagacgtcccttacctcggcaaaagggaggaccaatggtgcggctcgttaattgggctgaccgcccgagcaacgtgggctacaaatatccaggtggccattaaccaggttagacggttgatcggaaatgaaaactacctggattatatgacctccatgaagaggttcaaaaatgagtctgacccagaaggtgcgctctggtga

SEQ ID NO: 13959 - RNA, 9879 nt, synthetic construct
  misc_feature 1..9879: note = derived and/or modified CDS sequence (opt3) from DENV-1__GU131792__SS-prME
  source 1..9879: mol_type = other RNA
agcgtgaccatgctgctcatgcttatgcccacagcactggctttccacttgactacgagaggcggggaacctcatatgatcgtcaccaagcaggaaaggggaaaatccttactgtttaagacatctgccggtgttaacatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagcgtggcccttgcaccccatgtcggcctgggtttggagaccagaacagaaacttggatgagctccgagggggcctggaaacagatccagagggtggaaccttgggctctccggcacccaggattcaccgttattgcactgtttctggcccatgctatcggcacatctattacccagaagggcatcatattcatcctcttaatgctggtgacgccctcgatggccatgcgctgcgtcgggattggatcaagagcgtttgtggagggtcttagcggcgcaacttgggtagatgttgtgttggagcacgggagttgtgtcacaaccatggccaaggacaaacctactctggatatcgaactactcaagacagaggtgaccaacccagctgtgctgaggaaactttgcattgaagccaagatctccaatacgaccacagactctcggtgtcccactcaaggagaggcaaccctgatggaagaacaagatgctacattcgtctgccgccgaacttttgttgacagaggctggggtaacgggtgtggattgttcggcaaaggcagcctcataacctgcgccaagtttaagtgcgtgacaaaactggaggggaagattgtacagtacgaaaatttaaaatattccgtgatcgtcaccgtgcacactggagatcagcatcaagttggtaacgagtcaacggaacacggcacaaccgcgactattacccctcaggccccaacaagtgagatccagctgccggactacggggcactcacccttgactgtagccccaggactggactggatttcaatgaaatggtgttgctaacaatgaaggagaaatcttggctggtccataagcagtggtttctcgacctgcctcttccatggacgtccggcgcttcaaccagccaagagacttggaaccggcaggatctgttggtgacattcaaaaccgcccacgctaagaagcaggaagtagttgtgctcggtagtcaagagggggccatgcacacaggcctgactggagcaaccgaaatccagacgtctggcaccacaactatttttgccgggcatttaaaatgccgtctgaagatggacaaactaaccctcaagggaatgtcctatgtcatgtgtacaggtagcttcaaactggagaaggaagtggctgagactcagcacggcaccgtccttgtgcagataaagtacgaggggacggatgcgccctgcaaaatccctttctcgacacaagacgaaaagggagttacccagaatggccgcttgattactgcaaacccaatcgtgacagataaagagaagcccgtaaatatagaagccgagccgccttttggtgagtcttatattgtcatcggggctggcgaaaaagccctgaagctctcctggttcaagaaaggatcaagtatcggcaagatgtttgaggcaaccgccagaggggctaggcggatggccattctgggagacactgcatgggatttcggtagcgtgggcggggtttttacctccgtgggaaaacttgtccatcagatcttcggcacagcgtacggtgtgctgttttctggggtaagctggacgatgaagattggcataggagtgttgctcacctggctgggcttaaactcacgaagtacttccctgagcatgacatgtatcgctgttgggctagtcaccctctacctgggagtgatggtgcaggccgactctggctgcgtcattaattggaaaggtcgcgaacttaagtgtgggtcaggaatcttcggcacaaacgaggttcacacttggaccgaacaatataagtttcaggcagatagtcccaaaagattgagcgccgctatcggtaagccatgggaggagggcgtgtgcgggattaggtccgccacgcggctggaaaatataatgtggaaacagatctctaacgagctcaaccatattctgttagaaaatgacatgaagttcacagtggtagtcggagacgtggttggcatcctggcacaggggaaaaagatgattcgccctcaacccatggagcacaaatactcgtggaaaagctggggaaaggctaagatcataggcgccgatgtgcagaacaccacttttatcattgacggtccaaatacccccgaatgtcctgatgaccagagagcgtggaacatctgggaggtcgaggattatgggttcggaatttttacaactaatatctggcttaagttgagggactcccacacccaggtgtgcgatcatcgtctcatggccgctgcaataaaagaccggaaggccgttcacgctgatatgggctactggattgaatcagagaaaaacgaaccatggaagctggcccgagcaagtttcatcgaggtgaagacatgtatttggccgaaatctcatacgctatggagcaatggtgtactggaatccgagatgatcatacccaagatctatggcgggcctatttcacaacacaactacagaccaggatatttcacccagactgcgggcccctggcacctcgggaaactggagcttgactttgatttgtgcgaaggaacaaccgtcgtggtggacgagcattgcggcaataggggtcctagcctgcgcactacaaccgtcacggggaagatcattcacgaatggtgttgccggtcttgtactttaccacccctcagattcaaaggagaggatggctgctggtacggtatggagatcaggccggttaaggaaaaggaggaaaacctggtgaaatccatggtaagtgccggcagcggggaggtggactctttttcccttggactgttgtgtatatcaattatgatcgaagaggtcatgcgcagtcgatggagccggaagatgctcatgaccggcacactggctgtgttcctactgctcatcatggggcagctgacctggaatgaccttattcgtttgtgcatcatggttggagccaacgcatcggatagaatgggcatgggtactacatacctggctttaatggccacctttaaaatgaggcctatgttcgcagtggggctcctgtttcgccggcttacatccagagaggtcctgctactcactattggactgtctttggtggccagcgttgaactgccaaattcattagaggaactcggcgacggcctggctatggggataatgatccttaagctgttgaccgatttccaaagtcatcagctctgggcgacgctgctatccctgacatttattaaaaccactctttctctccactatgcctggaagaccatggcaatggtgctgagcatcgtctccttgttccccctgtgtttatcaacaactagccagaagaccacgtggctccctgtactgcttggaagtctgggttgcaaacccttgacaatgtttctcattaccgagaacaagatctggggcaggaaatcttggccactgaatgaagggataatggctgtgggagttgtgtccatcctactgagctcgcttctcaagaacgacgtccctctggccggccccttgattgccggtgggatgttaatcgcttgttacgtgatttcaggatctagtgcagatctgtccctcgagaaagccgcggaggtaagctgggaagaggaagctgagcattctggcgccagccacaacatcctggtggaagtccaggacgatggcactatgaagataaaagacgaggagcgagatgacacacttaccattctgttgaaggcaactctactggccgtttccggggtgtatccactctcaatcccggctacactgttcgtgtggtacttttggcaaaagaaaaagcagcgcagtggagtcctttgggatacccctagtcccccagaagtggagcgggcagttttagacgatggtatctatagaattatgcagaggggcctgctcgcccgttctcaggtaggggtgggagtcttccaagaaaatgtgttccacacgatgtggcatgttactcgcggcgcggtgttgatgtaccagggtaaacggctggagccctcctgggcttcagtcaagaaagacctcataagttatgggggaggctggagactgcagggcagctggaacaccggggaggaagtgcaggtaatcgccgtcgagcctggaaagaatccaaagaacgtgcaaacagcacccggtacctttaaaacacctgaaggcgaggttggggccattgctcttgacttcaagccgggaacttccggctctccaatcgtgaatagggaaggtaaaattgtcgggctgtacggaaacggcgtggttaccacgtcgggcacatacgtgagcgccatcgcacaggctaaggcctcacaggaggggcccttgcctgagatagaagatgaggtctttcgaaaacggaatctaactatcatggacctgcacccaggatccggtaagacccgcagatatctccccgcgattgtgagggaagccatcaagcggaaattacgaacactgattcttgcacctaccagagtagtggctagtgagatggccgaagctctgaagggcatgccgatccgctaccaaactaccgcagttaaatctgagcatacagggaaggagatagtcgatctcatgtgccacgccacgttcactatgaggttgctgagccccgtgcgtgtgccaaactataatatgattatcatggacgaagcccattttaccgatccttcctcaatcgctgcgcggggatacatttctacaagagtcggcatgggtgaggcagccgctatcttcatgaccgccactcccccagggagcgtagaagcatttcctcagagtaacgccgtgatacaggacgaggaaagggatattcccgagcgctcctggaatagcggatatgagtggatcacagacttcccaggcaaaaccgtttggtttgtgccgtctattaagtcaggcaacgatatcgctaattgtctccgaaagaacgggaaaagagtcatacagctgtcccggaagacgttcgacactgaataccagaaaacaaagaataacgattgggactatgtggttaccaccgacattagtgagatgggagcgaactttagggccgatcgcgtgatcgaccctcgtagatgccttaaacccgtcatcctaaaggatggtccagaacgggtgattctggcaggccccatgcctgtaactgtggctagcgccgcacagaggcgcgggcgaatcggaagaaatcacaacaaggagggcgaccagtacatttacatgggtcagccattgaataacgatgaggaccacgcccattggacagaagctaaaatgttactggataatataaacacccccgaggggatcattcctgccctcttcgaaccggagcgggaaaagtcggcggcaatcgacggcgagtataggctgcgcggagaggccagaaaaacattcgttgaacttatgaggcggggcgatctgccagtctggctctcttacaaggtggcttccgaggggtttcaatatagcgaccgtcgctggtgcttcgatggagaacgaaataaccaggtgttggaggaaaatatggacgtcgagatctggactaaagagggtgaaagaaagaaactgaggccccggtggctagatgcccgcacgtactcagaccctctggctctcagagagtttaaggagttcgcagccggcaggcggagtgtttctggggaccttattctggagataggaaagttaccccagcacttgacccagcgagctcaaaacgccctggataatctcgtgatgctgcataactccgaacagggcggtagagcatatcgccacgcgatggaggagcttccagacacaatcgaaactctgatgctcttggccctgattgctgtattaaccgggggcgtgacactatttttcctgagcggaaggggcctcgggaaaacctcaatcggacttctgtgtgtcatggccagtagcgtgttgctgtggatggcatccgttgagcctcactggattgctgcctctatcatactcgaatttttcctgatggtgcttctcatccccgagccagatcggcagcgtactcctcaggacaatcaactggcatacgtcgtaattggtttgctgtttatgatcttaacggtggccgctaacgagatgggcctactggaaaccacaaagaaagatctcgggattggacatgttgcggtggagaatcaccatcacgccactatgcttgacgtcgatctgcatccggcaagcgcttggaccttgtatgccgtggccacaaccatcataactcccatgatgagacacacaattgaaaacacgaccgcaaacatctccctgactgctattgccaatcaggcggctatcctcatgggcctggacaagggttggccaatatcaaaaatggatatcggggtccctcttttagccctgggctgctactctcaggtgaaccccctcacattgaccgcagccgttctgatgctagtggctcactacgcaattatcggaccaggcctgcaagccaaggcgaccagggaggctcagaagcgcacagccgcagggattatgaaaaatcctactgtagacggaatcgtggccatagatctcgaccccgtcgtttatgatgctaagttcgaaaaacagcttggccagattatgctgttgatcctgtgtacgagtcaaatcctcctgatgcggaccacatgggccttatgcgagtcgattactcttgcaaccggtccgctgacaaccctctgggaggggagcccaggaaagttttggaacactacgatcgctgtgtccatggccaatatattccgaggctcttacctagcgggtgccggcctggcattttcattgatgaaaagcctagggggaggcagaagggggacaggagctcagggcgaaaccctcggtgagaagtggaagcgccagcttaaccagctgtccaaaagtgagttcaatatttataagcggtctgggatcatggaggtcgacagaagcgaagccaaagagggattgaagcgtggcgagactaccaggcatgcagtgtcacggggtacagctaaactgcgctggttcgtagaacgaaacctcgtgaagcctgagggcaaggttattgacttagggtgtggaagaggcgggtggtcctactattgcgccggactgaaaaaggtgactgaagtcaaaggctacaccaagggtgggcccggacacgaggaaccaatccccatggccacatatggctggaatcttgtgaaactgcatagtggcaaggatgtctttttcacgcctccggagaaatgtgacaccctactctgcgatataggggagagctctcccaacccaactatcgaagagggaaggacactgcgggtgttgaagatggttgaaccttggctgcgcggtaatcaattttgtattaagatcctcaacccctacatgccttccgtagtggagacccttgagcagatgcagagaaaacacggcgggatgctggtcaggaatccattatcacgaaacagcactcacgaaatgtactgggtgtcgtgcggaacaggcaatattgtttctgcggtgaacatgaccagtcggatgctgttgaatcgtttcacgatggctcatagaaagcccacctatgagcgcgacgtcgatctcggtgcagggacaaggcacgtggccgtagaacctgaggtggctaacctggacatcattggacagcggatcgaaaacataaaacatgagcacaagtccacttggcattacgatgaggacaatccatataaaacctgggcctaccacggcagctatgaagttaagccctcaggctccgcatctagcatggtcaacggggtggtgaagctacttacaaaaccgtgggatgtcattcctatggttactcaaatcgccatgaccgacacaaccccatttggacagcagagagtgttcaaggagaaagtagatactcgcacgcccaaggctaaaaggggtacagcgcaaatcatggaagtgaccgcccgatggctgtggggctttctcagtcggaataagaagcctagaatttgtactagggaggagttcacccgcaaagtccgttccaacgcagctataggggccgtgtttgttgacgagaatcagtggaacagcgcaaaggaggccgtggaagacgagcggttctgggatctggtccagaaagaaagagagttgcacaagcagggaaaatgcgctacatgcgtgtacaatatgatgggcaagagggaaaagaaactgggtgagtttgggaaggccaaaggatctcgcgcgatctggtatatgtggctcggcgcacgattccttgagtttgaagccctgggcttcatgaacgaggaccattggttctcacgggaaaatagtttatccggggtagagggagagggtctgcacaagttgggctacattctcagagatatcagcaaaattccagggggaaacatgtacgctgacgatacggccggctgggacaccaggatcactgaagatgacctgcaaaatgaggcaaagataacagatatcatggaacccgagcatgctctacttgccacctctatttttaaactgacttatcagaacaaggttgtgcgcgtccagagaccggctaagaatggtacagtgatggacgtgatctcgcggagggatcagcgtgggtcaggacaagtcggcacctacggcctcaacacattcactaatatggaagcccagctgattcgacagatggagagcgaggggatctttttgccttccgaattagagacccccaacctggcagaacgcgttctcgactggcttgagaaatatggagtggaaagactgaagcggatggcgataagtggtgatgactgtgtagtgaaaccaattgacgataggttcgccacggctctaaccgccctgaacgacatgggcaaggtccgcaaagatatccctcagtgggagccctctaaggggtggaatgactggcaacaggtgccattttgcagccaccacttccatcagctcatcatgaaggatggaagagagattgttgtgccctgtcggaaccaggacgaattggtcggcagggcacgagtgtcccaaggtgctgggtggtcactgcgtgagacagcctgccttggaaaaagttacgcacagatgtggcagctgatgtattttcacagacgcgatctccggttagccgcgaatgctatatgttctgccgtacctgttgactgggtgccaactagcaggaccacatggtccatccatgcacaccatcaatggatgactaccgaagatatgctgtcagtctggaacagagtgtggattgaggaaaatccgtggatggaggacaagacgcacgttagctcttggggcgatgtgccctacttgggcaaacgcgaggaccagtggtgcgggtccctgatcggactcacagcccgggctacctgggccagtaacattcaggtcgcaatcaatcaggtgaggcgacttataggtaacgaaaattatctggactacatgactagcatgaagagattcaaaaacgagggcgatcctgaaggggctctatggtga

SEQ ID NO: 13960 - RNA, 9879 nt, synthetic construct
  misc_feature 1..9879: note = derived and/or modified CDS sequence (opt3) from DENV-1__HM488256__SS-prME
  source 1..9879: mol_type = other RNA
agcgtgaccatgctgctcatgcttatgcccacagccctggctttccacttgactacgcgaggaggggaacctcatatgatcgtctccaagcaggaaaggggaaaatctttactgtttaagacctcagccggtgttaacatgtgcacattgattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcccatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactgctcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgccagactacggggcgctcactcttgattgtagcccgaggacaggactggacttcaacgaaatggtcttgctaacgatgaaggagaaatcttggctggtgcataagcagtggtttctcgatctgccccttccttggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaatccagacctctggaacaactaccatttttgcaggccatttaaaatgccgtctgaagatggataaactaacactcaaggggatgtcctatgtgatgtgtactggcagcttcaaactggagaaggaacttgccgagacccagcacggtacggtcttggtgcagataaagtacgagggcacagacgctccatgcaaaatccccttctcgacccaagatgaaaagggggttactcagaacggacgcctgattacagcgaatcctatcgtgaccgacaaagagaagccagtaaacatagaagcagagcccccgtttggcgagtcttatattgtcatcggtgccggggaaaaagctctcaagctgtcctggttcaagaaaggctcaagtatcggaaagatgtttgaggccactgcaagaggcgccaggcggatggctattcttggggcccctgcatgggatttcggaagcatcggtggcgtgtttacctccgttgggaaactggtgcatcagattttcggaacagcgtacggcgtcttgttttctggtgtgagctggacgatgaagatagggatcggcgtactcctgacctggttaggactaaattcacgaagtacttccctaagcatgacatgtattgctgtgggcctcgttaccctgtaccttggggtcatggtgcaggccgactctggatgcgtgatcaactggaaaggccgcgaattgaagtgtggttcagggatcttcgtcacaaatgaggttcacacttggaccgaacaatataagtttcaggcagatagtcccaaaagactgagcgccgctattggaaaggcctgggaggagggcgtgtgcggtataaggtccgcaacgcggctcgaaaacatcatgtggaaacagatttctaacgagctgaatcatatcttactggaaaacgacatgaagttcacagtggtagtcggcgacgtggctgggattcttgcccagggcaagaaaatgatccgcccacaacctatggagcacaaatactcgtggaaaagctggggcaaggcgaaaataatcggggccgatgttcagaataccacttttattatcgacggacccaacaccccagaatgtcccgatgaccagagagcttggaatatttgggaggtggaggattatggcttcggtatctttacaactaacatatggttgaagctcagggactcctacacccaggtctgcgatcaccgtctgatgtcagcagccattaaagacagtaaggctgtgcatgccgatatggggtattggatcgaatctgagaaaaatgaaacatggaagctagcacgggcgagcttcattgaggttaagacgtgtatctgggccaaatcccacaccctgtggtcaaacggagtgctcgaaagcgagatgataatccctaagatttacggcggtccaatctctcaacataattatcgaccgggctacttcactcagacagctgggccctggcacctgggaaaacttgagttggactttgatctgtgcgaaggcaccactgtagtcgtggacgagcactgcgggaacagaggaccttccttaaggacaaccacggtgactggcaagattatccatgaatggtgttgccgcagttgtaccctcccacccctgcggttcagaggtgaggatgggtgctggtacggaatggagataagccctgtcaaagaaaaggaggaaaatcttgttaagtctatggtgtccgccggctcaggtgaggtagacagttttagcctgggcttgctctgtatttcgatcatgatcgaagaggtgatgaggtcccgctggtctcgaaaaatgctgatgacagggaccctagcagtcttctttctgctcattgtgggacagctgccatggaacgaccttatccggttgtgcattatggttggcgctactgccagcgcacgtatggggatgggaacaacctcactggccttaatggctacattcaagatgagacccatgtttgcggtgggcctcctgttcaggcgccttacaagtcgggaggtcctgctactcaccataggtctgtccttggtggcctctgttgaactgccgaatagcttagaggaactcggggatggactggcaatgggcatcatgattcttaaactgttgacggactttcaatcccaccagctctgggctacactgctatcactgaccttcatcaagactacctttagccttcattatgcctggaaaacaatggccatgggcctcagtgtggtctctctgttccctttgtgtctgtccactaccagccagaagacgacatggttaccagtactcctggggtcgcttggatgcaagcccctgaccatgtttttgattgctgagaacaaaatctggggtagaaggtcatggcctctcaatgaaggcataatggcagtggggatcgtttctattctgctaagttccctgcttaagaacgatgtgcccctcgccggaccactgatcgcgggcggtatgttgattgcttgttacgtcatcagcgggtctagcgccgacttatccctggagaaagcagccgaggtgtcatgggaagaggaagctgagcacagtggagcaagccataacatactcgtagaagtgcaggatgacggcactatgaagattaaagatgaggagcgagacgatacactgaccatccttctgaaggccactttgctagcggtctctggcgtttatcctctgtccatccccgctacactcttcgtgtggtacttctggcagaagaagaagcagcgctcaggggtgctgtgggacaccccaagtccgcctgaagtcgagcgggccgtgcttgatgacggaatttatagaataatgcagaggggtttactgggccgtagccaggttggggtaggagtgtttcaagaaaatgtcttccacacgatgtggcacgtgactcgcggcgcagttctcatgtaccagggtaaacggttggagccctcctgggcctctgtgaagaaagatctgatctcgtatgggggaggctggagactccagggcagctggaacaccggggaggaagtccaggtgattgctgtagagccaggaaagaatcccaaaaacgtccaaacagcccctggtacctttaagacaccagaaggcgaggtgggggcaatcgctctggacttcaagcccggaacttcaggctcccctattgttaatagggaaggtaaaatcgtggggctttacggaaacggcgtcgtgaccacgagtggcacatacgtttctgccatagcgcaggccaaggcaagccaggaggggccgctgccagagatcgaagacgaggtgtttcgaaaacggaatttgactattatggatctacatcccggatccggtaagacccgcagatatctgcctgctatcgtcagggaagccattaaacggaagctccgaacattaatcctggctccaaccagagtggtagcatcagagatggccgaagcccttaagggcatgcccatacgctaccaaactaccgctgtgaaatctgagcacacagggaaggagattgttgacctgatgtgccatgcgacgttcactatgaggctcttgagccctgtccgtgtgccgaactataatatgatcatcatggatgaagcacactttaccgaccccagttccattgccgctcggggatacatcagcacaagagtgggcatgggtgaggccgcagccatattcatgaccgctactccacctgggtctgtcgaagcgtttccccagtcaaacgccgtaattcaggatgaggaaagggacatcccagagcgctcctggaatagtggatatgagtggattacagatttccctggcaaaaccgtgtggtttgttcccagcatcaagtcgggcaacgacatagcaaattgtctgagaaagaacgggaagagagtgattcagctctctcggaagacgttcgatactgaataccaaaagactaagaataacgactgggattatgtcgtgaccaccgacatctccgagatgggagctaacttcagggccgaccgcgttatcgatccacgtagatgcctgaaaccggtgattcttaaggacggtcctgaacgggtcatcctagcaggccccatgccagtgactgtagccagcgctgcccagaggcgcgggcgaattggaagaaatcataacaaagagggcgatcagtacatatacatgggtcagcccctgaataacgacgaggatcacgcgcactggacagaagcaaagatgttgttagacaatatcaacacccctgaggggattatcccagccctgtttgaacccgagcgggaaaagtcagctgccatcgatggcgagtataggctccgcggagaggctagaaaaacattcgtggaactgatgaggcggggcgaccttcctgtttggctgagttacaaggtcgcatctgaggggtttcaatattccgatcgtcgctggtgcttcgacggagaacgaaataaccaggtgctcgaggaaaatatggatgtggagatttggactaaagagggtgaaagaaagaaattgaggccgcggtggctggacgcccgcacgtacagcgatccactagctctgagagagtttaaggagttcgccgcaggcaggcggtcagtcagtggggacctcatacttgagatcggaaaactgccccagcatttaacccagcgagcgcaaaacgccttggacaatctggttatgctccacaacagcgaacagggcggtagagcttatcgccatgccatggaggagctgcctgatacaattgaaactcttatgctgctcgcattgatcgctgtgctgaccgggggcgtaacattatttttcctatccggaaggggcctggggaagacctctattggactcctttgtgtgatggccagctccgtcctgttgtggatggcatcagtggagccccactggatcgccgcttctataatcctggaatttttcctcatggttctgcttattccagagcctgaccggcagcgtactccccaggataatcaactcgcgtacgtggtcatcggtctgttgtttatgattctgacggtagccgcaaacgagatgggcttactagaaaccacaaagaaagacctggggatcggacacgtggctgttgagaatcatcaccatgccgccatgctcgatgtggaccttcacccagcaagtgcttggactctgtatgccgtcgcgaccacaataattacccctatgatgagacatactatcgaaaacacaacggctaacatttcgttgaccgccatcgcaaatcaggccgctatactgatgggcctcgataagggttggccgatcagcaaaatggacattggggtgcccctgcttgcattaggctgctactcccaggtcaacccactgactctcacagccgcggtgttgatgctggttgctcactacgccatcattggacctggcctacaagcaaaggccaccagggaggctcagaaacgcaccgccgcagggatcatgaagaatcccacagtggatggaatagtagctattgacctggatccagtggtctatgacgccaagttcgaaaaacagctcggccagatcatgcttctgatcttgtgtacttctcaaattctgctcatgcggacgacctgggcgctgtgcgagtcaatcacattagccactggtcctcttaccacactgtgggaggggagccccggaaagttttggaacaccactatagcagtttccatggctaatattttccgaggcagttacctcgccggtgcaggcctagctttctctctgatgaaaagcctagggggaggcagaagggggacgggagcccagggcgaaacactgggtgagaagtggaaacgccagctcaaccagctttcaaagtccgaatttaatacctataagcggagtgggatcatggaggtggatagaagcgaagccaaagagggactgaagcgtggcgagactaccaaacacgcggtctctaggggtacagctaagttgcggtggttcgtggaacgcaacctggtaaaaccggagggcaaggtgattgacctcgggtgtggacgaggcgggtggtcctactattgcgcaggattaaagaaagttactgaagtgaagggctacaccaaaggtgggccaggacatgaggaacctatccccatggccacatatggctggaatctggtcaaacttcactcaggcaaagacgtgtttttcataccacccgagaagtgtgatacgctgctatgcgacatcggggagagctcgcctaacccgaccattgaagagggaagaactctcagggtcctgaaaatggtggaaccctggttgcggggtaatcaattttgtatcaagattctgaacccatacatgccttctgttgtagagacactcgagcagatgcagcgcaagcatggcgggatgcttgtgagaaatcccctgagtaggaactccacccacgaaatgtactgggtcagctgcggaactggcaatatcgtgtcagctgttaacatgacatcccgaatgttactgaatcggttcaccatggcccaccgtaaacctacgtatgagagagatgtggacttgggtgcagggacccgccatgtcgccgtggaaccagaggtagctaacctcgatattatcggacagaggatagaaaacattaagcacgagcataaatctacatggcactacgacgaggataatccctataagacttgggcgtaccatggcagctatgaagtgaaacctagtggctccgccagctctatggttaacggggtcgtgaagctgctaaccaagccatgggacgtgatccccatggtcacacaaatcgcaatgactgataccacaccgtttggacagcagcgggttttcaaagagaaggtggacaccagaactcctaaagctaagcgcggtacggcccaaattatggaagtaacagcaaaatggctttggggctttctgtcaaggaataagaagccacgaatatgtacccgggaggagttcactagaaaagtgaggagtaacgccgctatcggggccgtctttgtggatgagaatcagtggaactccgcgaaggaggcagttgaagacgagcgcttctgggacctcgtgcaccgtgaacgggagctgcacaaacagggaaagtgcgcaacctgcgtctacaatatgatgggcaaaagagaaaagaagttgggtgagtttgggaaagctaagggaagcagggccatttggtatatgtggctgggcgcacgcttcctcgagttcgaagctcttggctttatgaacgaggatcattggttctctcgagaaaattcgctgtcaggggtggagggagagggtttacacaaactgggctacatcttgcgggacattagcaagatccccgggggaaacatgtacgccgatgacacagctggctgggatacgagaataaccgaagacgatctccagaatgaggccaggatcactgacattatggaacctgagcatgcactgctagcgaaatccatctttaaacttacatatcaaaacaaagtagttcgcgtgcagagaccagccaagaatggtaccgtcatggatgtgattagtcggagggaccagcgtgggtctggacaggtgggcacttacggcctgaacacattcaccaatatggaagctcaactcatccgacagatggagagcgaggggatattttccccctcagaactggagacaccgaacttggccgaacgcgtcttagattggctggagaagtatggagttgaaagactcaaacggatggcaattagtggtgacgattgtgtggtaaagcctatcgacgacaggttcgctactgcccttaccgcactgaacgatatgggcaaagtgcgcaaggacatcccccagtgggagccatctaaagggtggaatgattggcagcaagtccctttttgcagccaccacttccatcagctaattatgaaggacggaagagagatagtggttccctgtcggaaccaggatgaactggtgggcagggcccgagtctcccagggtgcggggtggtcactccgtgagacggcttgcttgggaaagagctacgcccaaatgtggcagctgatgtattttcacagacgcgaccttcggctggcagccaatgctatctgttctgccgtgccagtagattggattcccacctccaggacaacttggagtatccatgcacaccatcagtggatgaccacagaagacatgctcagcgtttggaacagagtgtggattgaggaaaatccttggatggaggataaaactcacatctcgtcctggggcgacgtcccatacttaggcaagcgcgaggatcaatggtgcgggtctctgataggattgaccgctcgggccacgtgggcgacaaacatccaggtggctattaatcaggttaggcgactgatcggtaacgaaaattatctcgactacatgacctcaatgaaaagattcaagaacgagagcgacccggaaggcgccctttggtga

SEQ ID NO: 13961 - RNA, 9879 nt, synthetic construct
  misc_feature 1..9879: note = derived and/or modified CDS sequence (opt3) from DENV-1__GU131793__SS-prME
  source 1..9879: mol_type = other RNA
agcgtgaccatgctgctcatgcttatgcccacagccctggctttccacttgactacgagaggcggggaacctcatatgatcgtctccaagcaggaaaggggaaagtctttactgtttaagacctcagccggtgttaatatgtgcacactaattgccatggacctcggcgaactgtgtgaagatactatgacctacaagtgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgacgactcagaagggcattatcttcatactcttaatgctggtgacaccatcaatggctatgcgctgcgtcgggatcggaagcagagattttgtggagggtcttagtggcgccacctgggtagacgttgtgttggagcacgggtcctgtgtcactacaatggcgaaggataaacccaccctggacattgaactactcaagacggaggtgaccaaccctgcagtgctgaggaaactttgcatcgaagccaagatttctaatacaactaccgatagccggtgtccaacacaaggagaggctactctggtcgaagaacaggacgccaacttcgtttgccgccgaacctttgtggatagaggctggggtaatgggtgtggattgttcggcaaaggctccctcatcacatgcgcaaagtttaagtgcgtaaccaaactggaggggaagatagtgcagtacgaaaacttaaaatattcagtcattgtgactgttcacacgggagaccagcatcaagtgggtaatgagagtacagaacacggcaccactgctaccatcacaccccaggcccctaccactgagattcagctgacagactacggggcgctcacgcttgattgtagcccaaggaccggactggacttcaacgaaatggtcttgctaactatgaaggagaaatcttggctggtgcataagcagtggtttctcgatctgccgcttccctggacatccggcgcctcaaccagccaagagacatggaatcggcaggacctgttggtaactttcaaaaccgcacacgctaagaagcaggaagttgtggtcctcggtagtcaagagggggccatgcacacggctctgaccggcgccacagaaatccagacttctggaaccacaactatctttgcaggccatttaaaatgccgtctgaagatggataaactaaccctccgcgggatgtcctatgtgatgtgtacggggagcttcaagctggagaaagaagtcgccgagacacagcacggtaccgtgcttgttcagattaagtacgagggcactgacgctccttgcaagataccattctcgacacaagatgaaaaaggggtgacccagaacggaagattgatcactgcgaatcccattgtaaccgacaaggagaaacctgtcaacatcgaagcagagccaccctttggcgagtcttatatagtgattggtgccggggaaaaggctctgaaactctcctggttcaagaagggctcaagtatcggaaaaatgtttgaggccacagcaaggggcgcccggcgaatggctatcctgggggatacggcctgggacttcggaagcattggtggcgtttttacctccgtggggaaacttgtccatcagatcttcggaactgcatacggcgtgctgttttctggtgtaagctggacaatgaaaattgggataggcgtgttgctcacctggctgggattaaattcacgcagtacatccctgagcatgacttgtatcgcggttggcctagtcaccctctacctgggggtgatggtgcaggctgattctggatgcgtcattaactggaagggcagagaacttaaatgtggttcagggatcttcgttacgaatgaggtgcacacatggaccgaacaatataagtttcaggccgacagtccgaagaggttgagcgcagccatcggaaaggcttgggaggagggcgtgtgcggtattcggtccgccactcgcctggaaaacataatgtggaagcagatctctaacgagctcaatcatattctgttagaaaacgacatgaaattcaccgtagtcgtgggcgatgttgcagggatcctggctcagggaaagaaaatgattagacctcaacccatggagtacaagtattcgtggaaaagctggggcaaggccaagatcataggggcggacgtgcagaatacaacttttatcattgatggaccaaacacccctgaatgtcccgacgatcagagggcctggaatatctgggaggtcgaggactacggcttcggtatttttacaacgaacatctggcttaaattgcgtgattcctatacccaggtgtgcgaccaccggctcatgtcagctgcaataaaggatagtaaagccgttcacgctgacatggggtactggattgaatctgagaagaatgaaacttggaaactggcccgagcatccttcatcgaggtgaagacatgtatttggccaaagtcccataccctatggtcaaacggagtactggaaagcgagatgatcatacccaaaatctatggcggtcctatttctcaacacaattacagaccaggctacttcactcagacagcggggccgtggcatctcggaaagctggagcttgattttgacttgtgcgaaggcaccacggtcgtggtggatgagcactgcgggaacaggggaccctccctgcgcactaccacagtcaccggcaaaatcattcacgaatggtgttgccggagttgtactttacctccactcagattcaggggtgaggacgggtgctggtatggaatggagatccgccccgttaaggaaaaagaggaaaatctggtaaagagcatggtatctgccggctccggtgaggtggactcatttagtcttggcctgttgtgtataagcattatgatcgaagaggtcatgcgatcgcggtggtcccgtaagatgctcatgacagggaccctggctgtgttctttctactgatcatgggacagctcacatggaacgatctgattagactttgcatcatggttggcgccaatgcatctgacaggatggggatgggaactacctacttggctctgatggccacgttcaaaatgcgccctatgtttgcagtgggcttactcttccggagactgacaagcagggaggtccttctgctaaccattggtctctcactggtggccagtgttgaattgccaaactccctggaggaattaggggatggactcgctatgggcataatgatcctgaaacttctgactgactttcaatctcatcagttgtgggcgaccctcctgagcctaacattcattaaaactaccttttccctgcactgtgcctggaagacgatggcaatggtgctttcaatcgtcagcctcttccccctgtgcttgagtacaacctctcagaaaactacatggctgccggtattactcggctccctggggtgtaagcctcttaccatgtttctgattgctgagaataagatctggggacgacgcagctggccattgaacgaaggtataatggccgtgggcatcgtttcgattctcctgtcatctctactgaaaaacgatgtgccccttgccgggcctctcatcgctggaggcatgctgattgcatgctatgtcatcagtggttccagcgccgacttgtctttagagaaggcggctgaggtgagctgggaagaggaagccgagcattccggggcatcacacaatatactggtagaagtgcaggatgacggaactatgaaaattaaggatgaggagcgggacgatacactcaccatcctgcttaaagccacgctgttggctgtcagtggcgtttaccccctaagcatcccagcaactctgttcgtgtggtatttctggcaaaagaaaaagcagagatctggcgtgctctgggacaccccttcacccccagaagtcgagagggccgtgctggatgacgggatttaccgtataatgcagcgcggacttttaggtcggagccaggttggcgtaggggtgtttcaagaaaacgtcttccatacaatgtggcacgtgaccagaggagcggttctgatgtatcagggcaagaggctcgagccgagttgggctagcgtgaaaaaggacttgatctcctacggtgggggatggcgactgcagggctcttggaatacaggcgaggaagtccaggtgattgccgtagagcctgggaaaaaccccaagaatgtccaaactgcaccaggaacctttaaaacgcccgaaggtgaggtgggcgccatcgctctcgatttcaagcctgggacatcgggaagcccaattgttaaccgggaaggcaagatcgtgggtctgtacgggaatggagtcgtgactacctcaggcacatatgtttccgccatagcacaggctaaagccagtcaggagggcccccttcctgagatcgaagacgaggtgtttcgcaagagaaacctgaccattatggatttgcacccggggtctggaaaaactaggcggtacctaccagcgatcgtccgagaagccattaagagaaaactgcgcaccctcatcttagcacccacaagggtggtagctagcgagatggccgaagctctgaagggtatgcctatacgttatcaaacgactgcagtgaagtccgagcataccggcaaagagattgttgaccttatgtgtcacgccacattcaccatgcggctgctctcaccagtcagagtgcccaattacaacatgatcatcatggatgaagcccattttactgacccttctagcattgctgcgagggggtatatcagtacacgcgtgggaatgggcgaggcagccgctatattcatgaccgccacgccgcccggttccgtcgaagcatttccacagagcaatgccgtaattcaggatgaggaacgagacatccctgagagatcttggaactcagggtacgagtggattactgatttccccggaaagacagtgtggtttgttccatccatcaaaagtggcaatgacatagctaactgcttgcggaagaatggcaaaagggtgattcagctgagccgcaagaccttcgataccgaatatcaaaagactaaaaacaacgactgggactacgtcgtgacaaccgatatctcggagatgggggcgaatttccgtgccgacagagttatcgatcctcggaggtgcctcaagcccgtgattctgaaagacggaccagaacgcgtcatccttgcaggtccgatgcctgtgacagtagcttctgccgcacagcgaagaggccggattgggaggaaccacaataaggagggagatcagtacatatatatgggccagcccctaaacaatgacgaggatcatgcccactggactgaagctaaaatgctgttggacaacatcaatacgccagagggtattatccccgccttatttgaacctgagcgcgaaaagtccgcggcaatcgatggggagtacagactgaggggcgaggcccggaagaccttcgtggaactcatgcgtcgcggagacctgccagtttggcttagctataaagtcgcttcagagggctttcaatacagtgatcgaagatggtgtttcgacggggaaaggaacaatcaggtgctggaggaaaacatggatgtggagatttggacaaaggagggagaacggaaaaagctccgccccagatggttggacgccaggacttattctgaccctctggctctacgggagtttaaagagttcgcagccggtcgaagatccgtcagcggcgatctgatactcgagatcgggaaacttccgcagcacctgacccagcgcgctcaaaatgccttagacaacttggttatgctgcataattcagaacagggaggcagggcataccggcacgcgatggaggagctcccagatacaattgaaaccctgatgcttctggccctcatcgctgtgttgactggtggggtaacgctgtttttcttaagtggccgtggactaggcaaaaccagcattgggctgctctgcgtgatggcctcctctgtccttctgtggatggcaagcgtggagccccattggatcgctgcctccataatcttggaatttttcctgatggttctcctgattcctgagcccgacaagcagagaacaccacaggataaccaacttgcatatgtggtcatcggactcctgtttatgattttgactgtagccgctaatgagatgggtctgttagaaaccacaaagaaagacctaggcatcgggcacgtggcggttgagaaccaccatcacgccgcaatgctggatgtggacctccatcctgcttcagcctggaccctttacgccgtcgcaactacaataattacgcccatgatgaggcacaccatcgaaaacactacagctaatatttctctgaccgccatcgcgaaccaggctgccatattgatgggactggataagggctggccaatcagtaaaatggacattggtgtgcctctcctggcacttgggtgttactcgcaggtcaatccgttaaccctgacagccgctgtgctcatgttggttgcacattatgccatcattggccccggactgcaagcgaaggctactcgcgaggcccagaaacggacggcagccggcatcatgaagaacccaaccgtggatgggatagtagctattgacctagatcctgtggtctacgacgccaagttcgaaaaacagctgggacagatcatgctccttatcctgtgcacaagccaaattttgctgatgcgaactacctgggcactctgtgagtccatcacactggctaccggccccttaactacgctttgggagggttctccagggaagttttggaatacaaccatagccgtttcaatggcgaacattttcagaggaagctatctggccggcgcaggtctcgctttctccctaatgaaaagtctgggcgggggaaggcgcggcactggggcccagggagaaaccttgggcgagaagtggaaacggcagctgaatcagctctctaagagcgaatttaacacatacaagagatcaggtatcatggaggtggaccgttccgaagcaaaagaggggcttaagaggggagagactaccaaacacgctgtcagtcggggcacagccaagctgcgctggttcgtggaacgaaatttggtaaaacctgagggtaaggtgattgatctgggctgcgggagaggaggctggagctattactgtgccgggctcaagaaagttacggaagtgaagggatataccaaaggcggtcccgggcacgaggaaccgatcccaatggcgacttacggatggaacttagtcaagctgcattctggcaaagacgtgtttttcatacctcccgagaagtgcgatacacttctgtgtgacatcggcgagtcctcaccaaatcccaccattgaagaggggaggactctacgggtcctcaaaatggtggaaccttggctgcgcggaaaccaattttgcatcaagattttgaatccgtacatgcccagcgttgtagagacactggagcagatgcagagaaagcacggtggcatgctcgtgaggaacccactttcgcgaaattctacccatgaaatgtattgggtcagttgtgggacgggaaacatcgtgtccgctgttaatatgaccagccggatgctgttaaaccgtttcacaatggcacacagaaaacctacttacgagcgcgatgtggacctgggcgccggtaccaggcacgtcgctgtggaacccgaggtagccaacttggatattatcgggcagcggatagaaaatattaagcatgagcacaaatcaacatggcattatgacgaggataacccttacaagacttgggcatatcacggatcctacgaagtgaaaccatctggcagcgccagttccatggttaatggcgtcgtgaagctcctgaccaagccctgggacgtgatccctatggtcacacaaatcgctatgaccgatactacgccatttgggcagcagagagttttcaaagagaaggtggacacacgcacccccaaagcgaagaggggaactgcccaaattatggaagtaaccgcaaaatggctatggggttttcttagccgaaacaagaagccgcggatatgcacaagagaggagttcacgaggaaagtgcgctctaatgctgccatcggcgcagtctttgtggacgagaaccagtggaactcagccaaggaggctgttgaagatgagcgtttctgggacctggtgcatcgggaaagagagctccacaaacaggggaagtgcgccacctgtgtctataacatgatgggaaaaagggaaaagaagctgggcgagtttggtaaagcgaaggggagtcgcgcaatttggtacatgtggttgggagcccgattcctggagttcgaagctctcggctttatgaatgaggatcactggttctcccgggaaaacagcctttctggcgtggagggggagggactgcataaattaggttacatcctgagagacatttcgaagatccctggcgggaatatgtatgccgatgacactgcaggatgggatacaaggataaccgaagacgatttgcagaacgaggctcgcatcactgacattatggaaccagagcacgccctcctggctaaatcaatctttaagctaacataccaaaataaagtagttagagtgcagcggcccgccaagaacggcaccgtcatggatgtgattagcaggcgtgaccagcgaggttccggacaggtgggaacatatggccttaatactttcaccaacatggaagcacaactgatccgccagatggagagtgagggcatattttctcctagcgaactcgagacgccaaacctggcggaaagagtcttggattggttagagaagtacggggttgaacggctgaaaaggatggccatttccggagacgactgcgtggtaaagcccatcgatgaccgcttcgctaccgccctcacagcacttaatgatatgggtaaagtgagaaaggacatcccgcagtgggagccttcaaaaggctggaacgattggcagcaagtccccttttgtagtcatcacttccaccagctgattatgaaggacgggcgggagatagtggttccatgcaggaatcaggatgagctagtgggacgagctcgtgtctctcagggcgccggttggagcctgagagagactgcatgtctcgggaagtcctatgcccaaatgtggcagttgatgtactttcatcgccgggacctgaggcttgcggctaacgccatctgctcagcagtgcctgtagattggattcccaccagcagaacaacttggtctatccacgcccatcaccagtggatgaccacggaagacatgctgtccgtttggaatcgcgtgtggattgaggaaaacccatggatggaggataaaacacatatcagtagctggggagacgtcccctatctcggcaagcgggaggaccaatggtgtggctcgttaatagggctgaccgctagggccacttgggcaacaaatatccaggtggctattaaccaggttcgaagattgatcggaaatgaaaactacctggattacatgacctccatgaaacggttcaagaatgagtctgaccctgaaggtgccctctggtga

SEQ ID NO: 13962 - RNA, 9879 nt, synthetic construct
  misc_feature 1..9879: note = derived and/or modified CDS sequence (opt3) from DENV-1__GU131794__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatgctagcgaccgtatggggatgggaacaacctacttggccctgatggcaacattcaaaatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaagcttctgacggactttcaaagccatcagttgtgggccacactcctgtccctaaccttcatcagaactaccttttcactgcactatgcatggaaaacaatggctatggtgcttagcattgtcagtctcttccccctgtgtttgtctactacctcccagaagacgacatggctgccggtattactcggcagcctggggtgcaagcctcttaccatgtttctgatcgccgagaataaaatatggggaaggaagtcgtggccattgaacgaaggtatcatggccgtgggcattgtttcaatcctcctgtctagtctactgaaaaacgatgtgccccttgctgggcctctcattgcaggaggcatgctgatcgcctgttacgtcatatccggtagctctgcggacttgagcttagagaaggctgccgtggtatcctgggaggaagaggcagaacattcaggggccagtcacaatattctggtggaggtccaggatgacggaactatgaaaatcaaggatgaagagcgagacgatacactcaccatcctgcttaaagctactctgttggcagttagcggcgtgtatcccctatctattccagccacactgttcgtgtggtacttctggcaaaagaagaaacagcgctccggcgtcctctgggacaccccttcacccccagaggtggaacgggcggttctggatgacgggatatatagaatcatgcagaggggacttttaggtcgtagtcaggtaggcgtgggggtctttcaagagaacgtgttccatacgatgtggcacgttactcgcggagctgtgctgatgtaccagggcaagcggctcgaaccgagctgggcctccgtcaaaaaggacttgatttcttacggtgggggatggagactgcagggctcgtggaataccggcgaggaggtgcaggtaatcgcagtcgaacctgggaaaaaccccaagaatgtgcaaacagccccaggaacctttaagacaagcgagggtgaagttggcgctattgccctcgatttcaaacccgggacttcaggatcccctatcgtgaacagggagggcaagatagtcggtctgtatgggaatggagtggttaccacgagtggcacatacgtgtctgcaatcgctcaggccaaagcgagccaggaaggcccacttcccgagattgaggacgaagtctttcgaaagcggaacctgactatcatggatttgcaccctgggtccggaaaaacccgcagatatctaccggccattgtgagggaggcaatcaagcggaagctgcgaacactcatattagctccaaccagagtagtggcctcagaaatggctgaggcactgaaaggtatgcccattcgctaccaaactaccgccgttaagtctgaacatacaggcaaagagatcgtcgaccttatgtgccacgccacgttcactatgaggctgctcagccctgtgcgtgtgccaaattataacatgatcattatggatgaggctcattttaccgaccccagttccatcgcggcacgggggtacataagcacaagagtcggaatgggcgaagccgctgccattttcatgaccgcaactcctccgggttctgtagaggcctttccccagtcaaatgctgtgatccaggatgaagagagggacattccagaacgctcctggaacagtgggtatgagtggatcacagatttccctggaaagaccgtttggtttgtgcccagcataaaatcgggcaatgacattgcgaactgtttgcgaaagaatggcaagagagtcatccagctgtctcggaaaacgttcgatactgagtaccaaaagacaaaaaacaacgactgggactacgtggttaccaccgatatctccgaaatgggggccaatttcagggcagaccgcgtgattgatccacgtagatgcctcaagcctgtcatcctgaaagacggacccgagcgggtgattcttgctggtccaatgccggtaactgtggccagcgcagcccagaggcgcggccgaatagggagaaaccacaataaggaaggagatcagtatatctacatgggccagcctctaaacaatgacgaggatcatgctcactggacagaggccaagatgctgttggacaacattaatacccccgaaggtatcatcccagcgttatttgagcccgaacgggagaaatcagcagccattgatggggaatataggctgcgcggcgaggctagaaagacattcgttgagctcatgaggcggggagacctgcctgtctggcttagttacaaagtggcctctgaaggctttcaatattccgatcgtcgctggtgcttcgacggggagcgaaacaatcaggtgctggaagagaacatggatgtcgaaatatggactaaggagggagagagaaaaaagctcaggccacggtggttggacgctcgcacgtacagcgaccccctggcactaagagaatttaaagagttcgccgctggtaggcggtcaatcagtggcgatctgattctcgaaatcgggaagcttcctcagcacctgacccagcgagcccaaaatgcattagacaacttggttatgctgcataatagcgagcagggaggcagagcgtatcgccacgccatggaagagctcccggatacaattgagactctgatgcttctggctctcatcgccgtgttgaccggtggggtaacactgtttttcttatccggcaggggactaggcaagacctctatagggctgctctgtgtgatggcaagctccgtccttctgtggatggcttcagtggaaccacattggatcgccgcatctattatcttggagtttttcctgatggttctcctgattcccgaacctgaccggcagcgtactccccaggataaccaacttgcctacgtggtcatcggactcctgtttatgatattgacggtagctgcgaatgagatgggtctgttagagaccacaaaaaaggacctaggcattgggcacgtggccgttgaaaaccaccatcacgcagctatgctggatgtggacctccatccagccagtgcctggactctttacgcagtcgctaccacaatcattacccctatgatgagacacactatcgagaacacaacggccaatatatcgctgaccgcgatcgctaaccaggccgcaattttgatgggactggataaaggctggcccatcagcaagatggacattggtgtgccactcctggcccttgggtgctattcccaggtcaatcctttaactctgacagctgcagtgctcatgttggttgcccattacgcgatcataggcccgggactgcaagctaaagccaccagggaagcacagaagcgcaccgccgctggcattatgaagaaccccacagtggatgggatcgtagccatcgacctagatccagtggtctatgacgcaaaattcgagaagcagctgggacagattatgctccttatcctgtgtacttctcaaatattgctgatgcggacgacctgggctctctgcgaatcaattacactggccactggccctttaaccacactttgggagggtagccccgggaaattttggaataccactatcgcggtttccatggccaacattttccgaggaagttacctggcaggcgctggtctcgccttctctctaatgaagagcctgggcgggggaagaaggggcacgggggcacagggagagacattgggcgaaaaatggaagcgccagctgaatcagctctcaaagtccgagtttaacacctataaacggagtggtatcatggaagtggacagaagcgaggctaaggaagggcttaaacgtggagagactaccaagcacgccgtctctaggggcacagccaaactgcggtggttcgtggagcgcaatttggtaaagccagaaggtaaggtgatagatctgggctgtgggcgaggaggctggtcctactattgcgcggggctcaaaaaggttactgaggtgaaaggatacaccaagggcggtcctgggcacgaagagcccatcccgatggctacatacggatggaacttagtcaaactgcattcaggcaaggacgtgtttttcattccacctgaaaaatgtgatacgcttctgtgcgacatcggcgagagctcgcccaatccaaccattgaggaagggagaactctaagggtcctcaagatggtggagccctggctgcggggaaaccaattttgtatcaagattttgaatccttatatgccgtctgttgtagaaacactggagcagatgcagcgcaaacacggtggcatgctcgtgagaaacccccttagtaggaattccacccatgagatgtactgggtcagctgcgggactggaaacatcgtgtcagcagttaatatgacatcccgaatgctgttaaaccggttcaccatggcccaccgtaagccaacgtatgaaagagatgtggacctgggcgctggtacccgccacgtcgccgtggagcctgaagtagcaaacttggatataattgggcagaggatcgagaatatcaaacatgaacacaagtctacatggcattacgacgaggataacccctataaaacttgggcctaccacggaagctatgaggtgaagcctagtggctccgctagctctatggttaatggcgtcgtgaagctcctgaccaaaccatgggacgtgattcccatggtcacacaaatagcgatgactgataccacaccttttgggcagcagcgggttttcaaggaaaaagtggacaccagaactccaaaggccaaacgcggaacggcacaaatcatggaggtaacagctaagtggctatggggttttctttcaaggaacaagaaaccccgaatttgtacccgggaagagttcactagaaaggtgaggagtaatgccgcaatcggcgccgtctttgtggacgaaaaccagtggaattccgctaaagaggccgttgaggatgaacgcttctgggacctggtgcatcgtgagcgggaactccacaagcaggggaaatgcgcgacctgcgtctacaacatgatgggaaagagagagaagaaactgggcgaatttggtaaggcaaaagggagcagggccatttggtacatgtggttgggagctcgcttcctggagttcgaggccctcggctttatgaatgaagatcactggttctctcgagagaactcgctttcaggcgtggaaggggagggactgcataagttaggttatatcctgcgggacataagcaaaatcccgggcgggaatatgtacgcagatgacacagctggatgggatacgagaattaccgaggacgatttgcagaacgaagccaagatcactgacattatggagcctgaacacgctctcctggccaaatccatctttaagctaacatatcaaaataaggtagttagggtgcagcgcccagcaaaaaacggcaccgtcatggatgtgataagtagacgggaccagaggggttctgggcaggtgggaacttacggccttaatacattcaccaacatggaggcgcaactgattcgtcagatggaaagcgagggcatcttttccccctcagagctcgaaacacctaacctggccgggcgagtcttggattggttagagaagcatggagttgaacgcctgaaaagaatggctatcagtggtgacgactgtgtggtaaagccaattgatgaccggttcgccactgcactcaccgctcttaatgatatgggcaaagtgaggaaggacataccccagtgggagccgtctaaggggtggaacgattggcagcaagtccctttttgcagccaccacttccatcagctgatcatgaaagacggacgcgaaattgtggttccctgtagaaatcaggatgagctagtgggccgggccagggtctcccagggtgcagggtggtcactgcgagagacggcctgcctcggaaagagctatgcgcaaatgtggcagttgatgtactttcaccgtagagacctgcgccttgctgccaacgcaatctgttctgccgtgccagtagattgggttcctacctcccggacaacttggagtattcatgctcaccatcagtggatgaccacagaagacatgctgagcgtgtggaatagggtctggatcgaggaaaacccctggatggaggataaaactcacatatcgtcctggggcgacgtgccatatctcggcaagagagaagaccaatggtgcgggtctttaatcggactgaccgcccgcgcaacgtgggctacaaatattcaggttgccatcaaccaggtgcggaggttgctgggtaatgagaactacctcgattacatgacctcaatgaaacgattcaagaatgagagcgaccccgaaggcgcgctttggtga

SEQ ID NO: 13963 - RNA, 9879 nt, synthetic construct
  misc_feature 1..9879: note = derived and/or modified CDS sequence (opt3) from DENV-1__GU131796__SS-prME
  source 1..9879: mol_type = other RNA
agcgtgacaatgctgctcatgcttatgcccacagcactggctttccacttgactacgcgaggcggggaacctcatatgatcgtctccaagcaggaaaggggaaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccgatcctgccgtgctcaggaaactgtgcgtcgaagctaagatttctaacacgaccacagacagccggtgtccaactcaaggagaggccacccttgttgaagaacaagatgcaaattttgtgtgccgccgaacattcgtagacagaggctggggtaacgggtgtggactgtttggcaaaggctccttgatgacttgcgctaagttcaagtgcgtgaccaaactcgaggggaagatcgtccagtacgaaaatctgaaatattcagtgatagttacagtgcacaccggagaccagcatcaagtcggtaacgagagtactgaacacggcacgacagccaccattactccccaggcgcctagcaccgagatccagttaacagattacggggccctgaccctcgactgttctccaaggactggacttgattttaatgaaatggtgctgttgacaatgaaggagaaatcctggctagtacataagcagtggttcctggacctcccgctgccctggacgtcaggcgcaagcaccagtcaagagacttggaaccggaaagatcttctggttacatttaagaccgctcacgccaagaaacaggaagtggtcgtgttgggttctcaggagggggctatgcacacagccctcactggcgcaaccgaaattcaaacgtccggaaccacaactatcttcgccggccatctgaagtgccgtttaaaaatggacaagctgaccctaaaagggatgagctatgtcatgtgtacaggatcgttcaagctcgagaaggaagtggctgagactcagcacggtaccgttctggtgcagatcaaatacgagggcacggatgcgccttgcaagattccattttctacacaggacgaaaaaggggtaacccaaaatggacgccttataactgcaaaccccatcgtcacagataaggagaaacctgtgaatattgaagccgagccacccttcggcgagtcctatatcgttataggtgctggggaaaaggccttgaagctgtcatggtttaaaaagggcagtagcattggaaaaatgttcgaggcaaccgccagaggcgctaggcggatggccatcctcggggacactgcatgggattttggatccatcggtggcgtgttcacctctgtcgggaagctggtgcatcagatttttggaacagcgtacggcgtacttttcagcggtgtgtcatggacgatgaaaatcgggattggcgttctgttgacctggctcggactgaacagtcgatccactagcttatctatgacatgtatagctgtcggcctggtgaccctatacctcggggtgatggtccaggccgactcaggatgcgttatcaattggaagggccgcgaactgaagtgtggtagtgggatttttgtgacaaacgaggtgcacacttggaccgaacagtataaattccaagcagacagcccgaagagactttccgccgctatcggaaaagcctgggaggagggcgtatgcggtatcaggtctgcaacgcggttggaaaatattatgtggaagcagatatcgaacgagctgaaccatatcctcctggaaaatgatatgaaattaacagtcgtggttggcgacgtggctgggattctggcccagggaaagaaaatgatccgccctcagcccatggagtacaagtatagctggaagtcctggggcaaagcgaagattatcggggccgatgtccaaaacaccacttttataatcgacggaccaaatacccctgaatgtcccgatgaccagagagcttggaacatttgggaggtggaggattacggcttcggtatctttacaactaatatttggcttaaattgagggactcatatacccaggtttgcgatcaccgtctcatgagtgcagccatcaaggactctaaagctgtgcacgccgatatggggtactggatagaaagcgagaagaacgaaacatggaagctggcacgggcgtccttcattgaggtaaaaacgtgtatctggccaaagtcacataccctatggagcaatggagtcctggaatctgagatgattatccccaaaatatatggcggtcctatctcccagcacaactaccgaccaggctacttcactcaaacagccgggccgtggcatctcggaaagctggagcttgactttgatttgtgcgaaggcaccactgtggtggtcgacgagcactgcgggaatagaggacccagtctgaggacaaccacggttactggcaaaattatccacgaatggtgttgccgcagctgtaccttacctccactccggttcaagggtgaggacgggtgctggtatggaatggagattagacccgtgaaggaaaaagaggaaaacctggtaaagtctatggtgtccgctggctcaggtgaggtcgatagttttagccttggcctgttgtgtatctcgataatgattgaagaggtgatgaggtcccgctggtctcgaaaaatgctcatgacagggaccctggccgttttctttctactgatcatgggacagctcacttggaatgacctgatccggctttgcattatggtgggcgcaaacgctagcgatcgtatggggatgggaacaacctacttggccctgatggcaacattcaagatgagacctatgtttgccgtcggcttactcttcaggcgcctgacttcacgggaggtgcttctgctaaccatcggtctcagtctggttgcttccgtggaattgccaaattctctggaggaattaggggacggactcgcgatgggcattatgatactgaaacttctgacggattttcagagccatcaattgtgggccacactcctgtccctaaccttcatcaagactacctcaagcctgcactatgcatggaagacaatggctatggtccttagtattgtatctctctttcccctgtgtttgtccactaccagccagaaaacgacatggctgccggtgttactcggctcgctggggtgcaagcctcttaccatgttcctgatcgccgagaacaaaatttggggaagaaagtcatggccattgaatgaaggtatcatggccgttggcatagtgtctatcctcctgagtgctctactgaaaaacgacgtcccccttgcagggcctctcattgccggaggcatgctgatcgcgtgttacgtgatttccggtagctctgctgatttgagcttagagaaggccgcagaggtatcctgggaagaggaagccgagcattcaggggctagtcacaacatcctggtggaagtccaggacgatggaactatgaaaataaaggacgaggagagggatgacacactcaccattctgcttaaggcaactctgttggccgttagcggcgtgtatcccctatctatcccagcgacactgtttgtgtggtacttctggcagaaaaagaaacaacgatccggcgtcctctgggataccccttcacccccagaagtggagcgcgctgttctggacgacgggatctatcggattatgcagagaggacttttaggtaggagtcaggtaggcgtgggggtcttccaggaaaatgtgtttcatacgatgtggcacgttactcgtggagccgtgctgatgtaccaaggcaagcgcctcgagccgagctgggcatccgtcaaaaaggatttgatatcttacggtgggggatggcggctgcagggctcgtggaacaccggcgaggaagtgcaggtaatcgccgtcgagcctgggaagaatcccaaaaacgtgcagacagctccaggaaccttcaagacaagcgaaggtgaggttggcgccattgcactcgactttaaacccgggacttcaggatcccctatcgtgaatagagaaggcaagattgtcggtctgtatgggaacggagtggttaccacgagtggcacatacgtgtctgctatcgcccaagcgaaagccagccaggagggcccacttcccgagatagaagatgaggtcttcaggaagcgaaatctgactatcatggacttgcaccctgggtccggaaagacccggcgctatctaccggcaattgtgagagaagctatcaaaaggaagctgcggacactcattttagccccaacccgagtagtggcttcagagatggcagaagccctgaaaggtatgcccatcagataccagactaccgccgttaagtctgagcatacaggcaaagagatagtcgatcttatgtgccacgctacgtttactatgcgcctgctcagccctgtgagggtgccaaactataatatgattatcatggacgaagcgcatttcaccgatcccagttccatcgcagcccgtgggtacattagcacacgggtcggaatgggcgaggctgccgcaatctttatgaccgccactcctccgggttctgtagaggctttcccccaatcaaacgcggtgatacaggacgaggaaagagatattccagagaggtcctggaatagtgggtatgagtggatcacagactttcctggaaagaccgtttggttcgtgcccagcattaagtcgggcaacgatatcgccaattgtttgcgcaaaaacggcaagcgagtcatacagctgtctagaaaaacgtttgacactgaataccagaagaccaagaataacgactgggattacgtggttaccaccgacatttccgagatgggggcaaacttccgggctgatagggtgatcgacccacgccgttgcctcaagcctgtcatcctgaaggatggacccgaaagagtgattcttgccggtccaatgccggtaactgtggcaagcgccgctcaacggaggggccgcatcgggcgaaatcacaacaaagagggagaccagtatatttacatgggccagcctctaaataacgatgaggaccatgcccactggacagaagcgaagatgctgttggataatataaacacccccgagggtatcattccagcattattcgaacccgagagagaaaaatcagccgctatcgacggggagtatcggctgaggggcgaggcccgcaagacatttgttgaactcatgagaaggggagatctgcctgtctggcttagttacaaagtggcttctgagggcttccagtattccgaccggcgttggtgctttgatggggaacgcaataaccaagtgctggaggaaaatatggacgtcgagatctggactaaggagggagaaaggaaaaagctcagaccaagatggttggacgcacggacgtacagcgatcccctggccctacgcgagttcaaggaatttgctgccggtagaaggtcagttagtggcgacctgattctcgagatagggaaacttcctcagcacctgacccagcgggcacagaacgcgttagataatttggtgatgctgcataacagcgaacaaggaggccgagcctatagacacgctatggaggagctcccggacacaatcgaaactctgatgcttctggccctcattgcagtattgaccggtggggtgacactgttctttttatccggccgcggactaggcaagacctctatcgggctgctctgtgtcatggctagctccgtgcttctgtggatggcctcagttgagccacattggattgcagcctctatcatattggagttctttctgatggtgctcctgatccccgagcctgataggcagcggactccccaggacaatcagcttgcttacgtcgtaattggactcctgttcatgatcttgacggtggcggccaacgagatgggtctgttagaaaccaccaaaaaggatctaggcattgggcacgttgcagtggagaatcaccatcacgctgccatgctggacgtcgatctccatccagccagtgcatggactctttacgctgtggccaccacaatcataacccctatgatgcgtcacactattgaaaacacaacggcgaacatctcgctgaccgctattgccaatcaagcagccatcttgatgggactggacaaaggctggcccataagcaagatggatatcggtgtcccactcctggctcttgggtgctattcccaggtgaaccctttaactctgacagcagccgttctcatgttggtggcgcattacgctattatcggcccgggactgcaggccaaggcaaccagagaggcccagaaaaggaccgctgccggcattatgaagaatcccacagtagacgggatcgtggcaatagatctagacccagtcgtttatgacgctaaatttgaaaagcagctgggacagattatgctccttatcctgtgtacttctcagatcttgctgatgcgcacgacctgggccctctgcgagtcaattacactggcgactggccctttaaccacactttgggagggtagccccgggaaattctggaacaccactatcgccgtgtccatggcaaatatatttcggggaagttacctggctggcgccggtctcgcattctctctaatgaaaagcctgggcgggggacgaagaggcacgggggctcaaggagaaacattgggcgagaagtggaaaaggcagctgaaccagctctcaaagtccgagttcaatacctataaacgcagtggtattatggaggtcgatcggagcgaagccaaggaggggcttaaaagaggagagactaccaagcacgccgtgtctcgtggcacagcgaagctgaggtggtttgtagaacggaacttggtgaaaccagagggtaaggttatcgacctgggctgtgggcgcggaggctggtcctactattgcgctgggctcaaaaaggtgactgaagtcaaaggatacaccaagggcggtcctgggcacgaggaacccattccgatggcaacatacggatggaatttagtgaaactgcattcaggcaaggatgtcttctttatcccacctgagaagtgtgacacgcttctgtgcgatataggcgagagctcgcccaacccaaccatcgaagaggggcgaactctaagagtgctcaaaatggttgaaccctggctgaggggaaatcagttctgtattaagatcttgaacccttatatgccgtctgtagtggagacactggagcaaatgcagcggaaacacggtggcatgctcgtccgcaatccccttagtagaaactccacccatgaaatgtactgggtgagctgcgggactggaaatattgtttcagccgtgaacatgacatccaggatgctgttaaatcgatttaccatggctcaccggaagccaacgtatgagcgtgacgtcgatctgggcgccggtaccagacacgtggcagtagaacctgaggtggccaacttggacatcattgggcagcgcatcgaaaacataaaacatgagcacaagtctacatggcattacgatgaggacaatccctataagacttgggcttaccacggaagctatgaagttaaacctagtggctccgcgagctctatggtcaacggcgtggtgaagctcctgaccaaaccatgggatgtcattcccatggttacacagatcgccatgactgacaccacacctttcgggcaacagagggtgtttaaggagaaagtagacacccggactccaaaggcaaagagaggaacggctcagatcatggaagtgacagccaaatggctatggggtttcctttcacgcaataagaaacccaggatttgtacccgagaggaatttactcggaaggtcagaagtaacgcagccataggcgctgtgttcgttgatgagaatcaatggaactccgccaaagaggcggtggaagacgagaggttttgggatctggtccatcgcgaacgtgagctccacaagcaggggaagtgcgcaacctgcgtgtacaatatgatgggaaaacgggaaaagaaactgggcgagttcggtaaggccaaagggagcagagctatctggtacatgtggttgggagccaggtttctggagttcgaagcactcggcttcatgaacgaggaccactggttttctcgcgaaaattcgctttcaggcgtagagggggagggactgcataagttaggttatattctgcgagatatcagcaaaattccgggcgggaacatgtacgctgacgatacagccggatgggacacgcggatcaccgaagatgacttgcagaatgaggctaagataactgatatcatggaacctgagcacgccctcctggcaaagtccattttcaaactaacatatcagaacaaggttgtgagagtccaaaggccagcgaaaaatggcaccgtgatggacgtgatcagtcgcagagatcagcggggttctgggcaggtcggaacttacggccttaacacatttaccaatatggaagcccagctgattaggcaaatggagagcgagggcatcttctccccctcagaactcgagacacctaacctggctgggcgtgttttggactggttagaaaagcatggagtggagcgactgaaacgcatggccataagtggtgacgattgtgtagtgaagccaattgacgatagatttgcagctgccctcactgcacttaacgacatgggcaaggtccggaaagatatcccccagtgggaaccgtctaaggggtggaatgactggcaacaggtgcctttctgcagccaccactttcatcaactgatcatgaaagatggaagggagattgttgtgccctgtcgcaaccaggacgagctagtcggcagagcccgggtgtcccagggtgcggggtggtcactgagggaaaccgcttgcctcggaaagagctatgcccagatgtggcaattgatgtacttccaccgacgtgatctgagacttgcagccaatgctatatgttctgccgtaccagttgactgggtgcctacgtcccgcaccacatggagtatccatgcacaccatcagtggatgactaccgaggatatgctgagcgtctggaaccgggtgtggattgaagagaatccctggatggaagacaaaacacacatctcgtcctggggcgacgttccatatctcggcaagagggaggatcagtggtgcgggtctttaattggactgactgctagagccacctgggcgacgaacatccaagtggctataaatcaggtccgccggttgatcggtaacgagaattacctggactacatgacatcaatgaagaggtttaaaaacgaaagcgatcccgagggcgccctctggtga

SEQ ID NO: 13964 - RNA, 9879 nt, synthetic construct
  misc_feature 1..9879: note = derived and/or modified CDS sequence (opt3) from DENV-1__GU131797__SS-prME
  source 1..9879: mol_type = other RNA
agcgtgaccatgctgctcatgcttatgcccaccgccctggctttccacttgactacgagaggcggggaacctcatatgatcgtctccaagcaggaaaggggaaagtctttactgtttaagacctcagccggtgttaatatgtgcacgctaattgccatggacctcggcgaactgtgtgaagatactatgacctacaagtgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctccgcgggatgtcctatgtgatgtgtaccgggagcttcaagctggagaaagaagtcgccgagacgcagcacggtacagtgcttgttcagataaagtacgagggcaccgacgctccttgcaagatcccattctcgactcaagatgaaaaaggggtgacacagaacggaagattgattaccgcgaatcccatcgtaactgacaaggagaaacctgtcaacatagaagcagagccaccctttggcgagtcttatattgtgatcggtgccggggaaaaggctctgaaactctcctggttcaagaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagtacaagtattcgtggaaaagctggggcaaggccaagataatcggggcggacgtgcagaataccacatttattatcgatggaccaaacactcctgaatgtcccgacgatcagagggcctggaatatttgggaggtcgaggactacggcttcggtatctttaccacaaacatatggcttaaattgcgtgattcctatacacaggtgtgcgaccaccggctcatgtcagctgcaattaaggatagtaaagccgttcacgctgacatggggtactggatcgaatctgagaagaatgaaacctggaaactggcccgagcatccttcattgaggtgaagacttgtatctggccaaagtcccatacactatggtcaaacggagtactggaaagcgagatgataatccccaaaatttatggcggtcctatctctcaacacaattacagaccaggctacttcacccagactgcggggccgtggcatctcggaaagctggagcttgattttgacttgtgcgaaggcacaaccgtcgtggtggatgagcactgcgggaacaggggaccctccctgcgcacgactaccgtcacaggcaaaattatccacgaatggtgttgccggagttgtaccttacctccactcagattcaggggtgaggacgggtgctggtatggaatggagatacgccccgttaaggaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattatgggacagctcacctggaacgatctgatcagactttgcattatggttggcgccaatgcatctgacaggatggggatgggaacaacttacttggctctgatggccaccttcaaaatgcgccctatgtttgcagtgggcttactcttccggagactgacgagcagggaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaaaacaactttttccctgcactgtgcctggaagaccatggcaatggtgctttcaattgtcagcctcttccccctgtgcttgagtacgacatctcagaaaaccacttggctgccggtattactcggctccctggggtgtaagcctcttacaatgtttctgatcgctgagaataagatatggggacgacgcagctggccattgaacgaaggtatcatggccgtgggcattgtttcgatcctcctgtcatctctactgaaaaacgatgtgccccttgccgggcctctcattgctggaggcatgctgatcgcatgctatgtcataagtggttccagcgccgacttgtctttagagaaggcggctgaggtgagctgggaagaggaagccgagcattccggggcatcacacaatattctggtagaagtgcaggatgacggaaccatgaaaatcaaggatgaggagcgggacgatactctcacaatcctgcttaaagccaccctgttggctgtcagtggcgtttaccccctaagcattccagcaacgctgttcgtgtggtatttctggcaaaagaaaaagcagagatctggcgtgctctgggacactccttcacccccagaagtcgagagggccgtgctggatgacgggatataccgtatcatgcagcgcggacttttaggtcggagccaggttggcgtaggggtgtttcaagaaaacgtcttccataccatgtggcacgtgacaagaggagcggttctgatgtatcagggcaagaggctcgagccgagttgggctagcgtgaaaaaggacttgatttcctacggtgggggatggcgactgcagggctcttggaataccggcgaggaagtccaggtgatcgccgtagagcctgggaaaaaccccaagaatgtccaaacagcaccaggaacttttaaaacccccgaaggtgaggtgggcgccattgctctcgatttcaagcctgggacgtcgggaagcccaatcgttaaccgggaaggcaagatagtgggtctgtacgggaatggagtcgtgacaacttcaggcacctatgtttccgccatcgcacaggctaaagccagtcaggagggcccccttcctgagattgaagacgaggtgtttcgcaagagaaacctgacaatcatggatttgcacccggggtctggaaaaaccaggcggtacctaccagcgattgtccgagaagccatcaagagaaaactgcgcactctcatattagcacccaccagggtggtagctagcgagatggccgaagctctgaagggtatgcctattcgttatcaaacaacggcagtgaagtccgagcatactggcaaagagatcgttgaccttatgtgtcacgccaccttcacaatgcggctgctctcaccagtcagagtgcccaattacaacatgatcattatggatgaagcccattttaccgacccttctagcatcgctgcgagggggtatataagtactcgcgtgggaatgggcgaggcagccgctattttcatgacagccaccccgcccggttccgtcgaagcatttccacagagcaatgccgtaatccaggatgaggaacgagacattcctgagagatcttggaactcagggtacgagtggatcacggatttccccggaaagactgtgtggtttgttccatccataaaaagtggcaatgacattgctaactgcttgcggaagaatggcaaaagggtgatccagctgagccgcaagacattcgataccgaatatcaaaagaccaaaaacaacgactgggactacgtcgtgactacagatatctcggagatgggggcgaatttccgtgccgacagagttattgatcctcggaggtgcctcaagcccgtgatcctgaaagacggaccagaacgcgtcattcttgcaggtccgatgcctgtgaccgtagcttctgccgcacagcgaagaggccggatagggaggaaccacaataaggagggagatcagtacatctatatgggccagcccctaaacaatgacgaggatcatgcccactggacagaagctaaaatgctgttggacaacattaatactccagagggtatcatccccgccttatttgaacctgagcgcgaaaagtccgcggcaattgatggggagtacagactgaggggcgaggcccggaagacgttcgtggaactcatgcgtcgcggagacctgccagtttggcttagctataaagtcgcttcagagggctttcaatacagtgatcgaagatggtgtttcgacggggaaaggaacaatcaggtgctggaggaaaacatggatgtggagatatggaccaaggagggagaacggaaaaagctccgccccagatggttggacgccaggacatattctgaccctctggctctacgggagtttaaagagttcgcagccggtcgaagatccgtcagcggcgatctgatcctcgagattgggaaacttccgcagcacctgactcagcgcgctcaaaatgccttagacaacttggttatgctgcataattcagaacagggaggcagggcataccggcacgcgatggaggagctcccagataccatcgaaacactgatgcttctggccctcattgctgtgttgaccggtggggtaactctgtttttcttaagtggccgtggactaggcaaaacgagcatcgggctgctctgcgtgatggcctcctctgtccttctgtggatggcaagcgtggagccccattggatagctgcctccatcattttggaatttttcctgatggttctcctgatccctgagcccgacaagcagagaaccccacaggataaccaacttgcatatgtggtcattggactcctgtttatgatcttgacagtagccgctaatgagatgggtctgttagaaactaccaagaaagacctaggcatagggcacgtggcggttgagaaccaccatcacgccgcaatgctggatgtggacctccatcctgcttcagcctggacactttacgccgtcgcaaccactattatcacacccatgatgaggcacacgattgaaaacaccactgctaatatctctctgacagccatagcgaaccaggctgccatcttgatgggactggataagggctggccaattagtaaaatggacatcggtgtgcctctcctggcacttgggtgttactcgcaggtcaatccgttaaccctgaccgccgctgtgctcatgttggttgcacattatgccattatcggccccggactgcaagcgaaggctacacgcgaggcccagaaacggactgcagccggcataatgaagaacccaacggtggatgggattgtagctatcgacctagatcctgtggtctacgacgccaagttcgaaaaacagctgggacagatcatgctccttattctgtgcaccagccaaatcttgctgatgcgaacaacttgggcactctgtgagtccataaccctggctacaggccccttaaccactctttgggagggttctccagggaagttttggaatacgacaattgccgtttcaatggcgaacatcttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtattatggaggtggaccgttccgaagcaaaagaggggcttaagaggggagagacaactaaacacgctgtcagtcggggcaccgccaagctgcgctggttcgtggaacgaaatttggtaaaacctgagggtaaggtgatcgatctgggctgcgggagaggaggctggagctattactgtgccgggctcaagaaagttacagaagtgaagggatatacgaaaggcggtcccgggcacgaggaaccgataccaatggcgacctacggatggaacttagtcaagctgcattctggcaaagacgtgtttttcatccctcccgagaagtgcgatactcttctgtgtgacattggcgagtcctcaccaaatcccacaatcgaagaggggaggaccctacgggtcctcaaaatggtggaaccttggctgcgcggaaaccaattttgcattaagatcttgaatccgtacatgcccagcgttgtagagactctggagcagatgcagagaaagcacggtggcatgctcgtgaggaacccactttcgcgaaattctacacatgaaatgtattgggtcagttgtgggaccggaaacattgtgtccgctgttaatatgacgagccggatgctgttaaaccgtttcaccatggcacacagaaaacctacatacgagcgcgatgtggacctgggcgccggtactaggcacgtcgctgtggaacccgaggtagccaacttggatatcatagggcagcggattgaaaatatcaagcatgagcacaaatcaacctggcattatgacgaggataacccttacaagacatgggcatatcacggatcctacgaagtgaaaccatctggcagcgccagttccatggttaatggcgtcgtgaagctcctgactaagccctgggacgtgatccctatggtcacccaaattgctatgacagataccactccatttgggcagcagagagttttcaaagagaaggtggacacgcgcacacccaaagcgaagaggggaaccgcccaaataatggaagtaactgcaaaatggctatggggttttcttagccgaaacaagaagccgcggatctgcaccagagaggagttcacaaggaaagtgcgctctaatgctgccattggcgcagtctttgtggacgagaaccagtggaactcagccaaggaggctgttgaagatgagcgtttctgggacctggtgcatcgggaaagagagctccacaaacaggggaagtgcgccacgtgtgtctataacatgatgggaaaaagggaaaagaagctgggcgagtttggtaaagcgaaggggagtcgcgcaatctggtacatgtggttgggagcccgattcctggagttcgaagctctcggctttatgaatgaggatcactggttctcccgggaaaacagcctttctggcgtggagggggagggactgcataaattaggttacattctgagagacatctcgaagatacctggcgggaatatgtatgccgatgacaccgcaggatgggatactaggatcacagaagacgatttgcagaacgaggctcgcattaccgacatcatggaaccagagcacgccctcctggctaaatcaatttttaagctaacttaccaaaataaagtagttagagtgcagcggcccgccaagaacggcacagtcatggatgtgatcagcaggcgtgaccagcgaggttccggacaggtgggaacctatggccttaatacattcactaacatggaagcacaactgatacgccagatggagagtgagggcatattttctcctagcgaactcgagaccccaaacctggcggaaagagtcttggattggttagagaagtacggggttgaacggctgaaaaggatggccatctccggagacgactgcgtggtaaagcccatcgatgaccgcttcgctacggccctcaccgcacttaatgatatgggtaaagtgagaaaggacattccgcagtgggagccttcaaaaggctggaacgattggcagcaagtccccttttgtagtcatcacttccaccagctgataatgaaggacgggcgggagatcgtggttccatgcaggaatcaggatgagctagtgggacgagctcgtgtctctcagggcgccggttggagcctgagagagacagcatgtctcgggaagtcctatgcccaaatgtggcagttgatgtactttcatcgccgggacctgaggcttgcggctaacgccatttgctcagcagtgcctgtagattggatccccactagcagaaccacatggtctattcacgcccatcaccagtggatgactaccgaagacatgctgtccgtttggaatcgcgtgtggatcgaggaaaacccatggatggaggataaaacgcatataagtagctggggagacgtcccctatctcggcaagcgggaggaccaatggtgtggctcgttaatcgggctgacagctagggccacctgggcaactaatattcaggtggctatcaaccaggttcgaagattgattggaaatgaaaactacctggattacatgacatccatgaaacggttcaagaatgagtctgaccctgaaggtgccctctggtga

SEQ ID NO: 13965 - RNA, 9879 nt, synthetic construct
  misc_feature 1..9879: note = derived and/or modified CDS sequence (opt3) from DENV-1__GU131801__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctactcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggaagcttcaaacttgaaaaggaggtcgctgagacccagcacggtacggtgttggttcagattaagtacgaaggcacagatgcgccttgcaaaataccattctcgacccaagacgagaagggggtgactcagaacggacgcctgatcacagcaaatcccattgtaaccgataaagaaaagcctgtcaacatcgaggccgagccaccctttggcgaatcttatataggtattggggctggcgagaaagccctcaagctgtcctgggtgaagaaaggatcaagtatcggcaagatggttgaagcaactgccagaggggctaggcggatggccatccttggagacaccgcatgggatttcggtagcattggcggggtgtttacatccgtcggaaaactggtgcatcagatcttcggcacggcgtacggtgtattgttttctggggtgagctggaccatgaagattggcataggagttctcctgacttggttaggcctgaattcacgaagtacatccctaagcatgacctgtatcgctgtcgggctcgtgacactgtaccttggagtgatggtccaggccgactctggctgcgttattaactggaaaggtcgcgagttgaagtgtgggtcaggaatcttcgtgactaatgaagtgcacacctggacggagcaatataagtttcaggcagatagtccgaaaagactgagcgccgctatcggcaaggcctgggaggaaggtgtatgcggcattaggtccgcaacacggctcgagaacataatgtggaaacagatctctaacgaactgaatcatattttactggagaacgacatgaagttcaccgtcgtggttggggacgtggctggaatccttgtccagggcaaaaagatgattcgccctcaacccatggaatacaaatattcgtggaagagctgggggaaggccaaaatcataggagcggatgtgcagaattccacttttatcattgacggcccaaacacccctgagtgtcccgatgaccagagagcctggaatatctgggaggttgaagattacggtttcgggatttttacaactaacatctggttgaagctcagggactcatatacccaggtgtgcgatcaccgtctgatgagtgctgcaataaaagactctaaggccgtacacgctgatatgggatactggattgagagcgaaaaaaatgagacatggaagctagcccgggcatccttcatcgaagtcaagacgtgtatttggccaaaatcacataccctgtggagcaacggcgtgctcgagtctgagatgatcatacccaagatccacggtggccctatttcccaacataattatcgaccagggtactttactcagacagcgggaccgtggcacctgggcaaacttgaattggacttcgatctgtgcgaggggaccactgtggtcgttgacgaacactgcggaaacagaggccccagtttaaggacaaccacggtgactggtaagatcattcatgagtggtgttgccgcagctgtaccctccctccactgcggttcagaggggaggatggatgctggtacggcatggaaatcaggcccgtaaaagagaaggaagagaatcttgtgaagtctatggtctccgccggttcaggcgaagtggacagttttagcctggggttgctctgtatatcgattatgatcgaggaggttatgcgctcccgatggtctcggaaaatgctgatgacaggaaccctagctgtgttctttctgctcatcatgggccagctgacttggaacgaccttattcgtttgtgcatcatggtcggggccaatgcaagcgatagaatgggaatgggcacaacctatctggctttaatggccacattcaagatgaggcctatgtttgcagtgggtctcctgttccgccggcttacttcaagagaagttctgctactcaccattgggctgagtttggtggcctccgtcgagctgccaaactctttagaagagctcggagacggcctggctatgggcataatgatccttaaactgttgacggattttcaaagctaccagctctgggcgacactgctatccctgaccttcattaagactaccttttcacttcactatgcctggaaaacaatggcaatggtactcagcatcgtgagtctgttccccttgtgtctgtctactacctcccagaagacgacatggttaccggttctcctggggagccttggatgcaagcctctgaccatgtttttgattgctgaaaataaaatctggggtaggaagtcgtggccactcaacgagggcataatggccgtggggatcgtctcaattctgctatctagtctgcttaaaaacgacgtgcccctcgccggacctctgatcgctggcggtatgttgattgcatgttacgtaatctccgggagctctgccgatttaagcctggagaaggcggctgaagtgtcctgggaggaagaggccgaacattcaggagcaagtcacaatatactcgtcgaggttcaggacgatggcactatgaaaattaaggacgaggaacgagatgacacactgaccatccttctgaaagccactttgctagctgtgagcggcgtgtatcccctgtctatcccagcaacactcttcgtctggcatttttggcaaaagaagaaacagcgctccggggtgctgtgggataccccttcacccccagaggttgaacgggccgtacttgacgatggaatttacagaataatgcagaggggtttactgggccgtagtcaggtgggggtcggagtgttccaagagaacgttttccacacgatgtggcacgtgactcgcggcgcggtcctcatgtatcagggtaagcggttggagccgagctgggcttccgtgaaaaaggacctgatctcttacgggggaggctggagatttcagggctcgtggaataccggggaagaggtacaggtcattgccgtggaacctggaaaaaaccccaagaatgttcaaacagcaccaggtaccttcaagacacccgagggcgaagtgggggccatcgctctcgactttaaacctggaactagcggctcaccaattgtcaacagggagggtaagatcgtggggctgtacggaaatggcgttgtgaccacgtccggcacatatgtcagtgccatagcacaggctaaagcctctcaggaggggccccttcctgaaatcgaggatgaagtgttccgaaagcggaacctgactattatggacttgcatccgggaagcggtaaaacccgcagatacctaccagcgatcgtaagggaggccattaagcggaagctgcgaacactcatcttagcacccaccagagtggttgcttccgaaatggccgaggctctgaaaggcatgcctatacgctatcaaactaccgcagtcaagtcagagcacacagggaaagaaattgtggatcttatgtgccatgccacgtttactatgaggctgctctctccagtgcgtgtccccaattacaacatgatcatcatggacgaggcccacttcaccgatcctagcagtattgctgcgcggggatatatctccacaagagtaggcatgggtgaagcagccgctatatttatgaccgccactccgcccgggagcatggaggcattcccacagtctaatgccgtgattcaggacgaagagagggatatccctgagcgctcatggaactccggatacgaatggattacagactttcccggcaagaccgtttggttcgtgccaagtatcaaagctggcaatgatatagcgaactgtttgcgaaagaatgggaagagagtcattcagctgagccggaaaacgtttgacactgagtatcaaaagacaaaaaacaacgattgggactacgtggttaccaccgacatctcggaaatgggagccaatttcagggcagatcgcgtgatcgaccctcgtagatgcctcaagcccgtcattctgaaagatggtccagagcgggtgatccttgctggcccgatgcctgtaactgtggcctctgcagcccagaggcgcgggcgaattggaagaaaccataataaggagggcgaccagtacatatatatgggtcagcccctaaacaatgatgaagaccacgctcactggacagaggccaagatgctgttggataacatcaataccccagaagggattatccccgcgttattcgagcctgaacgggagaaatccgcagccatcgacggcgagtacaggctgcgcggagaagctagaaagacatttgttgagctcatgaggcggggcgatctgccagtctggcttagctataaagtggcctcagaagggttccaatacagtgaccgtcgctggtgctttgatggagagcgaaacaatcaggtgctggaagagaacatggacgtcgagatttggactaaggaaggtgagagaaaaaagctcaggccccggtggttggatgctcgcacgtattctgaccctctggcactaagagaattcaaagagtttgccgctggcaggcggtccgttagcggggacctgatactcgaaatcggaaagcttccgcagcatctgacccagcgagcccaaaatgcattagataacttggtgatgctgcacaattcagagcagggcggtagagcgtaccgccatgccatggaggaactcccagacacaattgagactctgatgcttctggctctcatcgccgtattgaccgggggcgtgacactgttctttttaagtggaaagggcctagggaaaaccagcattggactgctctgtgtcatggcatcctctgtgcttctgtggatggctagcgttgaaccccactggatcgccgcatccataatcttggagttctttctgatggtgctcctgattcctgagcccgataggcagcggactccacaggacaaccaacttgcctatgtcgtaatcggtctcctgttcatgattttgacggtggctgcgaatgaaatgggcctgttagagaccacaaagaaagatctagggatcggacacgttgccgtggaaaaccatcaccatgcagctatgctggacgtcgatctccaccctgcctcagcctggactctttacgcagtggctaccacaataattacccccatgatgcgtcatactatcgagaacacaacggccaatatttctctgaccgcgatcgctaaccaggccgcaatattgatgggcctggacaagggttggccaatcagtaaaatggatattggggtccctctcctggcccttggctgctactcgcaggtgaatccgttaactctgacagctgcagttctcatgttggtggcccactatgcgatcattggacccggcctgcaagctaaggccaccagagaagcacagaagaggaccgccgctgggatcatgaaaaacccaacaatagacggaattgtagccatcgatctagaccctgtggtctacgatgcaaagtttgagaaacagctgggccagatcatgctccttattctgtgtactagccaaatcttgctgatgcgcacgacctgggctctctgcgagtccataacactggccactggtcccttaaccacactttgggaagggtctccaggaaagttctggaataccactattgcggtttcaatggccaacatctttcggggcagctatctggcaggtgctggcctcgccttctccctaatgaaaagtctggggggaggccgaagagggacgggagcacagggcgagacattgggtgaaaagtggaagaggcagctgaatcagctctctaaaagcgagttcaacacctacaagcgctcagggattatggaagtggaccggtccgaggctaaagagggacttaagagaggcgaaactaccaaacacgccgtcagtcgtggtacagccaagctgaggtggtttgtggagcggaatttggtaaagcctgaaggcaaagtgatcgacctggggtgtggacgcggcgggtggagctattactgcgcgggactcaagaaagttactgaggtgaagggctataccaaaggtgggcccggacatgaagagccgataccaatggctacatacggctggaacttagtcaagctgcactctggcaaagatgtgttctttatccctcccgagaagtgtgacacgcttctgtgcgatattggggaatcctcaccaaatcccaccatcgaggaaggacgaactctaagagtcctcaagatggtggagccttggctgaggggtaaccaattctgtattaaaatcttgaatccgtacatgcccagcgttgtagagacactggaacagatgcagcggaagcatggcgggatgctcgtgcgcaacccactttcgagaaattctacccacgagatgtattgggtcagttgcggaactggcaacattgtgtccgcagttaatatgacaagcaggatgctgttaaaccgatttaccatggcccaccggaaacctacgtacgaacgtgacgtggatctgggtgctgggaccagacatgtcgccgtggagcccgaagtagcaaacttggacatcataggacagcgcattgagaatatcaagcacgagcataaatcaacatggcactatgatgaagacaacccttacaagacttgggcctatcatggctcctacgaggtgaagccatctggcagcgctagttccatggttaatggggtcgtgaaactcctgaccaagccctgggatgtgatccctatggtcacacaaattgcgatgactgacaccacaccattcggacagcagagggtttttaaagaaaaggtggatacccggactcccaaagccaagagaggtacggcacaaataatggaggtaacagctcgctggctatggggcttccttagcaggaacaagaaaccgcgaatctgtacccgggaagagtttactagaaaggtgaggtctaatgccgcaattggggccgtcttcgtggacgagaaccagtggaattcagctaaagaagccgttgaggacgatcgcttttgggacctggtgcaccgtgaacgggagctccacaagcagggaaaatgcgcgacctgcgtctataacatgatgggcaagagagaaaagaaactgggtgagttcgggaaggcaaaaggaagtagggccatctggtacatgtggttgggcgctcgctttctggagttcgaagccctcggcttcatgaatgaggatcattggttttcccgagaaaacagcctttctggggtggagggagagggtctgcacaagttaggctacattctgcgggacatctcgaaaatacctgggggaaatatgtatgcagatgacacagctggctgggatacgagaatcaccgaagacgatttgcagaacgaggccaagattactgacatcatggaaccagagcatgctctcctggccaaatcaattttcaagctaacataccaaaataaggtagttagggtgcagcgccccgcaaaaaacggtaccgtcatggatgtgatcagcagacgggaccagagggggtccggacaggtgggcacttatggccttaatacatttaccaacatggaagcgcaactgatacgtcagatggagagtgaggggattttcctccctaacgaactggagacaccaaatttggccggacgagtcttagattggctggaaaagtacggtgttgagcgcctcaaaagaatggctatctctggcgacgactgtgtggtaaagcccatcgatgaccggtttgccactgcacttaccgctctgaacgatatggggaaagtgaggaaggacattccgcagtgggaacctagcaagggatggaatgattggcagcaagtccccttctgctcccaccactttcatcagctaataatgaaagacggccgcgagatcgtggttccatgtagaaaccaggatgagctggtgggtcgggccagggtctcacagggggcaggatggagtctccgagaaacggcctgcttgggcaagtcttatgcgcaaatgtggcagctgatgtacttccaccgtagagaccttcgcctggctgccaatgcaatttgtagcgccgtgcctgtagattgggttcccacctcccggacaacttggtcaatccatgctcaccatcagtggatgaccacagaggacatgctcagcgtgtggaacagggtctggattgaagagaatccatggatggaagataaaactagaatctcttcctgggaggacgtgccctatttaggcaagcgcgaggaccaatggtgcgggagtctgataggattgaccgcccgggcaacgtgggctacaaacatccaggttgccattaatcaggtgaggcgactgatcggtaacgaaaattacagcgattacatgacctcgatgaaaagatttaagaacgagtccgaacctgagggcgcgctctggtga

SEQ ID NO: 13966 - RNA, 9879 nt, synthetic construct
  misc_feature 1..9879: note = derived and/or modified CDS sequence (opt3) from DENV-1__GU131804__SS-prME
  source 1..9879: mol_type = other RNA
agcgtgaccatgttcctgatgctcatgcccacagcacttgcttttcacctgactacgcggggaggggaacctcatatgatcgtctccaagcaggaaaggggaaaatctttgttattcaagacctcagccggtgttaacatgtgcacactgattgccatggacctaggcgaactctgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctctggcaccccatgtcggccttggtctggagaccagaacagaaacttggatgtcctctgagggggcatggaaacagatccagagggtggaaacctgggccttgcggcaccctggatttacagttattgctctcttcctggcacatgccatcggcacctcgattacgcagaagggcatcatatttatcctgctcatgttagtgactccatcaatggctatgcgctgcgtcgggattggaagcagagatttcgtggagggtctgagtggcgccacatgggtagacgttgtgcttgagcacgggtcctgtgtcaccactatggcgaaggataaacccacattggacatcgaactgctaaagaccgaggtgacgaaccctgcagtgctcaggaaactgtgcattgaagccaagatctctaataccacaactgatagccggtgtccaacccaaggagaggctacacttgtcgaagaacaggacgccaactttgtttgccgccgaactttcgtggatagaggctggggtaatgggtgtggactgtttggcaaaggctccttgataacctgcgcaaagttcaagtgcgtaacaaaactcgaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagttaactgactacggggcgctgacactcgattgtagcccaaggacgggacttgactttaacgaaatggtcctgttgaccatgaaggagaaatcttggctagtgcataagcagtggttcctggatctcccgctgccctggacttccggcgcctcaacaagccaagagacctggaatcggcaggaccttctggtaacatttaaaactgcacacgctaagaagcaggaagttgtggtcttgggtagtcaagagggggccatgcacaccgctctcacgggcgccaccgaaatccagacatctggaactaccacaattttcgcaggccatctgaaatgccgtttaaagatggataaactgactctaaaggggatgtcctatgtgatgtgtaccggtagcttcaaactcgagaaggaactggccgagacgcagcacggaacagtccttgtgcagataaagtacgagggcaccgacgctccttgcaaaatcccattttcgactcaagatgaaaagggggttacacagaacggacgcttgattaccgcgaatcccatcgtgactgacaaagagaagcctgtaaacatagaagcagagccacccttcggcgagtcttatattgtcatcggtgccggggaaaaagctctgaagctctcctggtttaagaaaggctcaagtatcggaaagatgttcgaggccaccgcaagaggcgccaggcggatggctattctgggggatacagcctgggactttggaagcatcggtggcgtgttcacgtccgttgggaaacttgtgcatcagatttttggaaccgcatacggcgtcctgttctctggtgtgagctggactatgaagatagggatcggcgtattgctcacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatctttgtcaccaatgaggttcacacgtggacagaacaatataagttccaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagtttactgtggtagtcggcgatgtggcagggattctggctcagggcaagaagatgatccgccctcaacccatggagtacaaatattcgtggaaaagctggggcaaggccaagataatcggggcggacgttcagaataccacattcattatcgatggaccaaacactcctgaatgtcccgacgatcagagagcctggaatatttgggaggtggaggactacggctttggtatcttcaccacaaacatatggcttaagttgagggattcctatacgcaggtctgcgaccaccgtctcatgtcagctgcaattaaagatagtaaggccgtgcacgctgacatggggtactggatcgaatctgagaaaaatgaaacctggaagctggcccgggcatccttcattgaggttaagacttgtatctggccaaaatcccatacactatggtcaaacggagtgctggaaagcgagatgataatccccaagatttatggcggtcctatctctcaacacaattaccgaccaggctactttacccagactgcggggccgtggcatctcggaaaactggagcttgatttcgacttgtgcgaaggcacaaccgtagtcgtggatgagcactgcgggaacagaggaccctccctgaggacgactaccgtgacaggcaagattatccacgaatggtgttgccgcagttgtaccttacctccactccggtttagaggtgaggacgggtgctggtatggaatggagataaggcccgtcaaagaaaaggaggaaaatctggttaagagcatggtgtctgccggctccggtgaggtagactcattcagtcttggcctgttgtgtattagcatcatgatcgaagaggtgatgcgctcgcgatggtcccggaaaatgctcatgactgggacactggctgtctttttcctactgattatgggacagctcacctggaacgatctgatccgtctttgcattatggtgggcgccaatgcatctgacagaatggggatgggaacaacttacttggctctgatggccacctttaagatgaggcctatgttcgcagttggcttactctttcgccggctgacgagcagagaggtgcttctgctaacaataggtctctcactggtcgccagtgtggaattgccaaactccctggaggaattaggggatggactcgctatgggcatcatgattctgaaacttctgaccgacttccaatctcatcagttgtgggcgactctcctgagcctaacctttatcaagacaactttctccctgcactatgcctggaaaaccatggcaatggttctttcaattgtgagcctctttcccctgtgtttgagtacgacatctcagaagaccacttggctgccggtcttactcggctccctggggtgcaagcctcttacaatgttcctgatcgctgagaataaaatatggggaaggcgaagctggccattgaacgaaggtatcatggccgtaggcattgtgtcgatcctcctgtcatctctactgaagaacgatgttccccttgccgggcctctcattgctggaggcatgctgatcgcatgttacgtgataagtggttccagcgccgacttgtctttagagaaagcggctgaggtcagctgggaagaggaagccgagcattccggggcatcacacaatattctggtggaagtacaggatgacggaaccatgaagatcaaagatgaggagcgcgacgatactctcacaatcctgcttaaggccaccctgttggctgtgagtggcgtctatcccctaagcattccagcaacgctgttcgtttggtacttttggcagaaaaagaagcagcggtctggcgtgctctgggacactccttcacccccagaagtggagagagccgtcctggatgacgggatatataggatcatgcagcgtggacttttaggtcgcagccaggtgggcgttggggtattccaagaaaacgtgtttcataccatgtggcacgtcacacggggagcggtgctgatgtaccagggcaaaagactcgagccgagttgggctagcgttaagaaagacttgatttcctacggtgggggatggaggctgcagggctcttggaataccggcgaggaagtgcaggtcatcgccgtggagcctgggaagaaccccaaaaatgtacaaacagcaccaggaactttcaagacccccgaaggtgaggtcggcgccattgctctcgattttaagcctgggacgtcgggaagcccaatcgtgaaccgagaaggcaaaatagttggtctgtatgggaatggagtggtcacaacttcaggcacctacgtgtccgccatcgcacaggctcgggccagtcaggagggcccccttcctgagattgaagacgaggttttccgcaagagaaacctgacaatcatggatttgcacccggggtctggaaaaaccaggcggtatctaccagcgattgtgcgagaagccatcaagagaaaactgcgcactctcatattagcacccaccagggtcgtggctagcgagatggccgaagctctgaagggtatgcctattcgttaccaaacaacggcagtaaagtccgagcatactggcaaagagatcgtggaccttatgtgccacgccacctttacaatgcggctgctctcaccagttagagtccccaattataacatgatcattatggatgaagcccatttcaccgacccttctagcatcgctgcgagggggtacataagtactcgcgtgggaatgggcgaggcagccgctatttttatgacagccaccccgcccggttccgtggaagcattcccacagagcaatgccgtcatccaggatgaggaacgagacattcctgagagatcttggaactcagggtatgagtggatcacggattttcccggaaagactgtatggttcgtgccatccataaaaagtggcaatgacattgctaactgtttgcggaagaatggcaaaagggttatccagctgagccgcaagacattcgataccgaataccaaaagaccaaaaacaacgactgggactacgtggtcactacagatatctcggagatgggggcgaattttcgtgccgacagagtgattgatcctcggaggtgcctcaagcccgttatcctgaaagacggaccagaacgcgtgattcttgcaggtccgatgcctgtcaccgtggcttctgccgcacagcgaagaggccggatagggaggaaccacaataaggagggagatcagtatatctacatgggccagcccctaaacaatgacgaggatcatgcccactggacagaagctaaaatgctgttggacaacattaatactccagagggtatcatccccgccttattcgaacctgagcgcgaaaagtccgcggcaattgatggggagtatagactgaggggcgaggcccggaagacgtttgtagaactcatgcgtcgcggagacctgccagtgtggcttagctacaaagttgcttcagagggcttccaatatagtgatcgaagatggtgctttgacggggaaaggaacaatcaggtcctggaggaaaacatggatgtggagatatggaccaaggagggagaacggaaaaagctccgccccagatggttggacgccaggacatactctgaccctctggctctacgggagttcaaagaatttgcagccggtcgaagatccgtgagcggcgatctgatcctcgagattgggaaacttccgcagcacctgactcagcgcgctcaaaatgccttagacaacttggtcatgctgcataattcagaacagggaggcagggcatatcggcacgcgatggaggagctcccagataccatcgaaacactgatgcttctggccctcattgctgttttgaccggtggggtgactctgttctttttaagtggccgtggactaggcaaaacgagcatcgggctgctctgtgtaatggcctcctctgtgcttctgtggatggcaagcgtcgagccccattggatagctgcctccatcattttggagttctttctgatggtgctcctgatccctgagcccgacagacagaggaccccacaggataaccaacttgcatacgttgtgattggactcctgttcatgatcttgacagtcgccgctaatgagatgggtctgttagaaactaccaagaaggacctaggcatagggcacgcggccgtagagaaccaccatcacgcagctatgctggatgtggacctccatcctgcctcagcctggacactttacgcagttgctaccactattatcacacccatgatgcgccacacgattgaaaacaccactgccaatatctctctgacagcgatagctaaccaggccgcaatcttgatgggactggataaaggctggccaattagtaagatggacatcggtgtgcctctcctggcccttgggtgctattcgcaggtcaatccgttaaccctgaccgctgcagtgctcatgttggtcgcccattacgcgattatcggccccggactgcaagctaaagccacacgggaggcacagaagcgaactgccgctggcataatgaaaaacccaacggtggatgggattgttgccatcgacctagatcctgtggtatatgacgcaaagtttgaaaagcagctgggacagatcatgctccttattctgtgtaccagccaaatcttgctgatgagaacaacttgggctctctgcgagtccataaccctggccacaggccccttaaccactctttgggagggttctccagggaaattctggaatacgacaattgcggtgtcaatggccaacatcttcaggggaagctacctggcaggcgctggtctcgccttttccctaatgaagagtctgggcgggggacgccggggcaccggggcacagggagaaactttgggcgagaaatggaagagacagctgaatcagctctctaaaagcgagttcaacacctataagcgttcaggtattatggaggtcgacaggtccgaagctaaggaggggcttaaacggggagagacaactaagcacgccgttagtcgcggcaccgccaaactgcgatggtttgtggaaagaaatttggtcaagcctgagggtaaagtgatcgatctgggctgtgggaggggaggctggagctactattgcgcggggctcaagaaggtaacagaagtgaaaggatacacgaagggcggtcccgggcacgaggaaccgataccaatggctacctacggatggaacttagttaaactgcattctggcaaggacgtgttctttatccctcccgagaaatgtgatactcttctgtgcgacattggcgagtcctcaccaaatcccacaatcgaagaggggcggaccctacgcgtcctcaagatggtggaaccttggctgagaggaaaccaattctgtattaaaatcttgaatccgtatatgcccagcgtcgtggagactctggagcagatgcagaggaagcacggtggcatgctcgttcgaaacccactttcgagaaattctacacatgaaatgtactgggtaagttgcgggaccggaaacattgtgtccgcagtcaatatgacgagccgtatgctgttaaacagatttaccatggcccaccgcaagcctacatatgagagggatgtggacctgggcgctggtactcggcacgttgccgtggaacccgaggtcgcaaacatcgatataattgggcagagaatcgaaaatatcaaacatgagcacaagtcaacctggcattacgacgaggataacccttataaaacatgggcctaccacggatcctatgaagtgaagccatctggcagcgctagttccatggtaaatggcgtggttaaattgctcactaagccctgggacgtcattcctatggtgacccaaatagcgatgacagataccactccattcgggcagcagcgcgtgtttaaggagaaagtcgacacgaggacacccaaggccaaacgaggaaccgcacaaatcatggaagttactgctaagtggctgtggggtttcctaagccggaacaaaaagccgagaatttgtaccagggaggaatttacacgcaaggtgcgttctaatgccgcaatcggcgccgtattcgtggacgagaaccagtggaactcagctaaagaggccgtcgaagatgagcggttttgggaccttgtgcatagagaaagggagctgcacaagcaggggaaatgcgcgacgtgcgtttacaacatgatgggaaagcgcgagaaaaagctcggcgagttcggtaaggcaaaagggagtcgagccatttggtacatgtggctgggagctcggttcttggagtttgaagccctgggcttcatgaatgaggatcactggttttccagagaaaacagcctctctggcgtggagggggagggacttcataagctgggttatatcttaagggacatatcgaaaatccctggcgggaatatgtacgcagatgacaccgctggatgggatactcgcattacagaagacgatctgcagaacgaggccagaatcaccgacattatggaaccagagcacgctttgctcgccaagtcaatcttcaaactgacttatcaaaataaggtcgtgcgggtacagaggcccgccaaaaatggcacagttatggatgtgataagccgtcgagaccagcgcggttccgggcaggtcggaacctacggcctaaatacatttactaacatggaagcgcaacttattagacagatggagagtgagggcatcttctctcctagcgaactggagaccccaaacctcgccgaacgggtgctggattggttggagaagtatggggtggaaaggttaaagcgcatggctatctccggagacgactgtgtcgttaaacccattgatgacagatttgccacggcactgaccgctctcaatgatatgggtaaggtgcggaaagacataccgcagtgggagccttcaaagggctggaacgattggcagcaagtacccttctgcagtcatcactttcaccagcttatcatgaaagacgggagggagattgtggtcccatgtcgaaatcaggatgaactggtgggacgtgccagagtttctcagggcgcaggttggagcctacgcgagacagcctgcctggggaagtcctacgcgcaaatgtggcagctcatgtatttccatcggagggacttgagactggctgccaacgcaatctgttcagccgtgcctgtcgattggattcccactagccgcaccacatggtctatccacgctcatcaccagtggatgactaccgaagacatgctttccgtgtggaatcgggtatggatagaggaaaacccatggatggaggataagacgcatatcagtagctggggagacgttccctacctgggcaaaagggaggaccaatggtgcggctcgctcattgggttaacagcccgagcaacctgggctactaatatccaggtggccattaaccaggtcagacggctgatcggaaatgaaaactacttggattatatgacatccatgaagaggtttaaaaatgagtctgaccctgaaggtgcgctgtggtga

SEQ ID NO: 13967 - RNA, 9879 nt, synthetic construct
  misc_feature 1..9879: note = derived and/or modified CDS sequence (opt3) from DENV-1__GU131805__SS-prME
  source 1..9879: mol_type = other RNA
tccgtgaccatgctgctcatgcttatgcccacagcactggctttccacttgactacgcggggcggggagcctcatatgatcgtctccaagcaggaaaggggaaagtctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccgatcctgccgtgctcaggaaactgtgcattgaagctaagatctctaacacgaccacagacagccggtgtccaactcaaggagaggccacccttgtcgaggaacaggatgcaaattttgtttgccgccgaacattcgtggacagaggctggggtaacgggtgtggactgtttggcaaaggctccttgatgacttgcgctaagttcaagtgcgtaaccaaactcgaggggaagatagtgcagtacgaaaatctgaaatattcagtcattgtgacagttcacaccggagaccagcatcaagtgggtaacgagagtactgaacacggcacgacagccaccatcactccccaggcgcctagcccagagattcagttaccggattacggggccctgaccctcgactgttctcccaggcctggacttgattttaatgaaatggtcctgttgccaatgaaggagaaatcctggctagtgcataagcagtggttcctggacctccccctgccttggacatcaggcgcaagcaccagtcaagagacttggaaccggaaagatcttctgggtacatttaagacggctcacgccaaggaacaggaggtagttgtgttggggtctcaggaaggcgctatgcacaccgccctcactggagcaacagagatccaaacctccggcacaactaccatcttcgccgggcatctgaaatgccgtttaaagatggacaaactgacgctaaagggaatgagctatgtcatgtgtaccggttcgttcaaactcgaaaaggaggtggctgagacacagcacggcactgtcctggtgcagattaagtacgaagggaccgatgcgccatgcaaaatacccttttctacacaggacgagaagggagttactcaaaatggccgccttatcaccgcaaacccgattgtgacggataaagaaaagcctgtaaatatcgaggccgagcccgctttcggtgaatcctatatagtcattggggccggcgagaaagcattgaagctgtcatgggtgaagaaaggaagtagcatcggcaagatgtttgaagccacagctagaggggccaggcggatggcaatcctcggagacaccgcgtgggatttcggttccattggcggggtttttacttctgtgggaaaactggtccatcagatcttcggcacagcttacggtgtgctttttagcggggtatcatggaccatgaagattggcataggagtgctgttgacttggctcggcctgaacagtcgatccaccagcttatctatgacatgtatcgccgttgggctggtcacgctatacctcggagtgatggtgcaggcagactcaggctgcgtcattaattggaaaggtcgcgagctgaagtgtgggagtggaatcttcggcaccaacgaagttcacacttggacagagcagtataagtttcaagccgacagcccaaaaagactttccgctgccatcggtaaggcatgggaggaaggcgtgtgcgggattaggtctgctacccggttggagaatataatgtggaaacagatctcgaacgaactgaaccatattctcctggagaatgccatgaagttaacagtggtagtcggagatgtggcgggcatcctggcccaggggaaaaagatgattcgccctcagcccatggaatacaaatatagctggaagtcctggggaaaggctaaaatcataggcgcagacgttcaaaacactaccttcatcattgatggtccaaatacgcccgagtgtcctgacgatcagagagcctggaacatctgggaggtggaagactacgggtttggaattttcacaaccaatatctggcttaagttgagggattcatatactcaggtctgcgaccaccgtctcatgagtgctgccataaaagattctaaggcagtgcacgcggacatgggctactggattgagagcgagaagaatgagccatggaagctggcccgggcttcctttatcgaagttaagacctgtatttggccgaaatcacatacactatggagcaatggtgtgctggagtctgagatgatcatacccaagatctatggcgggcctatttcccagcacaactaccgaccaggatacttcactcaaaccgccggcccctggcatctcgggaaactggaacttgatttcgacttgtgcgagggaacaacggtagtcgtggatgaacactgcggcaatagaggtcctagtctgaggaccactacagtgccagggaagatcattcacgagtggtgttgccgcagctgtaccttacccccgctccggtttaaaggagaggacggctgctggtatggtatggaaatctctcctgtcaaggagaaggaagagaacctggttaaatccatggtgtcagcaggcagtggggaagtagacagcttctcgcttggactgttgtgtatatccattatgatcgaggaggtgatgagatctaggtggagccgcaagatgctcatgactggcccactgcccgtctttttcctactgatcatggggcagctcccttggaatgatctgattcgactttgcatcatggtgggagctaacgcctcagaccggatgggcatgggtacaccctacttggcactgatggccacctttaaaatgcgtccaatgttcgctgttgggttactctttagaaggctgacgagtcgcgaaggacttctgctaactattggcctctccctggtggcgtctgtcgagttgcctaatagcctggaagagttaggcgatgggctcgccatgggaataatgatcctgaaacttctgaccgacttccagtcccatcaattgtgggcaacactcctggctctaacctttattaaaactacattctcactggattatgcctggaagaccatggccatggtgcttagcatcgttagtctctttcccctgtgtttgtctacaacttcccagaagaccacgtggctgccagtgttactcggtagcctgggctgcaaaccgcttacaatgttcctgattgctgaaaacaagatctgggggcggaaatcgtggcctttgaatgagggaataatggcagtcggcatcgtatcaattctcctgtctgccctactgaagaacgacgtgccccttgcgggtccactcatcgctgggggaatgctgattgcctgttacgttatcagtggctccagcgcagatttgtctttagagaaagccgctgaagtgagctgggaggaagaggcagaacactccggcgggtcacataacatactggtcgaggtgcaggacgatggaaccatgaagattaaagacgaggaaagagatgccactctcaccatcctgcttaaggcgacactgttggctgtaagtggtgtgtatcccctaagcatccctgccactctgtttgtctggtacttctggcagaagaaaaagcaaaggtctggcgttctctgggacaccccatcaccccctgaggtggaacgagcagtgctggatgacgggatttatcgcataatgcagcggggacttttaggcagaagccaggtcggtgtgggggttttccaggagaatgtatttcacacgatgtggcatgtgacaaggggagccgtcctgatgtaccaaggcaaacgtctcgagccgagttgggctagcgtgaagaaagacttgatctcctacggcgggggatggcgcctgcagggttcttggaacaccggcgaagaggttcaggtgattgccgtcgaaccagggaagaatcccaagaacgtgcagactgcacctggaacattcaaaacctcggagggcgaagtaggtgctatcgccctcgattttaagccagggactagcggatcacccattgtcaatcgggagggcaaaatcgtgggcctgtatgggaacggagttgtgacaacctccggtacgtacgtcagtgcgatagcccaagcaaaggcttctcaggagggccctcttccggaaatcgaggacgaagtgttcagaaaaaggaatctgactattatggatttgcaccccgggagcggaaagacccgacggtatctaccagccatcgttcgcgaggctattaagagaaaactgaggacactcatcttagcacctacccgggtggtcgcctccgaaatggccgaggctctgaagggcatgcccatacgataccagacaactgcggtgaaatcagagcacaccggtaaggaaattgtagaccttatgtgccatgcaacgtttacaatgagactgctctctccagtgcgcgttcctaactataatatgatcatcatggatgaggcccacttcactgaccccagcagtattgctgccagggggtacatctccacccgtgtcggaatgggcgaagcagccgctatatttatgacagcgaccccaccgggcagcgtggaggccttccctcaatctaacgcagtgattcaggatgaagaacgggacatccccgagagatcatggaactccgggtatgaatggattactgattttccaggaaaaaccgtctggttcgtacccagtatcaagagcggtaacgacatagctaattgtttgaggaagaacggcaaacgcgtgattcagctgtcgcgaaagacatttgatacggagtaccagaaaactaagaataacgactgggactacgttgtgaccacagatatctctgaaatgggggccaacttcagagcagaccgggtcatcgatcctaggcgctgcctcaaaccagtgattctgaaggacggacccgagcgtgttatccttgccggccctatgccggtgaccgtcgcttccgccgcgcaaagacggggtaggattgggcgcaatcataacaaggagggcgatcagtatatatacatgggacagccactaaataacgacgaagatcacgcacattggactgaggccaaaatgctgttggacaatatcaacacacccgaaggcattatccctgctttattcgagcccgaacgagaaaagagcgccgctatcgatggggagtatagactgcggggagaagcaaggaaaacctttgtggagctcatgcgcagaggtgacctgccagtatggctttcatacaaggtggccagtgaaggcttccagtattctgataggcggtggtgctttgacggggagcgtaataaccaagttctggaagagaatatggatgtcgagatttggacgaaagaaggagagcgcaagaaactccgacctagatggttggacgctaggacttactccgaccccctggccctacgggagttcaaggagtttgcagcgggccgcagaagcgtgtcaggtgatctgatactcgaaatcgggaaacttccacagcacctgacacagagggcccagaacgctttagacaatttggtgatgctgcacaacagtgagcaaggcggacgggcctatcgacatgcaatggaggaactccctgataccattgagaccctgatgcttctggctctcatcgccgtcttgactggcggggttacactgttctttttaagcggaagaggtctaggcaaaacctccattgggctgctctgtgtgatggcatctagcgtacttctgtggatggcctccgtggaaccgcactggatcgctgcgtcaataatcttggagttctttctgatggtcctcctgattcccgagccagaccgccagaggacacctcaggataatcagcttgcctacgtggttatcggactcctgttcatgattttgactgtggcagctaacgaaatgggcctgttagagacgaccaagaaagacctaggtatcgggcatgtcgccgtagaaaatcaccaccatgccgcaatgctggatgtggacctccaccccgcttctgcctggacactttacgcggttgctactaccataattacaccaatgatgcggcataccatcgagaacactacggccaacattagtctgaccgcaatcgccaatcaagctgcaatattgatgggcctggataagggatggcctatctcgaaaatggacattggcgtgcccctcctggcccttgggtgctatagccaggtcaacccgttaacactgactgcggctgtgctcatgttggtcgcccactacgcaatcattggaccaggcctgcaggccaaggctacccgtgaagcccaaaagagaacagcagctggtatcatgaaaaatcctaccgtggatgggatagttgccattgacctagatcccgtggtatatgacgcgaagtttgagaaacagctgggacagatcatgctccttatcctgtgtacttcccagattttgctgatgaggacaacgtgggccctctgcgagtctatcaccctggcaactggcccattaacaaccctttgggaaggttcacccggcaagttctggaacaccacaatagctgtgagcatggccaatatttttcgcgggtcctacctggcaggagctggcctcgccttcagtctaatgaaatctctagggggaggccggcgaggtactggggcccaaggagagacgttgggcgaaaagtggaagagacagctgaaccagctcagcaaatcagagttcaatacctataagaggtccggtatcatggaagtcgaccgcagtgaggcgaaagagggccttaagagaggggaaacaactaaacatgctgttagcagaggaaccgcaaagctgcgttggtttgtggagaggaacttggtcaagcctgaaggcaaagtgattgatctggggtgtggacggggcggttggtcttactattgcgccgggctcaagaaagtaacagaggtgaagggatacaccaaaggcggcccggggcacgaagaacccatcccaatggctacttacggatggaatttagttaagctgcactccggtaaagacgtgttctttatacctcccgagaagtgtgatacgcttctgtgcgacatcggcgaatcaagccctaacccaacaattgaggaagggcgcaccctacgagtcctcaagatggtggagccctggctgagaggaaatcagttctgtatcaaaattttgaacccttatatgccatcggtcgtggagactctggaacaaatgcagaggaagcatggcggtatgctcgttcggaatcccctttctcgcaacagtacccacgagatgtactgggtatcctgcgggacaggaaatatcgtgagcgccgtcaacatgacttcaagaatgctgttaaataggtttaccatggcacatcgaaaaccgacatatgaacgggatgtggacctgggcgccggcacgcgtcacgttgctgtggagcctgaagtcgcgaacttggatattatcgggcagagaatagagaacattaagcacgagcataaatccacctggcactacgacgaagataatccatataagacttgggcctaccatggatcttatgaggtgaagcccagcggtagtgcatccagcatggtaaacggcgtggttaaactcctgacaaagccttgggacgtcatcccaatggtgacccagatcgctatgactgatacaacccccttcgggcaacagcgcgtgtttaaagaaaaggtcgacacgaggaccccgaaagccaagcggggaacagcacagattatggaggttactgccaagtggctatggggcttcctttctagaaataaaaagcctcgcatatgtaccagggaagagtttacacgaaaagtgcggtcaaacgctgccatcggtgcggtattcgtggacgagaatcaatggaacagtgcaaaggaagccgtcgaggatgaaagattttgggacctggtgcacagggagcgcgaactccataaacaggggaagtgcgctacttgcgtttacaatatgatgggaaagcgtgagaaaaagctgggcgagttcggcaaagccaaggggtcccgggcaatttggtacatgtggttgggagctagatttctggagttcgaggccctcggtttcatgaacgaagatcactggtttagcagggaaaattctctttcgggcgtggagggggaaggactgcacaaattaggctatatcctgcgcgacatttcaaagatccccggtgggaacatgtacgctgatgacaccgccggatgggatacacgaataaccgaggacgatttgcagaatgaagcaaaaatcactgacattatggagccagaacatgcgctcctggccaagagcatcttcaagctaacgtatcagaacaaagtcgtgcgggtacaaagacctgctaagaatggcacagttatggatgtgatttccaggcgcgaccagagaggcagtgggcaggtcggaacctacggtcttaacacttttaccaatatggaggcccagctgatccggcaaatggagtctgaaggcatattcagcccctccgagctcgaaacaccaaacctggcagggagggtgttggattggttagagaaacacggagtggaacgtctgaagcgaatggctatttcaggcgacgactgtgtcgttaaacccatcgatgaccgctttgccgcagccctcacggcgcttaacgatatgggtaaggtgagaaaggacatccctcagtgggagccaagtaaagggtggaatgattggcagcaggtaccgttctgctctcatcactttcaccaactgattatgaaggacggacgggagatagtggtcccctgtaggaaccaggatgagctggtgggccgcgctagagttagccagggcgccgggtggtccctgcgggagaccgcatgcctcggaaaatcatatgcccagatgtggcaattgatgtacttccataggcgagacctgcgtcttgctgccaatgcaatctgtagcgctgtgcctgtcgattgggtgccaacttctagaacaacctggtccattcacgcccatcaccagtggatgactacagaagacatgctgagtgtatggaaccgcgtttggatcgaggaaaatccctggatggaggataagacccatattagctcgtggggtgacgtgccttatctcggcaaacgggaggaccagtggtgcgggtccttaatcggactgacagcgagggctacttgggccaccaacatacaagtcgcaatcaatcaggtgagacgcttgattggcaacgaaaattacctggattacatgacgtctatgaagcggtttaagaacgagtcagacccagaaggtgccctctggtga

SEQ ID NO: 13968 - RNA, 9879 nt, synthetic construct
  misc_feature 1..9879: note = derived and/or modified CDS sequence (opt3) from DENV-1__GU131806__SS-prME
  source 1..9879: mol_type = other RNA
agcgtgaccatgttcctgatgctcatgcccacggcccttgcttttcacctgactacgcggggcggggaacctcatatgatcgtctccaagcaggaaaggggaaaatctttgttattcaagacctcagccggtgttaatatgtgcacactgattgccatggacctgggcgaactctgtgaagatactatgacctacaaatgcccacggataacagaaaccgaaccggacgatgtggactgttggtgcaatgcgactgatacatgggtgacctatgggacgtgtagtcaaactggagagcaccgccgagacaagcgtagcgtggctctggcaccacatgtcggccttggtctggagaccagaacagaaacttggatgtcctctgagggggcatggaaacagatccagagggtggaaacctgggccttgcggcaccctggatttacagttattgctctcttcctggcacatgccatcggcacctcgattacgcagaagggcatcatatttatcctgctcatgttagtgactccatcaatggctatgcgctgcgtcgggattggaagcagagatttcgtggagggtctgagtggcgccacatgggtagacgttgtgcttgagcacgggtcctgtgtcaccactatggcgaaggataaacccacattggacatcgaactgctaaagaccgaggtgacgaaccctgcagtgctcaggaaactgtgcattgaagccaagatctctaataccacaactgatagccggtgtccaacccaaggagaggctacacttgtcgaagaacaggacgccaactttgtttgccgccgaactttcgtggatagaggctggggtaatgggtgtggactgtttggcaaaggctccttgataacctgcgcaaagttcaagtgcgtaacaaaactcgaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagttaactgactacggggcgctgacactcgattgtagcccaaggacgggacttgactttaacgaaatggtcctgttgaccatgaaggagaaatcttggctagtgcataagcagtggttcctggatctcccgctggcctggacttccggcggttcaacaagccaagagacctggaatcggcaggaccttgtagttacatttaaaactgcacacgggaagaagcaggaagtggtcgtgctgggcagtcaagagggagctatgcacaccgccttgacgggcgctaccgaaatccagacatctgggactaccacaattttcgccggacatctcaaatgccgtctgaagatggataaattaactctgaagggtatgtcctatgtcatgtgtaccggcagcttcaaactagagaaggaactcgcagagacgcagcacgggacagtgctggttcagataaagtacgagggaaccgacgccccctgcaaaatccctttttcgactcaagatgaaaagggcgtgacacagaacggtcgccttattaccgctaatccaatcgtaactgacaaagagaagcccgtcaacatagaagcggagcctccattcggggagtcttatattgtgatcggcgcaggagaaaaagccttgaagctgtcctggtttaagaaaggctcaagtatcgggaagatgttcgaggctaccgccagaggagcaaggcggatggccattctcggtgatacagcttgggactttggcagcatcgggggagttttcacgtccgtgggcaaactggtccatcagatttttggtaccgcctacggggtgcttttctctggcgtaagctggactatgaagataggaatcggcgtgctgttgacatggctcgggctaaattcacgaagtacctccttaagcatgacatgtattgcagttggactggtcactctatacctcggcgtgatggtgcaggcggattctggttgcgtcatcaactggaaagggcgcgaactgaagtgtggatcaggcatctttgttaccaatgaggtgcacacgtggacagaacaatataagttccaggctgacagtcccaaaagacttagcgccgcaattggtaaggcctgggaggagggcgtgtgcgggataaggtccgctacccggttggaaaacatcatgtggaaacagatttctaacgagctgaatcatatcctcctggaaaacgacatgaagtttactgtagtcgtgggagatgttgccggcattttagcacaggggaaaaagatgatccgcccgcaacctatggagtacaaatattcgtggaaaagctggggaaaggctaagataatcggcgccgacgtgcagaataccacattcattatcgatggtcccaacactccagaatgtcctgacgatcagagagcgtggaatatttgggaggtcgaggactacgggtttggaatcttcaccacaaacatatggctgaaacttagggattcctatacacaggtgtgcgaccaccgtttgatgtcagccgctattaaagatagtaaggcagttcacgccgacatgggctactggatcgaatctgagaaaaatgaaacctggaagctcgctcgggccagcttcattgaggtgaagacttgtatctggcccaaatcccatacactgtggtcaaacggtgtactagaaagcgagatgataatcccaaagatttatggcgggcccatctctcaacacaattaccgacctggatactttacccagactgcaggcccatggcatctggcgaaactcgagctggatttcgacctttgcgaagggacaaccgtcgtggtggatgagcactgcggaaacagaggcccgtccttgaggacgactaccgtcacaggtaagattatccacgaatggtgttgccgcagttgtaccctgccccctttacggtttagaggggaggacggatgctggtatggcatggagataaggccagttaaagaaaaggaggaaaatctcgtaaagtcgatggtatctgccggttccggcgaggtggactcattcagtctggggcttctgtgtattagcatcatgatcgaagaggtcatgcgctcgcgatggtcccggaaaatgttgatgactggaacactcgctgtgtttttcctgctaattatgggccagctgacctggaacgatctcatccgtctgtgcattatggttggggccaatgcatctgacagaatgggaatgggcacaacttaccttgctttgatggccacctttaagatgaggcccatgttcgcagtgggtctgttatttcgccggctcacgagcagagaggtcctgcttctgacaatagggctatcactcgtggccagtgttgaactgcctaactccttggaggaactgggagatggcttagctatgggcatcatgattctcaaactgcttaccgacttccaatctcatcagctgtgggcgactttgctcagcctgacctttatcaagacaactttctccctacactatgcctggaaaaccatggcaatggtgctgtcaattgtcagcctttttccactctgtctgagtacgacatctcagaagaccacttggttgcccgtactgttagggtccctcggatgcaagccgctgacaatgttccttatcgctgagaataaaatatggggtaggcgaagctggcctctgaacgaaggcatcatggccgtggggattgtttcgatcttgctctcatctctgctaaagaacgatgtgccactggccggaccccttattgctggcggtatgctcatcgcatgttacgtcataagtgggtccagcgccgacctgtctttggagaaagcggctgaggtgagctgggaagaggaagccgagcattccggaccttcacacaatattttagtagaagtgcaggatgacggccccatgaagatcaaagatgaggagcgcgacgataccctgactatcctcctgaaggcaacacttctggccgtcagtggcgtttatccattgagcattcctgctaccctattcgtgtggtacttttggcagaagaagaagcagcggtctggggtgctgtgggacacgccctccccaccggaagtcgagagagcagtgctcgatgacggaatatataggatcatgcagcgtggtctgcttggccgctcacaggttggggtaggagtgttccaagaaaacgtctttcatactatgtggcacgtgacccggggcgccgttttaatgtaccagggtaaaagactggagcctagttgggcgagcgtgaagaaagacctcatttcctacgggggaggctggaggttgcagggctcttggaatacaggggaggaagtccaggtgatcgctgtagagcccggaaagaaccccaagaatgtccaaaccgcccccggtacattcaagactcctgaaggcgaggtgggggcaattgccctggattttaagccaggaacctcgggcagccccatcgttaaccgagaaggtaaaatactcgggctgtatggaaatggcgtggtcacgacatcaggcacttacgtgtccgctatcgcccaggcacgggctagtcaggaggggcctcttccggagattgaagacgaggttttccgcaagagaaacctgaccatcatggatttgcacccaggatctggtaaaacaaggcggtatctacccgccattgtgcgagaagcgatcaagagaaaactgcgcaccctcatattagcccctactagggtcgtggcaagcgagatggctgaagccctgaagggcatgccaattcgttaccaaaccacagctgtaaagtccgagcatacggggaaagagatcgtggaccttatgtgccacgcaacttttaccatgcggctgctctcacccgttagagtccctaattataacatgatcattatggatgaagcccatttcacagacccgtctagcatcgccgctaggggatacataagtacccgcgtgggcatgggtgaggcggcagccatttttatgactgctacacccccagggtccgtggaagccttccctcagagcaatgcagtcatccaggatgaggaacgagacattcccgagagatcttggaactcaggatatgagtggatcaccgattttccaggcaagacggtatggttcgtgccttccataaaaagtggcaatgacattgccaactgtttgcggaagaatgggaaaagggttatccagctgagccgcaagactttcgatacagaataccaaaagaccaaaaacaacgactgggactacgtggtcaccactgatatctcggagatgggagctaattttcgtgcggacagagtgattgatccccggaggtgcctcaagccagttatcctgaaagacggtccggaacgcgtgattcttgccggccctatgcccgtcacagtggcatctgctgcccagcgaagagggcggataggaaggaaccacaataaggagggcgatcagtatatctacatgggtcagccactaaacaatgacgaggatcatgcacactggaccgaagccaaaatgctgttggacaacattaatacacccgaggggatcatccctgctttattcgaaccagagcgcgaaaagtccgccgcgattgatggcgagtatagactgaggggagaggcacggaagacttttgtagaactcatgcgtcgcggcgacctgcccgtgtggcttagctacaaagttgcctcagaggggttccaatatagtgatcgaagatggtgctttgacggagaaaggaacaatcaggtcctggaggaaaacatggatgtggagatatggacgaaggagggtgaacggaaaaagctccgccctagatggttggacgctaggacctactctgacccgctggccctacgggagttcaaagaatttgctgcaggccgaagatccgtgagcggggatctgatcctcgagattggaaaacttccacagcacctgacacagcgcgcccaaaatgctttagacaacttggtcatgctgcataattcagaacagggcggtagggcctatcggcacgcaatggaggagctccccgatactatcgaaaccctgatgcttctggcgctcattgccgttttgacagggggcgtgaccctgttctttttaagtggacgtggcctagggaaaactagcatcggactgctctgtgtaatggcttcctctgtgcttctgtggatggccagcgtcgagcctcattggatagcagcttccatcattttggagttctttctgatggtgctcctgatccccgagccagacagacagaggacgcctcaggataaccaacttgcctacgttgtgattggtctcctgttcatgatcttgaccgtcgcagccaatgagatgggcctgttagaaacaactaagaaggacctagggataggacacgtagctgtggagaaccaccatcacgcggccatgctggatgttgacctccatcccgcatcagcttggaccctttacgccgtggccacaaccattatcactccaatgatgcgccacacaattgaaaacacgaccgcaaatatctctctgactgctatagccaaccaggcggctatcttgatgggcctggataaaggttggcctattagtaagatggacatcggggtcccgctcctggcccttggctgctatagccaggtgaatcccttaacactgaccgcagccgtcctcatgttggtggctcattacgcaattatcggaccaggcctgcaagccaaagcgacccgggaggctcagaagcgaacagccgcagggataatgaaaaaccctactgttgatggaattgtggccatcgacctagatcccgtagtgtatgacgctaagtttgaaaagcagctgggccagatcatgctccttattctgtgtacgagccaaatcttgctgatgagaaccacatgggccctctgcgagtccataactctggcaaccggtccattaacaaccctttgggaggggtctcctggaaaattctggaatactacgattgctgtctcaatggccaacatcttcaggggcagctacctggcgggtgccggcctcgcattttccctaatgaagagtctagggggaggccgccgggggacaggagctcagggcgaaaccttgggtgagaaatggaagagacagctgaatcagctctctaaaagcgagttcaacacttataagcgttcagggattatggaggttgacaggtccgaagccaaggagggacttaaacggggcgagaccacaaagcacgcagtgagtcgcggtactgctaaactgcgatggtttgtcgaaagaaatttggtgaagcccgagggcaaagtaatcgatctggggtgtggaaggggcgggtggagctactattgcgccggactcaagaaggtgaccgaagttaaaggctacacaaagggtgggccgggacacgaggaaccaatacctatggccacgtacggctggaacttagtgaaactgcattctggcaaggacgtcttctttattcccccagagaaatgtgatacccttctgtgcgacatcggggagtcctcacccaatcctactatcgaagagggacggacactacgcgtgctcaagatggtcgaaccgtggctgagaggtaaccaattctgtattaaaatcttgaatccctatatgccaagcgtggttgagaccctggagcagatgcagaggaagcacggcgggatgctcgtacgaaaccctctttcgagaaattctactcatgaaatgtactgggtgagttgcggaacaggcaacattgtctccgcggtgaatatgaccagccgtatgctgttaaacagatttacgatggctcaccgcaagcccacctatgagagggatgttgacctgggtgcagggacacggcacgtggccgtcgaacctgaggtggctaacttggatatcataggacagagaattgaaaatatcaaacatgagcacaagtcaacttggcattacgacgaggataacccatataaaacctgggcctaccacggctcctatgaagtaaagccctctggcagcgcaagttccatggtgaatggggttgtcaaactcctgacaaagccttgggacgtgatcccaatggtgactcaaattgccatgaccgatacaacccccttcggacagcagcgcgtctttaaggagaaagttgacactaggacgccgaaggctaaacgaggtacagcgcaaataatggaagtgaccgccaagtggctatggggcttccttagccggaacaaaaagcctagaatctgtactagggaggaatttacccgcaaggtacgttctaatgcagctattggggccgtgttcgtcgacgagaaccagtggaactcagcaaaagaggccgtggaagatgagcggttttgggacctggttcatagagaaagggagctccacaagcagggaaaatgcgctacatgcgtgtacaacatgatgggcaagcgcgagaaaaagctgggtgagttcgggaaggccaaaggaagtcgagcgatctggtacatgtggttgggcgcacggttcctggagtttgaagccctcggcttcatgaatgaggatcactggttttccagagaaaacagcctttctggggtcgagggagagggtctgcataagttaggctatattctgagggacatctcgaaaataccagggggaaatatgtacgctgatgacacggccggctgggatacccgcatcactgaagacgatttgcagaacgaggcaagaattacagacatcatggaacccgagcacgctctcctggccaagtcaattttcaaactaacctatcaaaataaggtggtacgggttcagaggcctgctaaaaacggtactgtgatggatgtcatcagccgtcgagaccagcgcgggtccggacaggtgggcacatacggccttaatacctttacaaacatggaagcccaactgataagacagatggagagtgaggggattttctctccaagcgaactcgagactcccaacctggcagaacgggtgttggattggttagagaagtatggagtcgaaaggctgaagcgcatggcgatctccggtgacgactgtgttgtgaaaccgatcgatgacagatttgccaccgctctcacggcccttaatgatatgggcaaggtacggaaagacattcctcagtgggagccctcaaaggggtggaacgattggcagcaagtgccattctgcagtcatcactttcaccagctgataatgaaagacggaagggagatcgtcgtgccttgtcgaaatcaggatgagctggttggccgtgcaagagtgtctcagggtgctgggtggagcctgcgcgagaccgcctgcctcggaaagtcctacgcacaaatgtggcagttgatgtatttccatcggagggacctgagacttgccgcgaacgctatttgttcagccgtccccgtggattggatcccaacaagccgcactacctggtctattcacgcacatcaccagtggatgacaactgaagacatgctgtccgtatggaatcgggtttggatcgaggaaaacccctggatggaggataagacccatataagtagctggggcgacgtgccttacctcggcaaaagggaggaccaatggtgcgggtcgttaatcggactgacggcccgagctacatgggccaccaatattcaggtcgcaatcaaccaggtgagacggttgattggtaatgaaaactacctggattatatgacttccatgaagaggtttaaaaatgagtctgacccagaaggcgctctctggtga

SEQ ID NO: 13969 - RNA, 9879 nt, synthetic construct
  misc_feature 1..9879: note = derived and/or modified CDS sequence (opt3) from DENV-1__GU131807__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgccccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagcctgaggtgaccaacccagcagtgctgaggaaactttgcattgaagccaagatctctaatacgaccacagatagccggtgtcccactcaaggagaggctaccctggtcgaagagcaggacgccaacttcgtttgccgccgaacatttgtggatagaggctggggtaatgggtgtggattgttcggcaaaggctccctcataacttgcgcaaagtttaagtgcgtaaccaaactggaggggaagattgtgcagtacgaaaacttaaaatattcagtcatcgtgacagttcacaccggagaccagcatcaagtgggtaatgagagtactgaacacggcacgacagctaccattactcctcaggccccaaccacagagatccagctgaccgactacggggcgctcactcttgattgtagcccgaggacaggactggacttcaacgaaatggtcttggtgacgatgaaggagaaatcttggctagtacataagcagtggtttctggatctccccctgccttggacctccggcgcctcaactagccaagagacatggaatcggcaggaccttctggttaccttcaaaacagcacacgctaagaagcaggaagtggtcgtgttgggtagtcaagagggggccatgcacactgctctcaccggcgccacggaaatccagacctctggaacaactaccatttttgcaggccatctgaaatgccgtttaaagatggataaactgacactacgcgggatgtcctatgtcatgtgtactggaagcttcaagctcgagaaagaagtggccgagacccagcacggtacggttctggtgcagataaagtacgagggcacagacgctccatgcaagatccccttctcgacccaagatgaaaaaggggtaactcagaacggaagacttattacagcgaatcctatcgtcaccgacaaggagaaaccagtgaacatagaagcagagcccccgtttggcgagtcttatattgttatcggtgccggggaaaaggctttgaaactgtcctggttcaagaagggctcaagtatcggaaaaatgtttgaggccactgcaaggggcgcccggcgaatggctattctcggggataccgcctgggacttcggaagcatcggtggcgtgtttacatccgtcgggaagctggtgcatcagattttcggacctgcatacggcgtacttttttctggtgtgagctggcccatgaaaatagggatcggcgttctgttgacgtggctcggactgaattcacgcagtacctccttaagcatgacttgtattgcggtcggcctggtgacactatacctcggggtgatggtccaggctgattctggatgcgttatcaactggaagggcagagaactgaaatgtggttcagggatcttcgtgaccaatgaggtgcacacatggactgaacaatataagtttcaggccgacagtccaaagaggcttagcgcagccattggaaaagcttgggaggagggcgtatgcggtatacggtccgccacccgcttggaaaacatcatgtggaagcagatttctaacgagctgaatcatatcctcctggaaaacgacatgaaattcacggtcgtggttggcgatgtggcagggattttagctcagggaaagaaaatgatcagacctcaacccatggagtacaagtattcgtggaaaagctggggcaaggccaagataatcggggcggacgtccagaatacaacctttattatcgatggaccaaacactcccgaatgtcctgacgatcagagggcctggaatatttgggaggtggaggactacggcttcggtatctttaccacaaacatatggctgaaacttcgtgattcctatactcaggtttgcgaccaccggttgatgtcagctgcaattaaggatagtaaagccgtgcacgctgacatggggtactggatcgaatctgagaagaatgaaacctggaaactcgcccgagcaagcttcattgaggtaaagacatgtatctggccaaagtcccatacgctgtggtcaaacggagtcctagaaagcgagatgataatcccgaaaatttatggcggtcccatctctcaacacaattacagacctggctacttcacccagactgcggggccatggcatctgggaaagctcgagctggattttgacctttgcgaaggcacaaccgtggtggtcgatgaccactgcgggaacaggggaccctccttgcgcactacaaccgttacgggcaaaattatccacgagtggtgttgccggagttgtactctgcctccattaagattcaggggtgaagacgggtgctggtatggaatggagatacgccccgtgaaggagaaagaagagaatctcgtaaagagcatggtgtctgccggctccggtgaagtcgattcatttagtctgggccttctgtgtattagcatcatgatcgaggaagtgatgcgatcgcggtggtcccgtaagatgttgatgaccgggacactcgctgttttctttctgctaattatgggacagctgacctggaacgacctcatcagactgtgcattatggtgggcgccaatgcatctgataggatggggatgggaactacataccttgctttgatggccaccttcaaaatacgcccgatgtttgcagtcggcctgttattccggagactcacaagcagggaggtgctgcttctgactatcggtctatcactcgttgccagtgtggagctgcctaactccttggaagagctgggggacggattagctatgggcattatgatcctcaagctgcttaccgattttcaatctcatcagctgtgggcgacgttgctcagcctgacattcattaaaaccactttttccctacactgtgcctggaagaccatggcaatggtcctgtcaatcgtaagccttttcccactctgcctgagtacaacttctcagaaaaccacgtggttgcccgtgctgttaggctccctcgggtgtaagcctctgacaatgtttcttatagctgaaaataagatctggggacgacgcagctggcccctgaacgagggtattatggccgttggcatcgtgtcgattttgctctcatctctgctaaaaaacgacgtcccactggccgggcctcttatcgctggaggcatgctcatagcatgctatgtgattagtggttccagcgccgatctgtctttggaaaaggcggctgaggtaagctgggaggaagaggccgaacattccggggcatcacacaatatcttagtggaggtccaggacgatggaaccatgaaaatcaaggacgaagagcgggatgacactctgacaattctcctgaaagccacccttctggctgttagtggcgtgtaccccttgagcataccagcaactctattcgtgtggtatttctggcaaaagaaaaagcagagatctggcgtcctgtgggatacaccgtcccctcccgaggtggaaagggccgttctcgacgacgggatctaccgtattatgcagcgcggactgcttggtcggtcacaggtaggcgtgggggtctttcaagagaacgtgttccataccatgtggcacgttacgagaggagcggtgttaatgtatcagggcaagaggctggaaccaagttgggctagcgtcaaaaaggatctcatctcctacggtgggggatggcgattgcagggctcttggaatactggcgaggaggtgcaggtaattgccgtcgaacccgggaaaaaccctaagaatgtgcaaaccgcaccaggaacatttaaaacccccgagggtgaagttggcgccatcgctctggacttcaagcctgggacatcgggaagcccgatagtgaaccgggagggcaagatcgtcggtctctacgggaatggagtggttactacctcaggcacgtatgtgtccgccattgcacaggctaaagccagtcaggaaggcccactgcccgagatcgaggatgaagtctttcgcaagagaaaccttacaattatggacctgcaccctgggtctggaaaaactaggcggtacttgccagcgatcgtgcgagaggccataaagagaaaactacgcaccctgattctcgcacccacaagggtagtggctagcgaaatggccgaggctttaaagggtatgcctatccgttatcaaaccactgcagttaagtccgaacataccggcaaagagatcgtcgatctgatgtgtcacgccacattcacgatgcggcttctgtcaccggtgagagtgcccaattacaacatgattatcatggacgaggcccattttactgatccatctagcatagctgcgagggggtatattagtacccgcgtcggaatgggcgaagcagccgctatcttcatgacagccacccctcccggttccgtagaggcatttccacagagcaatgccgtgattcaggacgaagagcgagatatccctgaaagatcttggaactcagggtacgagtggataactgacttccccggaaagacagtttggtttgtgccatccattaaaagtggcaatgatatcgctaactgcctccggaagaatggcaaaagggtcatccagttgagccgcaagaccttcgacacggagtatcaaaagactaaaaacaacgactgggattacgtggttacaaccgacatttcggaaatgggggcgaatttccgtgccgatagagtgatcgacccgcggaggtgcctgaagcctgtcattctcaaagatggacccgagcgcgtgatactggcaggtccaatgcccgtaaccgtggcttctgccgcacagcgaagaggccggatcgggaggaaccacaataaggaaggagaccagtacatttatatgggccagcctcttaacaatgatgaggaccatgcccactggactgaggctaaaatgctactggataacatcaatacaccagaaggtatcattcccgccttgtttgagcctgaacgcgagaagtccgcggcaatagacggggaatacagattaaggggcgaggcccggaagaccttcgttgagctgatgcgtcgcggagatctcccggtctggctgagctataaagtggcttcagaaggctttcaatacagtgaccgaagatggtgtttcgatggggagaagaacaatcaggtgcttgaagagaacatggacgtcgaaatctggacaaaagagggagagaggaagaaactgcggccacgctggctcgacgccagaacttattctgatcccttggctctgagggaatttaaggagttcgcagccggtcggcgatccgttagcggcgacctaattctggaaatcgggaaactccctcagcaccttacgcagagagctcaaaatgccctggataacttagtgatgttgcataattcagagcagggaggccgcgcatacaggcacgcgatggaagagctgcccgacaccattgagacactcatgctgcttgccctgatcgctgtactcactggtggggtgaccttgtttttcctgagtggccggggattaggcaagacaagcatagggctactgtgcgtcatggcctcctctgtgctcctttggatggcaagcgttgaaccacattggatcgctgcctccattatcctggagtttttcttgatggtgctgctcattcctgaacccgataagcagcgtaccccacaggacaaccaactggcatatgtcgtaatcggacttctctttatgatactgactgtggccgctaatgagatgggtttgctggagacgaccaaaaaggatttaggcattgggcacgttgcggtggaaaaccaccatcacgccgcaatgctagacgtcgatctgcatcctgcttcagcctggacactctacgccgtggcaactaccatcattacaccgatgatgagacacaccatcgagaacactacagctaatatatctcttacggccatcgcgaaccaggctgccattctgatgggattggacaaaggctggcccatcagtaagatggatattggtgtcccactgctcgcactggggtgttactcgcaggtgaatcctcttaccttaactgccgctgttctgatgctcgtggcacattatgccatcataggccccggattgcaagcgaaagctacaagggaagcccagaagcgcaccgcagccggcattatgaagaacccaaccgtagacgggatcgtggctatcgatctggaccctgtcgtttacgacgccaaattcgagaagcagctaggacagattatgctgctcatcctttgcacaagccaaatactgttgatgcggactacgtgggcactgtgtgaatccattaccctcgctacaggccccctgactaccttatgggagggttctccggggaaattttggaatacaaccatcgccgtgtcaatggcgaacattttccgaggaagctatcttgccggcgcaggtctggctttctccctcatgaagagtctaggcgggggaagaaggggcactggggcccagggagagacgctgggcgaaaaatggaagcgccagttgaatcagctgtctaagagcgagtttaacacatacaaacggtcaggtatcatggaagtcgatagatccgaggcaaaggaagggctcaaacgtggagagaccactaagcacgctgtgagtaggggcaccgccaaacttcggtggttcgtagagcgcaatctggtgaagccagaaggtaaggttatagacttgggctgcgggcgaggaggctggagctattactgtgccgggctgaaaaaggtgacagaggtcaaaggatatactaagggcggtcctgggcacgaagagcccatcccaatggcgacctacggatggaacctcgtgaaattacattctggcaaggatgtctttttcattccccctgaaaaatgcgacacactgctttgtgatatcggcgagtcctcaccgaatcccacgattgaggaagggagaaccctgagggtgctaaagatggttgagccatggctccggggaaaccaattttgcatcaagattctgaatccttacatgcccagcgtagtggaaactttggagcagatgcagcgcaaacacggtggcatgctggtcagaaaccctctctcgaggaattctacacatgagatgtattgggtgagttgtgggaccggaaacatcgtttccgctgtgaatatgactagccgaatgcttctgaaccggttcacaatggcacaccgtaagccaacctacgaaagagacgtcgatttaggcgccggtacgcgccacgtggctgtagagcccgaagtggccaacctggacataattgggcagaggatcgagaatatcaaacatgaacacaagtcaacctggcattatgatgaggacaacccttacaaaacatgggcatatcacggatcctacgaggttaagccatctggcagcgccagttccatggtcaatggcgtggtgaagttgctcactaaaccctgggatgtcattccgatggttacccaaatagctatgacagacactaccccttttgggcagcagcgggtgttcaaggaaaaagtagacacaagaaccccaaaggcgaaacgcggaactgcccaaatcatggaggtgacggcaaagtggctgtggggttttctaagcaggaacaagaaaccccgaatttgcacacgggaagagttcaccagaaaggtcaggtctaatgctgccatcggcgcagtgtttgttgatgaaaaccagtggaattcagccaaagaggctgtggaggacgaacgcttctgggatcttgtccatcgtgagcgggaactgcacaagcaggggaaatgcgccacttgtgtgtataacatgatgggaaagagagagaagaaactcggcgaatttggtaaggcgaaagggagtagggcaatttggtacatgtggctgggagcccgcttcttggagttcgaggctctgggctttatgaatgaagaccactggttctcccgagagaacagcctctctggcgtagaaggggagggacttcataagctgggttacatcttacgggatatatcgaaaatccctggcgggaatatgtatgccgacgataccgcaggatgggacacaagaattacggaggatgacctgcagaacgaagctaggatcaccgatattatggagccagaacacgccttgctcgctaagtcaatctttaaactgacttaccaaaataaggttgtgcgcgtccagagacccgccaagaacggcacagtgatggacgtgataagccggagggatcagcgtggttccgggcaggtcggaacctatggcctaaatactttcacaaacatggaggcacaacttattcgacagatggaaagtgagggcatcttttctccgagcgagctggaaacccctaacctcgcggagcgcgttctggactggttggaaaaatacggggtggagagattaaagcggatggccatctccggagacgattgcgtagtgaaacccattgacgataggttcgctacagccctgactgcactcaatgacatgggtaaggtccgcaaagatataccacagtgggaaccttcaaagggctggaacgactggcagcaagtgcccttttgtagtcatcacttccaccagcttatcatgaaggatgggagagagattgttgtgccatgccggaatcaggacgagctggtcggaagggctcgagtgtctcagggcgccggttggagcctacgtgaaaccgcatgtctggggaaatcctatgcccaaatgtggcagctcatgtactttcatagacgcgatttgcggctggcggctaacgccatctgctcagcagtacccgttgactggattcctacgagcaggaccacatggtctatccacgcccatcaccagtggatgactaccgaggatatgctttccgtgtggaatagagtctggatagaagagaacccatggatggaagacaagacacatatcagtagctggggagacgtgccgtatctgggcaaacgcgaggatcaatggtgtggctcgctcattgggttaactgctcgggccacctgggcaacgaatatccaggttgctattaaccaggtgaggcgactgatcggaaatgagaactacttggactacatgacatccatgaagagattcaaaaatgaatctgatcccgagggtgccctgtggtga

SEQ ID NO: 13970 - RNA, 9879 nt, synthetic construct
  misc_feature 1..9879: note = derived and/or modified CDS sequence (opt3) from DENV-1__GU131811__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaatcggagagcaccgccgagacaagcgtagcgtggccctggcaccccatgtcggccttggtctggagacgagaactgaaacctggatgtcctctgagggggcctggaaacagattcagagggtggaaacatgggctttgcggcaccctggatttactgttatcgcactcttcctggcccatgctattggcacctcgatcacacagaagggcataatctttattctgctcatgttagtgaccccatcaatggccatgcgctgcgtcgggatcggaagcagagatttcgtggagggtctgagtggcgcgacgtgggtagacgttgtgcttgagcacgggtcctgtgtcactacaatggcaaaggataaacccaccttggacattgaactgctaaagactgaggtgacaaaccctgccgtgctcaggaaactgtgcatcgaagctaagatatctaataccacgaccgatagccggtgtccaacacaaggagaggccactcttgtcgaagagcaggacgcaaactttgtttgccgccgaaccttcgtggatagaggctggggtaatgggtgtggactgtttggcaaaggctccttgattacatgcgctaagttcaagtgcgtaactaaactcgaggggaagatcgtgcagtacgaaaacctgaaatattcagtcattgtgaccgttcacacaggagaccagcatcaagtgggtaatgagagtaccgaacacggcactacggccacaatcaccccccaggcgcctagcactgagatccagttaaccgactacggggccctgacactcgattgttctccaaggaccggacttgactttaacgaaatggtcctgttgactatgaaggagaaatcctggctagtgcataagcagtggttcctggatctcccgctgccctggacatcaggcgcaagcacgagtcaagagacctggaatcggcaggaccttctggtaacttttaaaacagctcacgccaagaagcaggaagttgtggtcttgggttctcaagagggggctatgcacaccgccctcacaggcgcaactgaaattcagacctccggaacgaccacaatattcgccggccatctgaaatgccgtttaaagatggataaactgactctaaaggggatgagctatgtgatgtgtaccggatcgttcaaactcgagaaggaagtcgctgagacacagcacggtactgtgctggttcagatcaagtacgagggcaccgacgcgccttgcaaaattccattttctacgcaagatgaaaagggggtgacacagaacggacgccttatcaccgcaaatcccatagtaactgacaaagagaagcctgtcaacattgaagccgagccacccttcggcgagtcctatatcgtgatcggtgttggggaaaaagctttgaagctgtcatggtttaagaaaggcagtagcattggaaagatgttcgagacaaccgccagaggcgcaaggcggatggccatcctcggggatactgcttgggactttggatccattggtggcgtgttcacctctgtcgggaaactggtgcatcagatatttggaacagcctacggcgtacttttcagcggtgtgtcatggacgatgaagatcgggattggcgttctgttgacctggctcggactgaatagtcgatccactagcttatctatgacatgtatcgcagtcggcctggtgaccctatacctcggggtgatggtccaggcggattcaggatgcgttatcaactggaaaggccgcgaactgaagtgtggtagtgggatttttgtgacaaatgaggtgcacacttggaccgaacaatataagttccaggctgacagcccgaaaagactttccgccgcaataggaaaggcctgggaggagggcgtatgcggtatcaggtctgctacgcggttggaaaacattatgtggaaacagatctcgaacgagctgaatcatattctcctggaaaacgacatgaagttaacagtcgtggttggcgatgtggccgggatcctggcacagggaaaaaagatgatacgccctcaacccatggagtacaaatatagctggaagtcctggggcaaggctaaaatcattggggccgacgtccagaataccacttttatcattgatggaccaaacacccctgaatgtcccgacgatcagagagcgtggaatatctgggaggtggaggactacggcttcggtatatttacaactaacatttggcttaagttgagggattcatatacccaggtttgcgaccaccgtctcatgagtgccgctatcaaagattctaaggcagtgcacgccgacatggggtactggattgaaagcgagaaaaatgaaacatggaagctggctcgggcctccttcatcgaggtaaagacgtgtatatggccaaaatcacataccctatggagcaacggagtcctggaatctgagatgatcattcccaagatctatggcggtcctatttcccaacacaattaccgaccaggctacttcactcagacagcagggccgtggcatctcggaaaactggagcttgattttgacttgtgcgaaggcaccactgtggtggtcgatgagcactgcgggaacagaggacccagtctgaggacaaccacggttactggcaagatcatacacgaatggtgttgccgcagctgtaccttacctccactccggttcaaaggtgaggacgggtgctggtatggaatggagattagacccgtgaaggaaaaggaggaaaatctggtaaaatctatggtgtccgcgggctcaggtgaggtcgacagttttagccttggcctgttgtgtatctcgatcatgattgaagaggtgatgaggtcccgctggtctcgaaagatgctcatgacagggaccctggccgttttctttctactgatcatgggacagctcacttggaacgatctgattcggctttgcataatggtgggcgctaatgccagcgaccgtatggggatgggaacaacctacttggcactgatggctacattcaaaatgagacctatgtttgccgtcggcttactcttcaggcgcctgacttcacgggaggtgcttctgctaaccatcggtctcagtctggttgcatccgtggaattgccaaactctctggaggaattaggggatggactcgccatgggcattatgatcctgaagcttctgacggactttcaaagccatcagttgtgggctacactcctgtccatgaccttcattagaactaccttttcactacactatgcgtggaaaacaatggccatggtcctgagcatcgtaagtcttttccccctctgtctgtctactacctcccagaagacgacatggttgccggtgctgttaggcagcctcgggtgcaagcctctgaccatgtttcttatagcagagaataaaatctggggaaggaagtcgtggccactgaacgaaggtattatggctgttggcatcgtgtcaattttgctctctagtctgctaaaaaacgatgtccccctggccgggcctcttatcgccggaggcatgctcatagcttgttacgtgatttccggtagctctgcagacctgagcttggagaaggccgcggtagtgtcctgggaggaagaggctgaacattcaggggccagtcacaatatcttagtcgaggttcaggatgacggaactatgaaaatcaaggatgaagagcgagacgatacactgaccattctcctgaaagcaactcttctggccgtgagcggcgtgtatcccttgtctataccagctacactattcgtctggtacttctggcaaaagaagaaacagcgctccggcgtgctgtgggacaccccttcacccccagaggttgaacgggcagtactcgatgacgggatctatagaattatgcagaggggactgcttggtcgtagtcaggtgggcgtcggggtgtttcaagagaacgttttccatacgatgtggcacgtgactcgcggagccgtcttaatgtaccagggcaagcggctggaaccgagctgggcgtccgtgaaaaaggacctcatctcttacggtgggggatggagattgcagggctcgtggaataccggcgaggaggtacaggtcattgctgtggaacctgggaaaaaccccaagaatgttcaaacagccccaggaacctttaagacaagcgagggtgaagtgggcgcaatcgccctggatttcaaacccgggacttcaggatcccctatagtcaacagggagggcaaggtggttggtctctatgggaatggagtggtcaccacgagtggcacatacgtgtctgctatcgcccaggcaaaagctagccaggaaggcccactgcccgagattgaggacgaagtatttcgaaagcggaaccttactatcatggatctgcaccctgggtccggaaaaacccgcagatatttgccggccattgtgagggaggcgatcaagcggaagctacgaacactgatactcgccccaaccagagttgtcgcatcagaaatggctgaggccttaaaaggtatgcccattcgctaccaaactaccgctgtgaagtctgaacatacaggcaaagagatcgtggacctgatgtgccacgcaacgttcactatgaggcttctgagccctgtccgtgtaccaaattataacatgatcattatggatgaggcccattttaccgaccccagttccatcgccgctcgggggtacataagcacaagagtgggaatgggcgaagcggcagccattttcatgaccgctactcctccgggttctgttgaggcctttccccagtcaaatgcagtgatccaggatgaagagagggacattccagaacgctcctggaacagtgggtatgagtggatcacagatttccctggaaagaccgtctggtttgtgcccagcataaaatcgggcaatgacattgccaactgtctccgaaagaatggcaagagagttatccagttgtctcggaaaacgttcgatactgagtaccaaaagacaaaaaacaacgactgggactacgtggtcaccaccgatatctccgaaatgggggctaatttcagggcggaccgcgtgattgatccacgtagatgcctgaagcctgtaatcctcaaagacggacccgagcgggtgattctggccggtccaatgccggttactgtcgcaagcgctgcccagaggcgcggccgaatagggagaaaccacaataaggaaggagatcagtatatctacatgggccagcctcttaacaatgacgaggatcatgcacactggacagaggccaagatgctactggacaacattaatacccccgaaggtatcatcccagctttgtttgagcccgaacgggagaaatcagccgcgattgatggggaatataggttacgcggcgaggcaagaaagacattcgtggagctgatgaggcggggagacctccctgtgtggctgagttacaaagtcgcctctgaaggctttcaatattccgatcgtcgctggtgcttcgacggggagcgaaacaatcaggttcttgaagagaacatggatgtggaaatatggactaaggagggagagagaaaaaagctgaggccacggtggctcgacgctcgcacgtacagcgaccccttggccctgagagaatttaaagagttcgctgcaggtaggcggtcagtaagtggcgatctaatcctggaaattgggaagctccctcagcaccttacccagcgagcccaaaatgctctggacaacttagtgatgttgcataatagcgagcagggaggcagagcctatcgccacgcaatggaagagctgccggatacaatcgagactctcatgctgcttgcgctgattgccgtcctcaccggtggggtgacattgtttttcctgtccggcaggggattaggcaagacctctatcgggctactgtgtgttatggctagctccgtgctcctttggatggcctcagtcgaaccacattggatagcagcttctatcattctggagtttttcttgatggtactgctcatccccgaacctgaccggcagcgtactccccaggataaccaactggcctacgtggttattggacttctctttatgatcctgacggtggcagccaatgagatgggtttgctggagaccacaaaaaaggacttaggcatagggcacgtcgctgtggaaaaccaccatcacgcggccatgctagatgtcgacctgcatccagcaagtgcttggactctctacgccgtggccaccacaattatcacccctatgatgagacacactattgagaacacaacggcaaatatctcgcttaccgctatagccaaccaggcggctatcctgatgggattggataaaggctggcccattagcaagatggacatcggtgttccactgctcgccctggggtgctattcccaggtgaatcctcttactttaacagcagccgtactgatgctcgtggctcattacgcaattatcggcccgggattgcaagccaaagcgaccagggaagctcagaagcgcaccgccgcaggcataatgaagaaccccacagtcgatgggattgttgccatcgacctggatccagtggtctatgacgctaaattcgagaagcagctaggacagatcatgctgctcattctttgtacttctcaaatcctgttgatgcggacgacctgggccctgtgcgaatcaataacactcgcaactggccctctgaccacattatgggagggtagccccgggaaattttggaataccactattgctgtgtccatggccaacatcttccgaggaagttaccttgcgggcgccggtctggcattctctctcatgaagagcctaggcgggggaagaaggggcacgggggctcagggagagacactgggcgaaaaatggaagcgccagttgaatcagctgtcaaagtccgagtttaacacctataaacggagtggtattatggaagtagacagaagcgaggccaaggaagggctcaaacgtggagagactaccaagcacgcagtgtctaggggcacagctaaacttcggtggttcgttgagcgcaatctggtgaagccagaaggtaaggtcatcgatttgggctgtgggcgaggaggctggtcctactattgcgccgggctgaaaaaggtgactgaggtcaaaggatacaccaagggcggtcctgggcacgaagagcccataccgatggccacatacggatggaacctcgtgaaattacattcaggcaaggacgtttttttcatcccacctgaaaaatgtgatacgctgctttgcgacattggcgagagctcgcccaatccaaccatcgaggaagggagaactctgagggtactaaagatggtggagccctggctccggggaaaccaattttgtattaagatcctgaatccttatatgccgtctgtcgtggaaacattggagcagatgcagcgcaaacacggtggcatgctggttagaaaccccctcagtaggaattccacccatgagatgtactgggtgagctgcgggactggaaacattgtctcagcggtgaatatgacatcccgaatgcttctgaaccggttcaccatggctcaccgtaagccaacgtatgaaagagatgtagacttaggcgcaggtacccgccacgtggccgttgagcctgaagtcgctaacctggatatcatagggcagaggattgagaatatcaaacatgaacacaagtctacatggcattacgacgaggataacccctataaaacttgggcctaccacggaagctatgaggtgaagcctagtggctccgcaagctctatggtgaatggcgtcgttaagttgctcaccaaaccatgggacgtgatccccatggtaacacaaattgccatgactgataccacaccttttgggcagcagcgggtgttcaaggaaaaagtcgacaccagaactccaaaggctaaacgcggaacggcgcaaataatggaggtgacagccaagtggctgtggggttttctatcaaggaacaagaaaccccgaatctgtacccgggaagagttcactagaaaggttaggagtaatgcagctattggcgccgtgtttgtcgacgaaaaccagtggaattccgcaaaagaggccgtggaggatgaacgcttctgggaccttgtacatcgtgagcgggaactgcacaagcaggggaaatgcgctacctgcgtttacaacatgatgggaaagagagagaagaaactcggcgaatttggtaaggccaaagggagcagggcgatctggtacatgtggctgggagcacgcttcttggagttcgaggccctgggctttatgaatgaagatcactggttctctcgagagaactcgctctcaggcgtggaaggggagggacttcataagctgggttatattttacgggacatcagcaaaataccgggcgggaatatgtacgctgatgacacagccggatgggatacgagaatcaccgaggacgatctgcagaacgaagcaaagattactgacatcatggagcctgaacacgctttgctcgccaaatccatttttaagctgacatatcaaaataaggtcgtgagggtgcagcgcccagctaaaaacggcaccgtcatggatgttatcagtagacgggaccagaggggttctgggcaggtgggaacttacggcctaaatacattcaccaacatggaggcccaacttatacgtcagatggaaagcgagggcattttttccccctcagagctggaaacacctaacctcgcagggcgagcgctggattggttggagaagcatggagtagaacgcttaaaaagaatggccatcagtggtgacgactgtgtggtcaagccaatcgatgaccggttcgctactgccctgaccgcactcaatgatatgggcaaagtgaggaaggacattccccagtgggagccgtctaaggggtggaacgattggcagcaagttcctttttgcagccaccacttccatcagcttataatgaaagacggacgcgaaatcgtggtcccctgtagaaatcaggatgagctggtgggccgggctagggtatcccagggtgccgggtggtcactacgagagacggcatgcctgggaaagagctatgcccaaatgtggcagctcatgtactttcaccgtagagacttgcgcctggcggctaacgccatttgttctgcagttccagtggattgggtccctacctcccggacaacttggagtatccatgcccaccatcagtggatgaccacagaagacatgcttagcgtgtggaatagggtttggattgaggaaaacccctggatggaggataaaactcacatctcgtcctggggcgacgtgccatatctgggcaagagagaagaccaatggtgcgggtctctcataggattaaccgctcgcgccacgtgggcaacaaatatccaggtcgctattaaccaggtgcggaggctgttgggtaatgagaactacctggattacatgacctcaatgaaacgattcaagaatgagagcgaccccgaaggcgccctctggtga

SEQ ID NO: 13971 - RNA, 9882 nt, synthetic construct
  misc_feature 1..9882: note = derived and/or modified CDS sequence (opt3) from DENV-1__JF937615__SS-prME
  source 1..9882: mol_type = other RNA
agcgtgaccatgctgctcatgcttatgcccactgccctggctttccacttgactacgagaggaggggaacctcatatgatcgtctccaagcaggaaaggggaaaatctttactgtttaagacctcagccggtgttaatatgtgcacactaattgccatggacctcggcgagttctgtgaagatactatgacctacaaatgcccacggatcaccgaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccgatcctgccgtgctcaggaaactgtgcattgaagctaagatctctaacacgaccacagacagccggtgtccaactcagggagaggccacccttgtcgaagaacaggatgcaaattttgtttgccgccgaacattcgtggacagaggctggggtaacgggtgtggactgtttggcaaaggctccttgatgacttgcgctaagttcaagtgcgtaaccaaactcgaggggaagatagtgcagtacgaaaatctgaaatattcagtcattgtgacagttcacaccggagaccagcatcaagtgggtaacgagagtactgaacacggcacgacagccaccatcactccccaggcgcctagcaccgagattcagttaacagattacggggccctgaccctcgactgttctccaaggactggacttgattttaatgaaatggtcctgttgacaatgaaggagaaatcctggctagtgcataagcagtggttcctggacctcccgctgccctggacgtcaggcgcaagcaccagtcaagagacttggaaccggaaagatcttctggtaacatttaagaccgctcacgccaagaaacaggaagttgtggtcttgggttctcaggagggggctatgcacacagccctcactggcgcaaccgaaatccaaacgtccggaaccacaactatcttcgccggccatctgaagtgccgtttaaaaatggacaagctgaccctaaaagggatgagctatgtgatgtgtacagattcgttcaagctcgagaaggaagtcgctgagactcagcacggaaccgtgctggttcagattaaatacgagggtacggacgcgccttgcaagataccattttctacacaggatgaaaaaggcgtgacccaaaatgggcgccttatcactgcaaaccccattgtaacagacaaggagaaacctgtcaatatcgaagccgagccacccttcggagagtcctatatagtgattggcgctggtgaaaaggccttgaagctgtcatggtttaaaaaggggagtagcatcggcaaaatgttcgaggcaaccgccagaggagctaggcggatggccatcctcggcgatactgcatgggactttgggtccattggaggtgttttcacctctgtgggcaagctggtccatcagatctttgggacagcgtacggagtgcttttcagcggcgtatcatggacgatgaaaattggtataggggtgctgttgacctggctcggcctgaacagtcgatccactagcttatctatgacatgtatcgctgttggactggtcaccctatacctcggcgtgatggtgcaggccgactcagggtgcgtcattaattggaagggacgcgaactgaagtgtggcagtggtatctttgttacaaacgaggtgcacacttggaccgaacagtataaattccaagcagatagcccgaagagactttccgccgctatcgggaaagcctgggaggagggagtgtgcggcattaggtctgcaacgcggttggaaaatataatgtggaagcagatctcgaacgagctgaaccatattctcctggaaaatgacatgaaatttacagtagtcgtgggtgatgttgctggcatcttagcccaggggaagaaaatgattcgccctcagcccatggagtacaagtatagctggaagtcctggggaaaagcgaagatcataggcgccgacgtgcaaaacaccactttcatcattgatgggccaaatacccctgaatgtcccgacgatcagagagcttggaacatctgggaggtcgaggactacggatttggcattttcacaactaatatctggctgaaacttagggattcatatacccaggtgtgcgaccaccgtttgatgagtgcagccataaaggattctaaagctgttcacgccgacatgggttactggattgaaagcgagaagaacgaaacatggaagctcgcacgggcgtccttcatcgaggtgaaaacgtgtatttggccaaagtcacataccctgtggagcaatggggtactagaatctgagatgatcatacccaaaatctatggaggccctatttcccagcacaactaccgaccaggttactttactcaaacagccggcccgtggcatctggggaagctcgagctggatttcgacctttgcgaaggaaccactgtcgtggtggacgagcactgcggcaatagagggcccagtttgaggacaaccacggtcactggaaaaatcattcacgaatggtgttgccgcagctgtaccctgcctccattacggtttaagggcgaggatggttgctggtatgggatggagatcagacccgttaaggaaaaagaggaaaacctcgtgaagtctatggtatccgctggatcaggcgaggtggacagtttcagcctgggtcttctgtgtatatcgattatgatcgaagaggtcatgaggtcccgctggtctcgaaaaatgttgatgacaggcaccctcgccgtgtttttcctgctaatcatggggcagctgacttggaatgatctcattcggctgtgcatcatggttggagcaaacgctagcgaccgtatgggcatggggacaacctaccttgccttgatggcaacatttaagatgagacctatgttcgccgtgggactgttatttaggcgcctcacttcacgggaggtcctgcttctgaccattggcctaagtctcgtggcttccgttgaactgccaaattctttggaggaactgggtgatgggttagcgatgggaataatgatcctcaaactgcttattgacttccagagccatcaactgtgggccacgttgctctccctgacatttatcaagaccactttctcactacactatgcatggaagaccatggctatggtgctgagcattgtcagtctttttcccctcctgccggtacatgatttgcctaaaaagacaacttggctgccagtgttactcggctctctgggctgtaaaccccttaccatgttcctgatcgccgagaacaagatatgggggagaaaatcctggcctttgaatgaaggaatcatggccgttggtattgtgagcatcctcctgtcggctctactgaagaacgacgtcccccttgcaggcccactcattgccgggggaatgctgatcgcgtgctacgtgatatcaggctctagtgctgatttgtccttagagaaagccgcagaggtaagctgggaagaggaagccgagcactctggtgctagccataacattctggtggaagtccaggacgatgggacgatgaagatcaaggacgaggagagggatgacacactcaccatcctgcttaaagcaactctgttggccgtttccggagtgtatcctctatcaattcccgcgacactgttcgtgtggtacttttggcagaagaaaaagcagcgaagtggcgtcctctgggacaccccaagcccgcctgaagtggagcgcgctgttctggatgacggcatatatcggatcatgcaaagagggcttttaggaaggtctcaggtaggtgtgggcgtcttccaggaaaatgtgtttcacactatgtggcacgttacacgtggggccgtgctgatgtaccagggaaaacgcctcgagccctcctgggcatcagtcaagaaggatttgattagttacggcggtgggtggcggctgcaaggaagctggaacaccggcgaggaagtgcaggtaatcgccgtcgagccaggcaaaaatcccaagaacgtgcagacggctcctgggactttcaaaacctccgaaggagaggttggtgccattgcactcgactttaagccaggcacatctgggtcgcccatcgtgaatagagaaggaaaaatagtcggcctgtatggtaacggggtggttaccacaagcggaacttacgtgtcagctatcgcccaggcgaaggcctcccaagagggccctcttccggagattgaagatgaggtcttcaggaagcgaaatctgaccatcatggacttgcatccaggcagtgggaaaacgcggcgctatctacccgcaattgtgagagaagctatcaagaggaaactgcggacactcatattagcccctactcgagtagtggcttctgagatggcagaagccctgaagggaatgccaattagataccagaccacagccgttaaaagcgagcacaccggtaaggagatcgtcgatcttatgtgtcatgctacttttaccatgcgcctgctctcccccgtgagggtgcctaactataatatgatcattatggacgaagcgcacttcacagatccgtcatctatcgcagcccgtggctacataagcacgcgggtcgggatgggagaggctgccgcaatttttatgactgccacacccccaggcagtgtagaggctttccctcagtccaacgcggtgatccaagacgaggaaagagatattcccgagaggagctggaactctggttatgagtggatcacagactttccagggaagaccgtttggttcgtgccttcaataaaatccggaaacgacattgccaattgcttgcgcaagaacggcaaacgagtcatccagctgagtagaaagactttcgatacagaataccagaaaaccaagaataacgactgggattacgtggttacgactgacatcagcgagatgggcgcaaactttcgggctgatagggtgattgacccccgccgttgtctcaagccagtcatcctgaaagatgggccggaaagagtgattcttgccggacctatgcccgtaacagtggcatcggccgctcagcggaggggtcgcataggccgaaatcataacaaggagggggaccaatatatctacatgggacagccactaaataacgatgaggaccacgcccactggaccgaagcgaaaatgctgttggataatattaacacccccgagggcatcatccctgcattattcgaaccagagagagaaaagtctgccgctattgacggtgagtatcggctgcgcggggaagccaggaaaacttttgttgaactcatgagaaggggcgatctgcccgtctggctttcctacaaggtggctagcgagggattccagtattcagaccggcgttggtgctttgacggcgaacgcaataaccaggtgctggaggaaaatatggatgtcgagatatggacaaaagagggggaacgaaagaagctcagacctaggtggttggacgcacggacctacagtgatccgctggccctacgcgagttcaaagaatttgctgccggaagaaggtctgtttccggtgacctgatcctcgagattggcaaacttccacaacatctgacacagcgggcacagaacgcgttagataatttggtgatgctgcacaacagcgaacaagggggacgagcctatagacatgctatggaggagctccccgacactatcgaaacgctgatgttccttgccctgattgcagtactcaccggcggtgtgacattgtttttcctgtcagggcgcggcttaggaaaaacaagtatcggcctactgtgcgtcatggctagctccgtgctcctttggatggcctctgttgagcctcactggatagcagccagcatcattctggaatttttcttgatggtgctgctcatccccgagccagataggcaacggacccctcaggacaatcagctggcttacgtcgtaattgggcttctctttatgatcctgacagtggcggccaacgagatgggattgctggaaaccactaagaaagatttaggtataggccacgttgcagtggagaatcatcaccatgctgccatgctagacgtcgatctgcaccccgcctccgcatggacgctctacgctgtggccaccacaattatcactccaatgatgcgtcataccattgaaaacacaaccgcgaacatctcacttactgctatagccaatcaggcagccatcctgatggggttggacaagggatggcctatttctaagatggatatcggcgtcccgctgctcgctctgggttgttatagtcaagtgaacccccttacattaacggcagccgttctgatgctcgtggcgcactacgctattatcgggccaggcttgcaggccaaagcaaccagagaggcccagaagaggactgctgccggaataatgaaaaatcctacagtagacggcattgtggcaatcgacctggatcccgtcgtttatgacgctaagttcgaaaaacaactagggcagatcatgctgctcattctttgcacctcgcagatcctgttgatgcgcaccacatgggccctgtgtgagagcataactctcgcgacgggaccactgaccacattatgggagggctcccctggtaagttctggaacactaccattgccgtgtctatggcaaatatctttcgggggtcataccttgctggagccggcctggcattcagcctcatgaagtccctaggtggcgggcgaagaggaacaggcgctcagggggaaaccctgggagagaaatggaagaggcaattgaaccagctgagtaaatctgaatttaatacttataagcgcagcggcattatggaggtcgatcggtcagaagccaaagagggtctcaagagaggggagacgacaaagcacgccgtgtcccgtggaaccgcgaaacttaggtggttcgtagaacggaacctggtgaagcccgagggcaaagttatcgacttgggttgcggccgcgggggatggagttactattgtgctggcctgaagaaagtgactgaagtcaaggggtacaccaaaggaggcccgggtcatgaggaaccaatacctatggcaacatacgggtggaatctcgtgaagttacacagcggaaaggatgtctttttcatacccccagagaaatgcgacactctgctttgtgatattggcgagtcttcccccaaccctaccatcgaagagggccgaacactgagagtgctaaagatggttgaaccgtggctcagggggaatcagttttgcattaaaatcctgaacccctatatgccatcagtagtggagacgttggagcagatgcaacggaagcatggaggtatgctggtccgcaatcctctcagcagaaactcgacccacgaaatgtactgggtgtcttgtggcactgggaatattgttagtgccgtgaacatgacatccaggatgcttctgaatcgattcaccatggctcaccggaaacccacttatgagcgtgacgtcgatttaggagccggcacaagacatgtggcagtagaacctgaggtggccaacctggacatcataggtcagcgcattgaaaacatcaagcacgagcataagagcacctggcactacgatgaggacaatccatataaaacgtgggcttaccatgggtcatatgaagttaagccctccggatctgcgagcagtatggtcaacggcgtggtgaaattgctcaccaagccttgggacgtcatcccaatggttacacagattgccatgactgataccacaccctttggccagcaaagggtgttcaaagagaaggtagacactcggaccccgaaggcaaaaagagggacagctcagataatggaagtgaccgccaagtggctgtggggatttctatcccgcaataaaaagcctaggatctgcactcgagaggagttcacgcggaaagtcagaagcaacgcagccattggtgctgtgtttgttgatgagaatcagtggaactctgccaaggaggcggtggaagacgagaggttctgggatcttgtccaccgcgaacgtgagctgcacaagcaaggcaaatgtgcaacatgcgtgtacaatatgatggggaagcgggagaagaagctcggagagttcggcaaagccaagggttcaagagctatctggtacatgtggctgggggccaggtttttggagttcgaagcactgggatttatgaacgaggaccattggttcagtcgcgaaaattccctcagcggcgtagagggcgaggggcttcacaaactgggatatattttacgagatatctctaagataccaggtggcaacatgtacgctgacgataccgccgggtgggacactcggatcaccgaagatgacctgcagaatgaggctaagattacagatatcatggaacccgagcatgccttgctcgcaaaatcgatttttaagctgacgtatcagaacaaagttgtgagagtccagaggcctgcgaagaatggaaccgtgatggacgtgatctcacgcagagaccaacggggcagcggtcaggtcgggacttacggactaaacacattcaccaatatggaagcccagcttataaggcagatggagtccgagggcatttttagtccatctgaactggagactcccaacctcgctggccgtgttctggattggttggaaaaacacggggtggagcgattaaagcgcatggccatcagcggagacgattgcgtagtgaagccgatcgacgatagattcgcagctgccctgacagcactcaacgacatgggtaaagtccggaaggatattcctcaatgggaaccctccaaaggctggaatgactggcaacaggtgccattttgttcacaccatttccaccagcttataatgaaggatgggagggagatcgttgtgccttgccgcaaccaagacgagctggtcggcagagcacgggtgagtcagggcgcgggttggtctctaagggaaaccgcttgtctggggaaaagctatgcccagatgtggcagctcatgtactttcatcgacgtgatttgagactggcagccaatgctatttgctccgccgtacccgttgactgggtgccaacatcacgcactacctggagcatccacgcacatcaccaatggatgacgaccgaggacatgctttctgtctggaaccgggtgtggattgaagagaatccctggatggaagataagacacacatctccagttggggagacgttccttatctgggcaagagggaggatcagtggtgtggcagcctcatagggttaactgctagagccacctgggcgacaaacatccaggtggctattaatcaagtccgccggctgatcggaaacgagaattacttggactacatgacttcgatgaaaaggttcaagaacgaatccgatccagagggtgccctgtggtga

SEQ ID NO: 13972 - RNA, 9879 nt, synthetic construct
  misc_feature 1..9879: note = derived and/or modified CDS sequence (opt3) from DENV-1__GU131814__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaagacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaagcccctaccaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggatcgttcaaactggagaaggaagtggccgagacgcagcacggtacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgccagtgtggaactgccaaactccttagaggaactcggggatggactggctatgggcattatgatccttaaactgttgaccgacttccaatctcatcagctctgggcgactctgctaagcctgacctttattaagacaactttctcccttcactatgcctggaaaaccatggcaatggttctctcaatcgtgagcctgtttcccttgtgtctgagtacgacatctcagaagaccacttggttaccggtcctcctgggctcccttgggtgcaagcctctgacaatgttcttgatagctgagaataaaatctggggaaggcgaagctggccactcaacgaaggtattatggccgtaggcatcgtgtcgattctgctatcatctctgcttaagaacgatgttcccctcgccgggcctctgatcgctggaggcatgttgatagcatgttacgtgattagtggttccagcgccgacttatctctggagaaagcggctgaggtcagctgggaagaggaagccgagcattccggggcatcacacaatatcctcgtggaagtacaggatgacggaaccatgaagatcaaagatgaggagcgcgacgatactctgacaattcttctgaaggccaccttgctagctgtgagtggcgtctatcccctgagcataccagcaacgctctttgtttggtacttctggcagaaaaagaagcagcggtctggcgtgctgtgggacactccttcacccccagaagtggagagagccgtccttgatgacgggatctataggattatgcagcgtggattactgggtcgcagccaggtgggcgttggggtattccaagaaaacgtgtttcataccatgtggcacgtcacacggggagcggtgctcatgtaccagggcaaaagattggagccgagttgggctagcgttaagaaagacctgatctcctacggtgggggatggaggctccagggctcttggaataccggcgaggaagtgcaggtcattgccgtggagcctgggaagaaccccaaaaatgtacaaacaactccaggaaccttcaagacgcccgaaggtgaggtcggcgcaatcgccctggattttaagcctgggacatcgggaagcccaatagtgaaccgagaaggcaaaatcgttggtctttatgggaatggagtggtcactacctcaggcacatacgtgtccgctattgcccaggcaaaggctagtcaggagggccccctgcctgagatcgaagacgaggttttccggaaacgcaacttgaccattatggatctacacccggggtctggaaagactagaaggtatctgccagccatcgtgcgggaagcgataaaacgaaagctcagaaccttaattctggcccccacacgcgtcgtggcaagcgagatggctgaagcccttaagggtatgcctatcaggtaccaaacgactgctgtaaaatccgagcataccggcaaggagatcgtggacctgatgtgccacgcaacatttaccatgcgtctcttgtcaccagttcgggtccccaattataacatgattatcatggatgaagcccatttcactgacccttctagcatagccgctagagggtacattagtacaagggtgggaatgggcgaggcggcagccatctttatgaccgctacgccgcccggttccgtggaagccttcccacagagcaatgcagtcattcaggatgaggaacgcgacatccctgagcgatcttggaactcagggtatgagtggataactgattttcccggaaaaacagtatggttcgtgccatccattaagagtggcaatgacatcgccaactgtctgaggaaaaatggcaagcgggttatccagctcagcaggaagacctttgataccgaataccagaaaactaagaacaacgactgggactacgtggtcacaaccgatatttcggagatgggggctaatttccgcgcggaccgtgtgatcgatcctagacggtgcctgaaacccgttattcttaaggacggaccagaaagggtgatactagccggtccgatgcctgtcacagtggcatctgctgcccagcgccgaggcagaatcgggcggaaccacaataaagagggagatcagtatatttacatgggccagcccctgaacaatgacgaggatcatgcacactggactgaagccaagatgttgttagacaacatcaatacgccagagggtatcattcccgctctgttcgaacctgagagggaaaagtccgccgcgatagatggggagtatcgcctcagaggcgaggcaaggaaaacctttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacaaaagagggagaaaggaagaaattgcggccccgctggctggacgctagaacttactctgaccctctagccctgagggagttcaaggaatttgctgcaggtcggcgatccgtgagcggcgatctcattcttgagatcgggaaactgccgcagcacttaacccagagagcccaaaatgctttggacaacctggtcatgctccataattcagaacagggaggccgcgcctataggcacgcaatggaggagctgccagatacaattgaaacccttatgctgctcgcgttgatcgccgttctgactggtggggtgacgttattctttctaagtggccggggactgggcaagaccagcatagggctcctttgtgtaatggcttcctctgtgctgttgtggatggccagcgtcgagccccattggatcgcagcttccattatcctggagttctttctcatggtgctgcttattcctgagcccgaccgtcagagaacaccacaggataaccaactcgcctacgttgtgatcggactgttgttcatgatactgactgtcgcagccaatgagatgggtttactagaaaccacaaagaaagacctgggcattgggcacgtagctgtgggaaaccaccatcacgcggccatgctcgatgttgaccttcatcctgcatcagcttggaccctgtacgccgtggccactacaatcattacgcccatgatgaggcacaccatcgagaacactacagcaaatatatctttgaccgctatcgccaaccaggcggctattctgatgggcctcgataagggttggccaatcagtaaaatggacattggggtccctctgcttgccttaggctgctatagccaggtgaatccgctgaccctcacagcagccgtcttgatgctggtggctcattacgcaatcataggacccggcctacaagccaaggcgactcgcgaagctcagaaacggacggccgcagggattatgaagaacccaaccgttgatggaatcgtggccatcgacctggatcctgtagtgtatgacgctaagtttgagaaacagctcggccagattatgcttctgatcttgtgtacaagccaaatactgctcatgcgaactacctgggccctgtgcgaatccattacattagcaaccggtccccttactacgctgtgggaggggtctccaggaaagttctggaatacaaccatcgctgtctcaatggccaacatttttagaggcagctacctcgcgggtgccggcctagcattctccctgatgaaaagtctagggggaggcaggcgcgggactggagctcagggcgagaccctgggtgaaaagtggaaacggcagctcaatcagctttctaagagcgagttcaacacatataagagatcagggatcatggaagttgaccgttccgaggccaaagaaggactgaagaggggcgagactaccaaacacgcagtgagtcggggtacagctaagttgcgctggtttgtcgagcgaaatctggtgaaacctgaaggcaaggtaatagatctcgggtgtggaagaggcgggtggagctactattgcgccggattaaagaaagtgacggaggttaagggctacaccaaaggtgggcccggacacgaagaaccgatcccaatggccacttacggctggaacctggtgaaacttcattctggcaaagacgtcttctttattcctcccgaaaagtgtgatacactgctatgcgacatcggggagtcctcaccaaatcccaccattgaggaaggaaggactctccgggtgctgaaaatggtcgagccttggttgcgcggtaaccaattctgtatcaagattctgaatccgtatatgcccagcgtggttgaaacactcgagcagatgcagagaaagcacggcgggatgcttgtaaggaacccactgtcgcgaaattctacccatgagatgtactgggtgagttgcggaacgggcaacatcgtctccgcggtgaatatgaccagccggatgttactgaaccgttttacaatggctcacagaaaacctacttatgaacgcgatgttgacttgggtgcagggaccaggcacgtggccgtcgagcccgaagtggctaacctcgatataattggacagcggatcgagaatatcaagcatgaacacgagtcaacatggcattacgacgaggataacccttataaaacttgggcctaccacggctcctatgaagtaaagccatctggcagcgcaagttccatggtgaatggggttgtcaaactgctaaccaagccctgggacgtgattcctatggtgacacaaatagccatgaccgatactacgccattcggacagcagagagtctttaaggagaaagttgacacacgcacccccaaggctaaaaggggtactgcgcaaatcatggaagtgaccgccaagtggctttggggcttcctgagccgaaacaaaaagccgcggatttgtacaagagaggaatttacgaggaaggtacgctctaatgcagctatcggggccgtgttcgtcgacgagaaccagtggaactcagcaaaagaggccgtggaagatgagcgtttttgggacctcgttcatcgggaaagagagctgcacaagcagggaaaatgcgctacctgcgtgtacaacatgatgggcaagagggagaaaaagttgggtgagttcgggaaggccaaaggaagtcgcgcgatttggtacatgtggctgggcgcacgatttctcgagttcgaagcccttggcttcatgaatgaggatcactggttttcccgggaaaacagcctgtctggggtcgagggagagggtttacataagctgggctatatcttgagagacatatcgaaaatccctgggggaaatatgtacgctgatgacactgccggctgggatacaaggattaccgaagacgatctccagaacgaggcacgcatcactgacattatggaaccagagcacgctctgctagccaagtcaatcttcaaacttacatatcaaaataaggtggtaagagttcagcggcccgctaaaaacggtaccgtgatggatgtcataagcaggcgtgaccagcgagggtccggacaggtgggcacatacggcctgaatacttttaccaacatggaagcccaactcattcgccagatggagagtgaggggatcttctctcctagcgaactggagacgccaaacttggcagaaagagtgttagattggctggagaagtatggagtcgaacggctcaagaggatggcgatctccggtgacgactgtgttgtgaaacccattgatgaccgctttgccaccgctcttacagccctgaatgatatgggcaaggtaagaaaagacataccgcagtgggagccttcaaaggggtggaacgattggcagcaagtgcccttctgcagtcatcactttcaccagctaatcatgaaagacggacgggagattgtcgtgccatgtaggaatcaggatgaactggttggccgagcacgtgtgtctcagggtgctgggtggagcctcagagagactgcctgcttgggaaagtcctacgcacaaatgtggcagctgatgtatttccatcgccgggaccttaggctggccgcgaacgctatctgttcagccgtccctgtggattggattcccaccagcagaacaacttggtctatccacgcacatcaccagtggatgaccacggaagacatgctctccgtatggaatcgcgtttggatagaggaaaacccatggatggaggataagacacatatcagtagctggggcgacgtgccctacttaggcaaacgggaggaccaatggtgcgggtcgctgattggattgaccgccagggctacttgggccacaaatatccaggtcgcaattaaccaggtgcgaagactgatcggtaatgaaaactacctcgattatatgacctccatgaagcggtttaaaaatgagtctgaccctgaaggcgctctttggtga

SEQ ID NO: 13973 - RNA, 9879 nt, synthetic construct
  misc_feature 1..9879: note = derived and/or modified CDS sequence (opt3) from DENV-1__GU131815__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgccccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagagcaggacgccaacttcgtttgccgccgaacttttgtggatagaggctggggtaatgggtgtggattgttcggcaaaggctccctcataacctgcgcaaagtttaagtgcgtaacaaggctggaggggaaaattgtgcagtacgaaaacttaaagtattcagtcatcgtgaccgttcacactggagaccagcatcaagtgggtaatgagagtacggaacacggcacaaccgctactattaccccccaggcccctacaaccgagatccagctgactgactacggggcgctcacacttgattgtagcccacggacgggactggacttcaacgaaatggtcttgctaaccatgaaagagaagtcttggctggtgcataaacagtggtttctcgatctgccgcttccctggacttccggcgcctcaacaagccaagagacctggaatcgtcaggacctgttggtaacattcaagactgcacacgctaaaaagcaggaagttgtggtcctcggtagtcaagagggggccatgcacaccgctctgacgggcgccaccgaaatccagacatctggaactaccacaatttttgcaggccatttaaagtgccgcctgaaaatggataagctaactctcaaagggatgtcctatgtgatgtgtaccggaagcttcaagctggagaaagaagtcgccgagacgcagcacggtacagtgcttgttcagataaagtacgagggcaccgacgctccttgcaagatcccattcttgactcaagatgaaaaaggggtgacacagaacggaagactgattaccgcgaatcccatcgtaactgacaaggagaaacctgtcaacatagaagcagagccaccctttggcgagtcgtatattaccatcggtgccggggaaaaggctctcaaactgtcttggttcaagaagggctcctcaatcggaaaaatgtttgaggccacagcaaggggcgcccggcgaatggctattcttggggatacggcctgggacttcggaagtatcggtggcgtgtttaccagcgttgggaagctggtgcatcagattttcggaactgcatacggcgtcttgttttccggtgtgtcttggacaatgaaaatagggatcggcgtactcctgacctggttaggactgaatagccgctcaacaagtctatccatgacttgtattgcggtgggcctcgttaccctgtaccttggggtcatggtgcaggctgatagcggatgcgtgatcaactggaagggcagagaattgaaatgtggttctgggatcttcgtcacgaatgaggttcacacatggaccgaacaatataagtttcaggccgactcaccgaagaggctgagtgcagccattggaaaagcttgggaggagggcgtgtgcggtatacggagcgccactcgcctcgaaaacatcatgtggaagcagatttccaacgagctgaatcatatcttactggaaaacgacatgaaattcaccgtggtagtcggcgatgtggcagggattcttgctcagggaaagaaaatgatcagacctcaacccatggagtacaagtattcttggaaatcgtggggcaaggccaagataatcggggcggacgttcagaatacaacttttattatcgatggaccaaacacccctgaatgtcccgacgatcagagggcctggaatatttgggaggtggaggactacggcttcggtatctttacaacgaacatatggttgaaactccgtgatagctatacccaggtctgcgaccaccggctgatgtccgctgcaattaaggattcaaaagccgtgcacgctgacatggggtactggatcgaaagtgagaagaatgaaacttggaaactagcccgagcatctttcattgaggttaagacatgtatctggccaaagagccataccctgtggtccaacggagtgctcgaatcagagatgataatccccaaaatttatggcggtcctatcagccaacacaattacagaccaggctacttcactcagacagcggggccgtggcatctgggaaagcttgagttggattttgacctgtgcgaaggcaccacggtagtcgtggatgagcactgcgggaacaggggaccctctttacgcactaccacagtgaccggcaaaattatccacgaatggtgttgccggtcctgtactctccctccactgagattcaggggtgaggacgggtgctggtatggaatggagatacgccccgtcaaggaaaaagaggaaaatcttgttaagagtatggtgagcgccggctctggtgaggtagactccttttcactgggcttgctctgtattagtatcatgatcgaagaggtgatgcgaagccggtggtcgcgtaagatgctgatgacagggaccctagctgtcttctttctgctcattatgggacagctgacatggaacgatcttatcagattgtgcattatggtgggcgccaatgcatccgacaggatggggatgggaactacctacctggctttaatggccacgttcaaaatgcgccctatgtttgcagttggcctcctgttccggagacttacatctagggaggtgctgctactcaccataggtctgagcttggtcgcctcagtggaactgccaaacagtttagaggaactcggggatggactggctatgggcatcatgattcttaagctgttgactgactttcaatcccatcagctctgggcgaccctgctatctctgacattcatcaaaactacctttagccttcactatgcctggaagacgatggcaatggttctctccattgtgtcactgttccccttgtgtctgagcacaaccagtcagaaaactacatggttaccggtcctcctgggctctcttgggtgcaagcctctgaccatgtttttgatcgctgagaataagatatggggacgacgctcctggccactcaacgaaggtatcatggccgtaggcattgtgagcatcctgctatcgtcactgcttaaaaacgatgttcccctcgccgggcctctgattgctggaggcatgttgatcgcatgttacgtgatatctggtagttccgccgacttaagcctggagaaggcggctgaggtctcttgggaagaggaagccgagcatagcggggcatcccacaatattctcgtggaagtacaggatgacggaactatgaaaatcaaggatgaggagcgggacgatacactgaccatccttctgaaagccacgttgctagctgcatcaggcgtgtatcccctgagtattccagccactctcttcgtctggtacttctggcaaaagaaaaagcagagaagcggcgttctgtgggacaccccttctcccccagaagtggagagggcggtgcttgatgacgggatatatcgtatcatgcagcgcggattactgggtcggtcccaggtcggcgtgggggtttttcaagaaaacgtattccatacaatgtggcacgtgaccagaggagctgtcctcatgtaccagggcaagaggttggagccgtcatgggccagtgtgaaaaaggacctgattagctacggtgggggatggcgactccagggctcctggaatacaggcgaggaagttcaggtgatcgcagtcgagcctgggaaaaaccccaagaatgtgcaaactgccccaggaacctttaaaacgcccgaaggtgaggtaggcgctattgccctggatttcaagcctgggacatctggatcgccaatcgtcaaccgggaaggcaagatagtgggtctttatgggaatggagttgtgactaccagcggcacatacgtctcagcaatcgctcaggccaaagcgtcccaggagggccccctgcctgagattgaagacgaggtgtttcgcaagagaaacttgaccatcatggatctacacccggggagtggaaaaactaggcggtatctgccagccattgttcgagaagcaatcaagagaaaactccgcaccttaatactggctcccacaagggtggtcgcctctgagatggctgaagcacttaagggtatgcctattcgttaccaaacgactgccgtgaagagcgagcataccggcaaagagatcgtagacctgatgtgccacgccacattcaccatgcggctcttgtccccagtgagagttcccaattataacatgatcattatggatgaagctcattttactgacccttcatctgtcgcggcaagggggtacatcagcacacgcgtgggaatgggcgaggccgctgccatattcatgaccgcaacgccgcccggtagtgtggaagcctttccacagtccaatgctgtcattcaggatgaggaacgagacatccctgagagaagctggaactctgggtatgagtggattactgatttccccggaaagacagtatggtttgtgccatcaatcaaatccggcaatgacatagcgaactgtctgcggaagaatggcaaaagggttattcagctcagtcgcaagaccttcgataccgaataccaaaagactaaaaacaacgactgggactacgtggtcacaaccgatatcagcgagatgggggccaatttccgtgcagacagagtgatcgatcctcggaggtgcctgaagcccgttattcttaaagacggaccagaacgcgtgatcctagctggtccgatgcctgtcacagtggcctcggcagcccagcgaagaggccggattgggaggaaccacaataaggagggagatcagtatatatacatgggccagcccctgaacaatgacgaggatcatgctcactggactgaagccaaaatgttgttagacaacatcaatacgccagagggtattatccccgcgctgtttgaacctgagcgcgaaaagtctgcagccatcgatggggagtatagactcaggggcgaggctcggaagaccttcgtagaactgatgcgtcgcggagaccttccagtgtggctgtcctacaaagttgccagcgagggctttcaatattcagatcgaagatggtgcttcgacggggaaaggaacaatcaggtcctcgaggaaaacatggatgtggagatttggacaaaggagggagaacggaaaaagttgcgccccagatggctggacgctaggacttacagtgaccctctagcactgcgggagtttaaagaattcgccgctggtcgaagatctgtgtccggcgatctcatacttgagatcgggaagctgccgcagcacttaacccagcgcgcccaaaatgcattggacaacctggtcatgctccataatagcgaacagggaggcagggcgtatcggcacgccatggaggagctgccagatacaattgaaacccttatgctgctcgctttgatcgccgttctgactggtggggtgacgttatttttcctatcaggccgtggactgggcaaaaccagtattgggctcctttgtgtaatggcaagctccgtgctgttgtggatggcttctgtcgagccccattggatcgccgcaagcataatcctggaatttttcctcatggtgctgcttattcctgagcccgacagacagaggacaccacaggataaccaactcgcctacgttgtgatcggactgttgtttatgattctgactgtcgctgcgaatgagatgggtttactagaaaccacaaagaaggacctgggcatcgggcacgtagccgcagagaaccaccatcacgctgccatgctcgatgtggaccttcatcctgcctccgcatggaccctgtacgctgttgccactacaataattacgcccatgatgcgccacaccatcgaaaacactacagcgaatatttcattgaccgctatcgccaaccaggcagccatactgatgggactcgataaaggctggccaatctctaagatggacattggtgtgcctctgcttgctttagggtgctatagtcaggtcaatccgctgaccctcacagcagccgtgttgatgctggtcgcgcattacgctatcattggccccggactacaagccaaagcaactcgggaggcccagaagcgaacggctgccggcatcatgaaaaacccaaccgtggatgggatagttgcaattgacctggatcctgtggtatatgacgctaagttcgaaaagcagctcggacagatcatgcttctgatcttgtgtacatcgcaaattctgctcatgagaactacctgggccctgtgcgagagcatcacattagcgaccggcccccttactacgctgtgggagggttccccagggaaattttggaatacaaccatagccgtgtctatggcaaacattttcaggggatcatacctcgctggcgccggtctagcattcagcctgatgaagtccttgggcgggggacgccggggcactggggctcagggagaaaccctgggcgagaaatggaagagacagctcaatcagcttagtaaatctgaatttaacacatataagcgtagcggtatcatggaggtcgacaggtcagaagccaaggaggggctgaaacggggagagactaccaagcacgccgtttcccgcggcacagcgaaattgcgatggttcgtggaaagaaatctggtcaagcctgagggtaaagtgattgatctcggctgtgggaggggaggctggagttactattgcgctgggttaaagaaggtaacggaagtgaaaggatacaccaagggcggtcccgggcacgaggaaccgatcccaatggcaacttacggatggaacctggttaaacttcatagcggcaaggacgtgtttttcatacctcccgagaaatgtgatacactgctatgcgacatcggcgagtcttccccaaatcccaccattgaagaggggcggactctccgcgtcctgaagatggtggaaccttggttgagaggaaaccaattttgtatcaaaattctgaatccgtatatgccctcagtcgtggagacactcgagcagatgcagaggaagcacggtggcatgcttgttcgaaacccactgagccggaattcgacccatgaaatgtactgggtatcttgcgggacgggaaacatcgtgagtgccgtcaatatgacctcccgtatgttactgaacagattcacaatggctcaccgcaagcctacttatgagagggatgtggacttgggcgccggtacccggcacgttgcagtggaacccgaggtcgccaacctcgatattatcgggcagagaatagaaaatattaaacatgagcacaagagcacatggcattacgacgaggataacccttataaaacttgggcttaccacggatcatatgaagtgaagccatccggctctgcgagcagtatggtaaatggcgtggttaaactgctaaccaagccctgggacgtcatccctatggtgacacaaatcgccatgaccgatactacgccatttgggcagcagcgcgtgttcaaggagaaagtcgacacaaggacccccaaggcaaaacgaggaactgctcaaattatggaagttaccgccaagtggctttggggttttctgtcccggaacaaaaagccgagaatatgtacaagggaggaattcacgcgcaaggtgcgtagcaatgcagccatcggcgctgtatttgtggacgagaaccagtggaattctgccaaagaggcggtcgaagatgagcggttctgggacctcgtgcatagagaaagggagctgcacaagcaggggaaatgcgcaacctgcgtttacaacatgatgggaaagcgcgaaaaaaagttgggcgagtttggtaaggccaaagggtcacgagctatttggtacatgtggctgggagcccggttcctcgagttcgaagcacttggctttatgaatgaggatcactggttcagtagagaaaactccctgagcggcgtggagggggagggattacataagctgggttatatcttgagggacatttctaaaatccctggcgggaatatgtacgctgatgacactgccggatgggatacacgcataaccgaagacgatctccagaacgaggctagaatcactgacattatggaaccagagcacgccctgctagcaaagtcgatctttaaacttacatatcaaaataaggtcgtgcgggtacagaggcccgcgaaaaacggcaccgttatggatgtgatttcacgtcgagaccagcgcggtagcgggcaggtcggaacatacggcctgaatactttcaccaacatggaagcccaactcatcagacagatggagtccgagggcatatttagtccttctgaactggagacgccaaacttggctgaacgggtgttagattggctggagaagtatggggtggaaaggctcaagcgcatggccattagcggagacgactgtgtcgttaaacccatcgatgacagattcgcaaccgctcttacagccctgaatgatatgggtaaggtgcggaaagacatcccgcagtgggagccttccaagggctggaacgattggcagcaagtacccttttgctcacatcacttccaccagctaattatgaaagacgggagggagatagtggtcccatgtcgaaatcaggatgaactggtgggacgtgcaagagttagtcagggcgccggttggtctctccgcgagactgcgtgcttggggaagagctacgctcaaatgtggcagctgatgtattttcatcggagggaccttagactggccgcaaacgccatctgttccgctgtgcctgtcgattggattcccacctcacgcacaacttggagcatccacgcccatcaccagtggatgaccacggaagacatgctctctgtgtggaatcgggtatggattgaggaaaacccatggatggaggataagacacatatctccagttggggagacgttccctacttaggcaaaagggaggaccaatggtgcggcagcctgatagggttgaccgcacgagctacttgggccacaaatatccaggtggcgattaaccaggtcagacggctgatcggaaatgaaaactacctcgattatatgacctcgatgaagaggttcaaaaatgagtccgaccctgaaggtgctctttggtga

SEQ ID NO: 13974 - RNA, 9879 nt, synthetic construct
  misc_feature 1..9879: note = derived and/or modified CDS sequence (opt3) from DENV-1__GU131818__SS-prME
  source 1..9879: mol_type = other RNA
agcgtgaccatgctgctcatgcttatgcccactgcactggctttccacttgactacgagaggaggggaacctcatatgatcgtctccaagcaggaaaggggaaaatctttactgtttaagacctcagccggtgttaacatgtgcactctaattgccatggacctcggcgagttctgtgaagatactatgacctacaaatgcccacggataactgaggcggaaccggacgatgtggactgttggtgcaatgctaccgatacttgggtaacctatgggacctgtagtcaaacgggagagcaccgccgagacaagcgtagcgtggccctggcaccccatgtcggccttggtctggagactagaaccgaaacatggatgtcctctgagggggcctggaaacagatccagaaggtggaaacttgggctttgaggcaccctggatttaccgttattgcactcttcctggcccatgctatcggcacctcgattacccagaagggcatcatatttatcctgctcatgttagtgacgccatcaatggccatgcggtgcgtcgggattggaagccgcgatttcgtggagggtctgagtggcgcgacttgggtagacgttgtgcttgagcacgggtcctgtgtcacgaccatggcaaaagataagcccactttggacatcgaactgctaaaaacagaggtgaccaaccctgccgtgctccggaagctgtgcattgaagctaaaatctctaatacgaccacagatagtaggtgtccaactcaaggagaggccacccttgtcgaagaacaggacgcaaactttgtttgccggcgcacattcgtggatcgaggctggggtaatgggtgtggactgtttggcaagggctccttgataacttgcgctaagttcaaatgcgtaaccaagctcgaggggaaaacagtgcagcacgaaaacctgaagtactcagtcattgtgaccgttcatactggagaccagcaccaagtgggtaatgagagtacggaacatggcacaaccgccactatcacaccccaggcgcctagcacagagattcagttaaccgactatggggccctgactctcgattgttctccaagaacaggacttgactttaacgaaatggtcctgttgacgatgaaagagaagtcctggctagtgcacaaacagtggttcctggatctcccgctgccctggacctcaggcgcaagcacaagccaagagacatggaataggaaggaccttctggtaacctttaagacagctcacgccaaaaagcaggaagttgtggtcttgggttctcaggagggggctatgcatactgccctcaccggcgcaacggaaatccaaacctccggaacaactaccatcttcgccggccacctgaaatgccggttaaagatggataaactgacactaaaggggactagctacgtgatgtgtaccggatcgttcaagctcgagaaagaagtcgctgagacgcagcatggtacagtgctggttcagattaagtatgagggcaccgacgcgccttgcaaaataccattttctactcaggatgaaaagggggtgacacaaaacggacgtcttatcaccgcaaatcccattgtaactgacaaagagaagcctgtcaacatcgaagccgagccacccttcggcgagtcctacatagtgattggtgctggggaaaaggccttgaaactgtcatggtttaagaaaggcagtagcatcggaaagatgttcgaggcaaccgcccgcggcgctagaaggatggccatcctcggggatacagcatgggactttggatccattggtggcgttttcacgtctgtggggaaactggtccaccagatctttggaaccgcgtatggcgtgcttttcagcggtgtatcatggactatgaagattgggataggcgtgctgttgacatggctcggactgaatagtcggtccaccagcttatctatgacatgtatcgctgttggcctggtcactctatacctcggggtgatggtgcaggccgattcaggatgcgtcattaactggaagggccgagaactgaaatgtggtagtgggatctttgttaccaatgaggtgcatacgtggacagaacagtacaagttccaagcagacagcccgaaacgcctttccgccgctatcggaaaggcctgggaggagggcgtgtgcggtattagatctgcaaccaggttggaaaacataatgtggaaacagatctcgaacgagctgaatcacattctcctggaaaacgacatgaagtttactgtagtcgtgggcgatgttgctgggatcttagcccagggcaagaagatgattcggcctcagcccatggagtataagtacagctggaaatcctggggcaaggcgaaaatcataggggccgacgtgcaaaataccacattcatcattgatggaccaaacactcctgaatgtcccgacgatcagcgcgcttggaatatctgggaggtcgaggactatggctttggtattttcaccacaaacatctggctgaaacttagagattcatacacacaggtgtgcgaccacaggttgatgagtgcagccataaaagattctaaggctgttcatgccgacatggggtattggattgaaagcgagaagaatgaaacctggaaactcgcacgtgcgtccttcatcgaggtgaagacttgtatttggccaaaatcacacacactgtggagcaacggagtactagaatctgagatgatcatacccaagatctacggcggtcctatttcccagcataattatcggccaggctactttacccaaactgccgggccgtggcacctgggaaaactcgagctggatttcgacctttgcgaaggcacaaccgtcgtggtggatgagcactgcgggaaccgaggacccagtttgagaacgactaccgtcacaggcaagatcattcatgaatggtgttgcaggagctgtaccctgcctccattacgctttaagggtgaggacgggtgctggtacggaatggagatccggcccgttaaagaaaaggaggaaaatctcgtgaaatctatggtatccgctggctcaggtgaggtggacagtttcagcctgggccttctgtgtatatcgattatgatcgaagaggtcatgagatccaggtggtctcgcaagatgttgatgactgggacactcgccgtgtttttcctgctaatcatgggacagctgacctggaacgatctcattcgactgtgcatcatggttggcgcaaatgctagcgaccggatggggatgggaacaacttatcttgccttgatggcaacctttaaaatgcgtcctatgttcgccgtgggcctgttatttagaaggctcacgtcacgcgaggtcctgcttctgacaattggtctaagtctcgtggcttccgttgaactgccaaactctttggaggaactgggggatggattagcgatgggcataatgatcctcaagctgcttaccgacttccagagccaccaactgtgggccactttgctctccctgacctttattaagacaactttctcactacattacgcatggaaaaccatggctatggtgctgagcatcgtcagtctttttcccctctgtctgtctacgacatcccagaagaccacttggttgccggtactgttaggcagcctcgggtgcaaacctctgacaatgttccttattgccgagaataagatctggggacggaaatcgtggccactgaacgaaggtataatggccgtgggcatcgtttcaattttgctctctagtctgctaaagaacgatgtgcccctggctgggcctcttatcgcaggaggcatgctcattgcctgttatgtcatctccggtagctctgcggacctgagcttggagaaagctgccgaggtgtcctgggaagaggaagcagagcactcaggggccagtcataatatattagtagaagtgcaggatgacggaaccatgaagattaaggatgaggagagagacgatactctgacaatcctcctgaaagctacccttctggcagtcagcggcgtttaccccttgtctatcccagccacgctattcgtgtggtatttttggcagaagaaaaagcaaaggtccggcgtgctgtgggacactccttcacccccagaagtcgagcgagcggtgctcgatgacgggatttaccgcataatgcagcggggactgcttggtagaagtcaggttggcgtaggggtgttccaggaaaacgtctttcacaccatgtggcacgtgacaaggggagctgttttaatgtatcaaggcaaacgtctggagccgagctgggcctccgtgaagaaggacctcatctcttacggtgggggatggcgcttgcagggctcgtggaataccggcgaggaagtccaggtgattgcagtagagcctgggaaaaaccccaagaatgtccagacagccccaggaactttcaaaaccagcgaaggtgaggtgggcgctatcgccctggattttaagcccgggacgtcaggatcccctattgttaaccgggaaggcaaaatcgtgggtctctacgggaatggagtcgtgacaacaagtggcacctatgtttctgcaatagctcaagccaaggcgagccaggagggcccactgcccgagatcgaagacgaggtgttcagaaagaggaaccttacaattatggatctgcatcctgggtccggaaaaacccgacggtacttgccggccatcgtccgcgaagcaattaagagaaaactaaggactctgatcctcgctccaacccgggtggtagcctcagagatggctgaagcattaaagggtatgcccatacgatatcagacaacggccgtgaaatctgagcacactggcaaggagattgttgacctgatgtgccatgccacctttacaatgagacttctgagccctgtccgcgtgccaaattacaacatgatcatcatggatgaagctcacttcaccgaccccagttccattgcggcaagggggtatatcagcactcgtgtgggaatgggcgaggccgctgccatatttatgacagcaacccctccgggttctgtcgaagccttcccccaatcaaatgctgtaattcaggatgaggaacgggacatcccagagagatcctggaacagtgggtacgagtggattacggattttcctggaaagactgtgtggttcgttcccagcatcaaatcgggcaatgacatagcgaactgtctcaggaagaatggcaaacgcgtgattcagttgtctcgaaagacattcgataccgaatatcagaaaaccaagaacaacgactgggactacgtcgtgactacagatatctccgagatgggggccaattttagagcagaccgggttatcgatccaaggcgctgcctgaagcctgtgattctcaaagacggacccgaacgtgtcatcctggctggtccaatgccggtgaccgtagccagcgcagcccaaagacggggcaggattgggcgcaaccataataaggagggagatcagtacatatatatgggccagcctcttaacaatgacgaggatcacgctcactggacagaagccaaaatgctactggacaacatcaatactcccgagggtattatcccagcgttgttcgaacccgagcgagaaaagtcagcagccatcgatggggagtacagattacggggcgaggctaggaaaacgtttgtggaactgatgcgcagaggagacctccctgtttggctgagttataaggtcgcctctgagggcttccagtactccgataggcggtggtgctttgacggggaacgtaacaatcaagtgcttgaggaaaacatggatgtggagatttggaccaaagagggagaacgcaagaagctgcgaccaagatggctcgacgctaggacatatagcgaccccttggcactgcgggagttcaaagaatttgccgctggtcgcagatcagtcagtggcgatctaatactggagatcgggaagctccctcagcatcttactcagagggcccagaatgcactggacaacttagttatgttgcacaatagcgaacaaggaggccgggcgtaccgacatgccatggaggagctgccggataccattgaaacactcatgctgcttgctctgatcgccgtgctcaccggtggggtaactttgttctttctgtccggcagaggattaggcaaaacgtctattgggctactgtgtgtgatggcaagctccgctctcctttggatggcctcagtcgagccacactggatcgcagcctctataatcctggagttctttttgatggtgctgctcattcccgagcctgaccgccagaggacaccccaggataaccagctggcttatgttgtgatcggacttctcttcatgattctgacagtcgcggccaatgagatgggtttgctggaaactaccaagaaagacttaggcatcgggcacgtagcagtggagaaccatcaccatgctgccatgctagatgttgacctgcacccagccagtgcatggacactctacgctgtggccaccactataattacacctatgatgcggcatacgatcgaaaacaccactgcgaatatttcgcttacagctatcgccaaccaagcagccatactgatgggattggataagggctggcccatcagcaagatggacattggtgtcccactgctcgctctggggtgctactcccaggtgaatcctcttaccttaaccgcagccgtcctgatgctcgtggcgcactatgctatcattggcccgggattgcaggccaaagcaacacgtgaggcccaaaagagaactgctgccggcatcatgaaaaaccccacggttgatgggatagtggcaattgacctggatccagtagtgtacgacgctaagtttgaaaaacagctaggacagatcatgctgctcgtcctttgtacctctcagatcctgttgatgaggacaacttgggccctgtgcgagtcaattaccctcgcgacaggccctctgaccactttatgggagggtagccccgggaagttctggaatacgacaatcgccgtttccatggcaaacatattccgcggaagttatcttgctggcgcctctctggcatttagcctcatgaagtcactaggtggcgggcggcgaggaaccggcgctcaaggggaaactctgggagagaaatggaagagacagttgaatcagctgtccaaaagtgagttcaacacctacaagaggagcggcattatggaggtggaccgctctgaagccaaagagggtctcaagagaggggaaacaactaagcacgccgtctcccggggaaccgcgaaacttcgttggtttgtggaaaggaatctggtaaagccagagggcaaagtgatcgatttgggttgtggcagaggcgggtggtcatattactgcgctgggctgaagaaagttacagaagtgaaggggtatacgaaaggaggccctggtcatgaggaacccattccgatggcaacctacgggtggaacctcgtcaagttacacagcggaaaggacgtgttctttatcccacctgagaaatgtgatactctgctttgcgacataggcgagtcgtctcccaatccaacaatcgaagagggccgcaccctgcgagtcctaaagatggtggaaccctggctcagagggaaccagttctgtattaaaatcctgaatccttacatgccgagtgttgtagagactttggagcaaatgcagaggaagcatggaggtatgctggtgcggaaccccctctcccgcaatagcacacacgaaatgtattgggtctcatgcggcaccgggaacattgtgtccgccgttaatatgacgtctagaatgcttctgaacaggtttaccatggctcaccgaaaaccaacatacgagcgggatgtggacttaggagccggcactcgtcatgtcgcagtggaacctgaggtagccaacctggatatcattggtcagagaatcgaaaatataaagcacgagcataagagcacctggcactatgacgaggataacccctacaaaacatgggcttatcatgggagttacgaagtgaagccttccggaagcgcgtcttcaatggttaatggcgtcgtgaaattgctcactaagccatgggacgtgattcccatggtcacccagatcgccatgacagataccactcctttcggccaacagcgcgtttttaaagagaaggtggacacgaggacaccaaaggcaaaacgggggaccgctcagatcatggaagtaactgccaagtggctgtggggattcctaagtagaaacaaaaagccccgcatttgtaccagggaggaatttacacgaaaagtgcggtccaatgcagccataggtgctgtcttcgtggacgagaaccaatggaatagcgccaaggaggcggttgaagatgagagattttgggaccttgtgcacagggaacgcgagctgcacaagcagggcaaatgcgcaacgtgcgtctataacatgatggggaagcgtgagaaaaagctcggagagttcggcaaagccaagggttctcgggctatctggtacatgtggctgggggccagattcttggagtttgaagcactgggattcatgaatgaggatcattggttttcgagggaaaactcactcagcggcgtggagggcgaggggcttcacaaactgggatacattttacgcgacatctccaagattccgggtggcaatatgtatgctgatgacaccgccgggtgggatactcgaatcacagaagacgatctgcagaacgaggctaagataaccgacatcatggaacctgagcatgccttgctcgcaaaaagtattttcaagctgacttaccagaataaagtagttcgggtgcaaagaccagcgaagaacggaacagtcatggatgtgatctctaggcgcgaccagagaggcagcggtcaggtggggacctatggactaaatacatttactaacatggaagcccagcttattcggcaaatggagtccgaggaaatcttctcacccagtgagctggaaacccctaacctcgctggcagggtcctggattggttggagaaacacggcgttgaacgtttaaagcgaatggccatatctggggacgactgtgtggtaaagccaattgatgaccgctttgcaacggctctgaccgccctcaatgatatgggaaaagtgagaaaggacatcccccagtgggagccgagcaaaggttggaacgattggcagcaggtccctttctgctcccaccattttcaccaacttatcatgaaggacggccgggagattgtggttccctgtaggaatcaggatgaactggtggggcgcgcaagagtctcacagggagccggctggagcctaaaagagacagcgtgcctgggtaagtcttacgctcagatgtggcaactcatgtatttccatcggagggacttgcgactggccgcaaacgccatatgttccgctgtgccagtagattgggttcctacaagtcgtaccacatggagcatccacgcccatcaccagtggatgactaccgaagacatgctttcggtgtggaatagagtctggattgaggaaaacccctggatggaggataagacgcacatctcctcttggggagacgtgccatacctgggaaaacgcgaggaccagtggtgcggctcactcattggcttaacagcacgggctacctgggccactaatatccaagttgcgataaaccaggtgaggagactgatcgggaatgaaaactatttggattacatgacaagcatgaagcgctttaaaaatgagagtgaccccgaaggagctctgtggtga

SEQ ID NO: 13975 - RNA, 9879 nt, synthetic construct
  misc_feature 1..9879: note = derived and/or modified CDS sequence (opt3) from DENV-1__GU131820__SS-prME
  source 1..9879: mol_type = other RNA
agcgtgaccatgctgctcatgcttatgcccacagcactggctttccacttgactacgagaggaggggaacctcatatgatcgtcaccaagcaggaaaggggaaaatccttactgtttaagacatctgccggtgttaatatgtgcactctaattgcaatggacctcggagaactgtgtgaagataccatgacatacaaatgcccacggataaccgaagcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggcagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggccagcttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggccttggtgaggtggactccttttcactgggcttgctctgtattagtatcatgatcgaagaggtcatgaggagccgctggtcgcgaaagatgctgatggctgggaccctagccgtgttcctgctcctgattatgggacagcttacttggaacgatttgatccggctgtgcattatggttggcgcaaatgcttccgaccgtatggggatgggaacaacctatttagccctcatggcaacatttaaaatgagacctatgttcgccgtgggcctgctttttaggcgcctgacttctcgggaggtcctactcctgaccataggtttgagcctggtggcttcagttgaattaccaaacagtctcgaggaactgggggatggacttgcgatgggcatcatgattctgaagttgctcacggacttccaatcccaccagctgtgggccacactactgtctcttacctttatcaaaactaccctcagcctgcattacgcatggaagacaatggctatggtgttgtccattgtctcactgttccccttatgtctcagcactaccagtcagaagacgacatggctgccggtacttctgggctctttggggtgcaaacctctcaccatgtttctgatcgccgagaataagatatggggaagaaaatcctggccactaaacgaaggtatcatggccgtgggcgttgtgagcattctgctttcgtcactcctgaagaacgatgtccccttggctgggcctttaatcgcaggaggcatgctgattgcctgttatgtgatctctggtagttccgcggacctcagcctggagaaagctgccgaggtatcttgggaagaggaagcagagcacagcggggcctcccataatatacttgtggaagtccaggatgacggaactatgaagattaaagatgaggagagggacgatacactgaccatcttgctaaaggctactctgctcgcaatctcaggcgtttaccccctgagtattccagccacacttttcgtgtggtatttttggcaaaagaaaaagcagcgaagcggcgtgttatgggacaccccttctcccccagaagtcgagcgcgcggtgctggatgacgggatataccggatcatgcagagaggactcttgggtaggtcccaggttggcgtaggggtgttccaagaaaacgtcttccacacgatgtggcacgtgactcgtggagctgttctgatgtatcagggcaaacgcctcgagccgtcatgggccagtgtgaagaaagacctgattagctacggtgggggatggcggcttcagggctcctggaataccggcgaggaagtccaggtgatcgcagtagagcctgggaagaaccccaagaatgtccaaacagccccaggaacctttaaaacacccgaaggtgaggtgggcgctattgccctggatttcaagcctgggacttctggatcgccaatcgttaacagagaaggcaaaatagtgggtttgtacgggaatggagtcgtgaccacgagcggcacatatgtttcagcaatcgctcaggccaaggcgtcccaggagggccccctacctgagattgaagacgaggtgtttaggaaacgaaacctgactatcatggatctccatccggggagtggaaagacccggcgctacttaccagccattgtcagagaagcaatcaagaggaaactgcggacacttatactggctcccacccgagtggtagcctctgagatggctgaagcactcaagggtatgcctattagatatcaaactaccgccgtgaaaagcgagcacacaggcaaggagatcgttgacttgatgtgccatgccacgttcactatgcgcctgctctccccagtcagggtgcccaattacaacatgatcattatggatgaagctcactttaccgacccttcatctatcgcggcacgtgggtatataagcacacgggtgggaatgggcgaggccgctgccattttcatgaccgcaactccgcccggtagtgtcgaagcctttccacagtccaatgctgtaatccaggatgaggaaagagacattcctgagaggagctggaactctgggtacgagtggatcacagatttccccggaaaaaccgtgtggtttgttccatcaataaagtccggcaatgacattgcgaactgtctgcgcaagaatggcaaacgagtgatccagcttagtagaaagacgttcgatactgaatatcagaaaaccaagaacaacgactgggactacgtcgtgaccaccgatatcagcgagatgggggccaattttcgggcagacagggttattgatcctcgccgttgcctaaaacccgtgatcctgaaggacggaccagaaagagtcattttggctggtccgatgcctgtgactgtagcctcggcagcccagcggaggggccgcatagggcgaaaccataataaggagggagatcagtacatctatatgggccagcccttaaacaatgacgaggatcacgctcactggacagaagccaaaatgctgctcgacaacattaataccccagagggtatcatccccgcgctgttcgaacctgagagagaaaagtctgcagccattgatggggagtaccggcttaggggcgaggctcgcaaaacattcgtggaactgatgagaaggggagacctcccagtttggttgtcctataaggtcgccagcgagggctttcaatactcagatcggcgttggtgcttcgacggggaacgcaacaatcaggtgctggaggaaaacatggatgtggagatatggactaaagagggagaacgaaagaaactaagacccaggtggctggacgctcggacgtatagtgaccctctcgcacttcgcgagtttaaggagttcgccgctggtagaaggtctgtctccggcgatctgatcttagagattgggaagttgccgcagcatctgacccagcgggcccaaaatgcactcgacaacctggttatgcttcacaatagcgaacagggaggccgagcgtacagacatgccatggaggagctgccagatacaatcgaaactctcatgttgctggctttaattgccgtgctaaccggtggggtaacactgtttttcctctcaggccgcggacttggcaaaaccagtatcgggctgttgtgtgtgatggcaagctccgtcctgctctggatggcttctgtggagccccactggatagccgcaagcatcattctggaatttttccttatggttctcctgatccctgagcccgacaggcagcggactccacaggataaccaattggcctatgtggtcattggactgttatttatgatcctaacggtagctgcgaatgagatgggtctgctcgaaaccacaaagaaagaccttggcatagggcacgtggccgttgagaaccatcaccatgcaactatgctggatgtggacttgcaccctgcttccgcctggaccctgtacgccgtcgcaacaaccattatcactcccatgatgcgtcatacaattgaaaacacgaccgctaatatctcactcactgccatagcgaaccaggctgccatcctgatgggacttgataagggctggccaatttctaaaatggacatcggtgtgcctttactggcactcgggtgctacagtcaggtcaatccgttgacactgaccgccgctgtgctaatgctggttgcacactatgccattatcggccccggactccaagcgaaggctaccagagaggcccagaagaggacagcagccggcataatgaaaaacccaactgtggatgggattgtagctatcgaccttgatcctgtggtctacgacgccaagttcgaaaaacagctgggacagatcatgttgctgattctctgtacgtcgcaaatcctgttaatgcgcaccacatgggcactttgcgagagcataactctggctaccggccccctcacaaccctatgggagggttccccagggaagttttggaatactacgattgccgtttctatggcgaacatcttccggggatcatatctggccggcgcaggtttggcttttagcctgatgaaatccctcggcgggggacgaagaggcacaggggcccagggagaaacccttggcgagaagtggaagaggcagctgaatcagttgagtaaatctgagttcaacatttacaagcgcagcggtatcatggaggtggaccggtcagaagcaaaagaggggctgaagagaggagagactacccgtcacgctgtctccaggggcacagccaaactccggtggttcgtggaacgcaatttagtaaagcctgagggtaaggtgatagatctgggctgtgggcgaggaggctggagttattactgcgccgggcttaaaaaggttactgaagtgaaaggatataccaagggcggtcccgggcatgaggaaccgatcccaatggcgacatacggatggaacctggtcaaactacacagcggcaaggacgtgtttttcacgcctcccgagagatgtgataccctcctgtgcgacattggcgagtcttccccaaatcccactatcgaagaggggaggacattgcgggtcctgaaaatggtggaaccttggctccgcggaaaccaattttgtattaagatccttaatccgtacatgccctcagttgtagagaccctggagcagatgcagagaaagcatggtggcatgttagtgaggaacccactgagccgaaattcgactcacgaaatgtattgggtctcttgcgggacaggaaacattgtgagtgctgttaatatgacctcccggatgttgctcaaccgtttcacgatggcacacagaaaacctacctacgagcgcgatgtggacctgggcgccggtacaaggcatgtcgctgtggaacccgaggtagccaacctagatatcatagggcagcggattgaaaatatcaagcacgagcataaaagcacttggcactatgacgaggataacccttacaagacctgggcatatcatggatcatacgaagtgaaaccatccggctctgccagcagtatggttaatggcgtcgtgaaacttctgacaaagccctgggacgtgatccctatggtcactcaaattgctatgaccgatacaaccccatttgggcagcagagagttttcaaagagaaggtggacactcgcacgcccaaagcgaagaggggaacagcccaaataatggaagtaaccgcacgatggctctggggttttctgtcccggaacaaaaagccgagaatctgtactagggaggagttcacccgcaaggtgcgtagcaatgctgccattggcgcagtctttgtggacgagaaccagtggaactctgccaaagaggctgttgaagatgagcggttctgggacttggtgcagaaggaaagagagctgcacaaacaggggaagtgcgccacatgcgtctataacatgatgggaaaaagggaaaagaagctcggcgagtttggtaaagcgaaggggtcacgcgcaatctggtacatgtggcttggagcccgattcctggagtttgaggctttaggcttcatgaatgaggatcactggttcagtcgggaaaactccctgagcggcgtggagggggagggattgcataaactcggttacattctgagagacatctctaagatacctggcgggaatatgtatgccgatgacacggcaggatgggataccaggatcactgaagacgatctacaaaacgaggctaaaattacagacatcatggaaccagagcacgcccttctggctacctcgatttttaagctcacttaccagaataaagtagttcgcgtgcagagacccgccaagaacggcacagtcatggatgtgatctcacggagggaccagcgtggtagcgggcaagtgggaacctatggcctgaatacattcactaacatggaagcacagttgatacgacagatggagtccgagggcatatttttacctagtgaactggagaccccaaacctcgcggaacgcgtccttgattggctggagaagcatggggttgaaagactaaaacggatggccatctctggagacgactgtgtggtaaagcccatcgatgacaggttcgctacggccctgaccgcactcaatgatatgggtaaagtgcgcaaggacattccgcagtgggagcctagcaaaggctggaacgattggcaacaggtccccttttgctcccaccacttccatcagttgataatgaaggacgggagagagatcgtggttccatgtcggaatcaggatgaactggtgggaagggctcgagtctcacaaggcgccggttggagtcttcgtgagacagcatgcctggggaagtcttacgcccagatgtggcagctcatgtattttcacagacgcgacttacggctggcggctaacgccatttgtagcgcagtgcctgtagattgggttcccacttccaggaccacatggtcaatccatgcccaccatcaatggatgactaccgaagacatgttgagcgtgtggaatagagtctggattgaggaaaacccatggatggaggataaaacgcacgtgtcttcctggggagacgttccctacctgggcaagcgcgaggaccagtggtgcggcagtctcatcgggcttacagctcgggccacctgggcaagcaatatacaggtggctatcaaccaggtcaggcgactgattggaaatgaaaactatctagattacatgacttcgatgaaaagattcaagaatgagggtgaccctgaaggcgccctgtggtga

SEQ ID NO: 13976 - RNA, 9879 nt, synthetic construct
  misc_feature 1..9879: note = derived and/or modified CDS sequence (opt3) from DENV-1__HM181970__SS-prME
  source 1..9879: mol_type = other RNA
agcgtgaccatgctgctcatgcttatgcccactgcactggctttccacttgactacgagaggaggggaacctcatatgatcgtctccaagcaggaaaggggaaaatctttactgtttaagacctcagccggtgttaatatgtgcacattaattgccatggacctcggagagctgtgtgaagatactatgacctacaaatgcccacggattacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttattcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagctgaccgtggtagtcggcgatgtggctgggatccttggacagggcaaaaagatgatacgccctcaacccatggagtacaaatattcgtggaaaagctgggggaaggccaaaatcattggagcggacgcccagaatactaccttcatcattgatggcccaaacacacctgaatgtcccgacgatcagagagcttggaatatctgggaggttgaggactacggttttgggatattcactaccaacatttggttgaagctcagggattcctatacacaggtgtgcgaccaccgtctgatgtcagcagccatcaaagatagtaaggctgtccacgccgacatgggatactggattgaatctgagaaaaatgaaacgtggaagctagcacgggcgagctttatcgaggtgaagacctgtatatggccaaaatcccatactctgtggtcaaacggcgttctcgaaagcgagatgatcattcccaagatctatggtggccctatttctcaacacaattaccgaccagggtacttcacacagaccgccggaccgtggcatctgggcaaacttgagttggatttcgacctgtgcgaagggactacagtggtagtcgatgagcactgcggaaacagaggcccctccttaaggaccacgactgtgaccggtaagatcatacacgaatggtgttgccgcagttgtacactccctccactgcggtttagaggggaggacggatgctggtatggcatggagattaggcccgtgaaagaaaaggaggaaaatcttgtcaagagcatggtttctgctggttccggcgaggtggactcattcagtctggggttgctctgtatcagcatcatgattgaagaggtaatgcgctcgcgatggtcccggaaaatgctgatgaccggaactctagccgtgtttttcctgctcatcatgggccagctgacatggaacgatcttattcgtttgtgcataatggtcggggcaaatgcttttgacagaatgggaatgggcaccacatacctggccttaatggcaactttcaagatgaggcctatgtttgccgtgggtctcctgttccgccggcttacctctagagaggttctgctactcacgatcgggctgagcttggtggcttcagtcgaactgccaaacagtttagaggaactcggagatggcctggcgatgggcattatgatccttaaactgttgacagactttcaatcccatcagctctgggccaccctgctatctctgactttcattaagaccacatttagccttcactatgcatggaaaactatggctatggtgctctccatcgtttcactgttccccttgtgtctgagcaccacgagtcagaagacaacctggttaccggtgctcctggggtctcttggatgcaagcctctgactatgtttttgatagccgagaataaaatctggggtaggaagtcctggccactcaacgaaggcattatggccgtcgggatcgtaagcattctgctatcgtcactgcttaaaaacgatgtgcccctcgctggacctctgatcgcaggcggtatgttgatagcctgttacgttatttctgggagttccgcggacttaagcctggagaaggctgccgaggtgtcttgggaagaggaagcagagcatagcggagcctcccacaatatcctcgtcgaagtgcaggatgacggcacaatgaaaatcaaggatgaggagcgagacgataccctgactattcttctgaaagctacattgctagcagtatcaggcgtgtatcccctgagtataccagccaccctcttcgtctggtacttctggcaaaagaagaaacagcgcagcggggttctgtgggacacgccttctcccccagaagtggagcgggcggtgcttgatgacggaatctatagaattatgcagaggggtttactgggccgttcccaggtcggggtgggagtttttcaagaagacgtattccatactatgtggcacgtgacccgcggcgctgtcctcatgtaccagggtaagcggttggagccgtcatgggccagtgtgaaaaaggatctgatcagctacgggggaggctggagactcaggggctcctggaacacaggggaggaagttcaggtgattgcagtcgagcctggcaaaaatcccaagaacgtgcagaccgccccaggtacatttaagactcccgaaggcgaggtaggggctatcgccctggacttcaaacctggaacctctggctcgccaatagtcaatcgagaaggtaagatcgtggggctttatggaaacggcgttgtgacgacaagcggcacttacgtctcagcaattgctcaagccaaagcgtcccaggaggggcccctgcctgagatcgaagatgaggtgtttcggaagcgcaatttgaccattatggacctacacccgggaagtggtaaaacaagaaggtatctgccagccatcgttcgggaagcaataaagcgaaagctcagaaccttaattctggctcccactcgcgtggtcgcctctgagatggctgaagcacttaaaggcatgcctatcaggtaccagaccacagccgtaaagagcgagcatacggggaaagagatcgtagatctgatgtgccacgccactttcaccatgcgtctcttgtccccagtgcgggttcccaactataatatgattatcatggacgaagctcattttacagatccttcatctatagcggcaagaggatacattagcaccagggtcggcatgggtgaggccgctgccatcttcatgactgcaacaccgcccgggagtgtggaagcctttccacaatccaacgctgtgattcaggacgaggaacgcgatatccctgagcgaagctggaactctggacacgagtggataaccgacttccccggcaagacggtctggtttgtaccatcaattaaatccggcaacgatatcgcgaattgtctgagaaagaacgggaagcgggtgatccagctcagtaggaaaactttcgacacagaatatcagaagaccaaaaataacgactgggattacgttgtgaccactgacattagcgagatgggagccaacttccgcgcagatcgtgtcatcgaccctagacggtgcctgaagcccgtgattcttaaagatggtccagaaagggttatactagctggcccgatgcctgtgacagtcgcctcggcagcccaacgccgagggagaatcggacggaatcataacaaggagggcgaccagtacatttatatgggtcagcccctgaataacgatgaggaccacgctcactggaccgaagccaagatgttgttagataatatcaacacaccagaggggatcattcccgcgctgtttgaacctgagagggaaaaatctgcagccgtggacggcgagtaccgcctcagaggagaggctaggaagactttcgtagaactgatgcggcgtggcgatcttccagtgtggctgtcctataaagttgccagcgaggggtttcagtactcagaccgccgatggtgcttcgatggagaaagaaataaccaagtcctcgaggaaaatatggacgtggagatatggacgaaggagggtgaaaggaaaaagttgcggccccgctggctggacgctagaacctatagtgatcctctagcactgagggagtttaaagagttcgccgctggccggcgatctgtgtccggggacctcatccttgagattggaaagctgccgcagcatttaacacagagagcccagaacgcattggataatctggtcatgctccacaacagcgaacaaggcggtcgcgcgtacaggcatgccatggaggagctgccagacactatcgaaacccttatgctgctcgctttgattgccgttctgacagggggcgtgaccttatttttcctatcaggacggggcctggggaagacaagtatcggactcctttgtgtaatggcaagctccgtgctgttgtggatggcttctgtcgagccccactggatagccgcaagcatcattctggaatttttcctcatggtgctgcttatccctgagcccgatcgtcagagaacgccacaggacaatcagctcgcctatgttgtgattggtctgttgtttatgatcctgaccgtcgctgcgaacgagatgggcttactagaaacaactaaaaaggatctggggataggacacgtagccgtggagaatcatcaccatgcagctatgctcgacgttgatcttcaccctgcctccgcctggaccctgtacgcagtggctacaaccattatcactcccatgatgaggcatacaattgaaaacacgaccgccaacatctcattgactgcgatagctaatcaagccgcaatcctgatgggcctcgacaaaggttggccaatttctaagatggatatcggggtccctctgcttgccttaggctgctacagtcaggtgaacccgctgacactcaccgctgcagtcttgatgctggtggcccactatgcgattatcggacccggcctacaggctaaagccacccgcgaggcacaaaagcggacagccgctgggataatgaagaatccaactgttgacggaattgtggccatcgatctggaccctgtagtgtacgacgcaaaattcgaaaagcagctcggccagatcatgcttctgattttgtgtacgtcgcagatcctgctcatgcgaaccacatgggctctgtgcgagagcataactttagccaccggtccccttacaaccctgtgggaggggtccccaggaaaattttggaacactacgattgcggtctctatggccaatatcttcagaggctcatatctcgcaggagctggcctagccttcagcctgatgaagtccctagggggtggcaggcgcgggacaggagcacaaggcgaaaccctgggtgagaaatggaagcggcagctcaaccagcttagtaagtctgaatttaatacttacaaaagaagcgggattatggaggttgatcgttcagaagctaaggagggactgaaaaggggcgagaccacaaagcacgccgtgtcccggggtactgccaaattgcgctggttcgtcgaacgaaacctggtgaagcctgagggcaaggtaatcgacctcgggtgtggaagaggcgggtggagttattactgcgcgggactaaagaaggtgaccgaagttaaaggctatacaaagggtgggcccggacatgaggaaccgataccaatggctacgtacggctggaatctggtgaaacttcacagcggcaaggatgtctttttcatccctcccgagaaatgtgacaccctgctatgcgatattggggagtcttccccaaaccccactatcgaagagggaaggacactccgggtgctgaagatggtcgaaccttggttgcgcggtaatcagttttgtattaagatcctgaacccgtacatgccctcagtggttgagaccctcgagcaaatgcagagaaaacatggcgggatgcttgtaaggaatccactgagccgaaactcgactcacgaaatgtattgggtgtcttgcggaacaggcaatattgtcagtgcagtgaacatgacctcccggatgttactgaatcgtttcacgatggcccacagaaagcctacctacgagcgcgacgttgatttgggtacagggactaggcatgtggctgtcgaacccgaggtggccaacctcgacatcataggacagcggattgaaaacatcaaacacgagcataagagcacctggcactatgatgaggacaatccttacaaaacatgggcatatcatggctcatacgaagtaaagccatccggctctgccagcagtatggtgaacggggttgtcaagctgctaactaaaccctgggatgtgatccctatggtgacccagattgctatgacagacaccactccatttggacaacagagagtcttcaaggagaaagttgacacgcgcacacccaaggcgaaaaggggtaccgcccagataatggaagtgactgcacgatggctttggggctttctgtcccggaataagaagccgagaatctgtaccagggaggagttcacacgcaaagtacgtagcaacgctgccattggggcagtgtttgtcgatgagaatcaatggaactctgccaaggaggctgtggaagacgagcggttctgggatctcgttcacagagaaagggagctgcacaaacagggaaagtgcgccacgtgcgtgtataatatgatgggcaaacgcgaaaagaagttgggtgagtttgggaaagcgaagggatcacgagcaatctggtacatgtggctgggcgcccggttcctcgagttcgaagctcttggctttatgaacgaggaccattggttcagtagagaaaattccctgagcggggtcgagggagagggtttacacaaactgggctacattttgagggatatctctaagatacctgggggaaacatgtatgccgacgataccgcaggctgggacactcgcatcacagaagatgacctccagaatgaggctaaaattaccgatatcatggaaccagagcatgccctgctagctaaggccatttttaaacttacttaccagaacaaggtggtaagagttcaacggcccgcaaagaatggtacagtgatggacgtcatctcgaggcgtgatcagcgagggtcaggacaggtgggcacctatggcctgaacacattcactaatatggaagcgcagctcatacgccaaatggagagcgaggggatattttcccctagtgaactggagaccccaaacttggccgaaagagctttagactggctggagaaatacggagtggaacggctcaagaggatggccatctctggtgacgattgtgtcgttaaacccatcgacgatcgcttcgcaacggctcttaccgccctgaacgacatgggcaaggtgagaaaagatattccgcagtgggagcctagcaaggggtggaatgactggcagcaggtacccttttgctcccaccacttccatcaactaataatgaaggatggacgggagatcgtggtcccatgtaggaaccaggacgaactggtgggccgagcacgtgtttcacagggtgccgggtggagtctcagagagacagcgtgcttgggaaaatcttatgctcagatgtggcaactgatgtactttcaccgccgggatcttaggctggccgcaaatgccatttgtagcgctgtgcctgtcgactgggtgcccacttccagaaccacatggtcaatccatgcccaccatcagtggatgactaccgaagatatgctcagcgtatggaaccgcgtttggattgaggaaaatccatggatggaggacaagacgcacatctcttcctgggaggacgtgccctatttaggcaaacgggaagatcagtggtgcggcagtctgatagggttgacagcaagggctacctgggccactaacatccaagtcgcgattaatcaggtgcgaagactgatcggaaacgagaattacctcgactacatgacaagcatgaagcggttcaaaaacgaatcggatcctgagggtgctctttggtga

SEQ ID NO: 13977 - RNA, 9879 nt, synthetic construct
  misc_feature 1..9879: note = derived and/or modified CDS sequence (opt3) from DENV-1__GU131821__SS-prME
  source 1..9879: mol_type = other RNA
agcgtgaccatgctgctcatgcttatgcccaccgcactggctttccacttgactacgagaggaggggaacctcatatgatcgtctccaagcaggaaagggggaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagaaggtggaaacttgggctttgaggcaccctggatttaccgttattgcactcttcctggcccatgctatcggcacatcgattacccagaagggcatcatatttatcctgctcatgttagtgacgccatcaatggccatgcggtgcgtcgggattggaagccgcgatttcgtggagggtctgagtggcgcgacttgggtagacgttgtgcttgagcacgggtcctgtgtcacaaccatggcaaaagataagcccactttggacatcgaactgctaaaaacagaggtgaccaaccctgccgtgctcagaaagctgtgcattgaagctaaaatctctaatacgaccacagatagtaggtgtccaactcaaggagaggccacccttgtcgaagaacaggacgcaaactttgtttgccggcgcacattcgtggatcgaggctggggtaatgggtgtggactgtttggcaagggctccttgataacttgcgctaagttcaaatgcgtaaccaagctcgaggggaaaacagtgcagcacgaaaacctgaagtactcagtcattgtgaccgttcatactggagaccagcaccaagtgggtaatgagagtacggaacatggcacaaccgccactatcacaccccaggcgcctagcacagagattcagttaaccgactatggggccctgactctcgattgttctccaagaacaggacttgactttaacgaaatggtcctgttgacgatgaaagagaagtcctggctagtgcacaaacagtggttcctggatctcccgctgccctggacctcaggcgcaagcacaagccaagagacatggaataggaaggaccttctggtaacctttaagacagctcacgccaaaaagcaggaagttgtggtcttgggttctcaggagggggctatgcatactgccctcaccggcgcaacggaaatccaaacctccggaacaactaccatcttcgccggccacctgaaatgccggttaaagatggataaactgacactaaaggggatgagctacgtgatgtgtactggatcgttcaagctcgagaaagaagtcgctgagacccagcatggtacggtgctggttcagattaagtatgagggcacagacgcgccttgcaaaataccattttctacccaggatgaaaagggggtgactcaaaacggacgtcttatcacagcaaatcccattgtaaccgacaaagagaagcctgtcaacatcgaagccgagccacccttcggcgagtcctacatagtgattggtgctggggaaaaggccttgaaactgtcatggtttaagaaaggcagtagcatcggaaagatgttcgaggcaactgcccgcggcgctagaaggatggccatcctcggggataccgcatgggactttggatccattggtggcgttttcacatctgtggggaaactggtccaccagatctttggaacggcgtatggcgtgcttttcagcggtgtatcatggaccatgaagattgggataggcgtgctgttgacttggctcggactgaatagtcggtccactagcttatctatgacctgtatcgctgttggcctggtcacactatacctcggggtgatggtgcaggccgattcaggatgcgtcattaactggaagggccgagaactgaaatgtggtagtgggatctttgttactaatgaggtgcatacctggacggaacagtacaagttccaagcagacagcccgaaacgcctttccgccgctatcggaaaggcctgggaggagggcgtgtgcggtattagatctgcaacaaggttggaaaacataatgtggaaacagatctcgaacgagctgaatcacattctcctggaaaacgacatgaagtttaccgtagtcgtgggcgatgttgctgggatcttagcccagggcaagaagatgattcggcctcagcccatggagtataagtacagctggaaatcctggggcaaggcgaaaatcataggggccgacgtgcaaaatactaccttcatcattgatggaccaaacacacctgaatgtcccgacgatcagcgcgcttggaatatctgggaggtcgaggactatggctttggtattttcactaccaacatctggctgaaacttagagattcatacacacaggtgtgcgaccacaggttgatgagtgcagccataaaagattctaaggctgttcatgccgacatggggtattggattgaaagcgagaagaatgaaacgtggaaactcgcacgtgcgtccttcatcgaggtgaagacctgtatttggccaaaatcacacactctgtggagcaacggagtactagaatctgagatgatcatacccaagatctacggcggtcctatttcccagcataattatcggccaggctactttacacaaaccgccgggccgtggcacctgggaaaactcgagctggatttcgacctttgcgaaggcactacagtcgtggtggatgagcactgcgggaaccgaggacccagtttgagaaccacgactgtcaccggcaagatcattcatgaatggtgttgcaggagctgtacactgcctccattacgctttaagggtgaggacgggtgctggtacggaatggagatccggcccgttaaagaaaaggaggaaaatctcgtgaaatctatggtatccgctggctcaggtgaggtggacagtttcagcctgggccttctgtgtatatcgattatgatcgaagaggtcatgagatccaggtggtctcgcaagatgttgatgaccgggactctcgccgtgtttttcctgctaatcatgggacagctgacatggaacgatctcattcgactgtgcatcatggttggcgcaaatgctagcgaccggatggggatgggaaccacatatcttgccttgatggcaacttttaaaatgcgtcctatgttcgccgtgggcctgttatttagaaggctcacctcacgcgaggtcctgcttctgacgattggtctaagtctcgtggcttccgttgaactgccaaactctttggaggaactgggggatggattagcgatgggcataatgatcctcaagctgcttacagacttccagagccaccaactgtgggccaccttgctctccctgacttttattaagaccacattctcactacattacgcatggaaaactatggctatggtgctgagcatcgtcagtctttttcccctctgtctgtctaccacgtcccagaagacaacctggttgccggtactgttaggcagcctcgggtgcaaacctctgactatgttccttattgccgagaataagatctggggacggaaatcgtggccactgaacgaaggtataatggccgtgggcatcgtttcaattttgctctctagtctgctaaagaacgatgtgcccctggctgggcctcttatcgcaggaggcatgctcattgcctgttatgtcatctccggtagctctgcggacctgagcttggagaaagctgccgaggtgtcctgggaagaggaagcagagcactcaggggccagtcataatatattagtagaagtgcaggatgacggaacaatgaagattaaggatgaggagagagacgataccctgactatcctcctgaaagctacacttctggcagtcagcggcgtttaccccttgtctatcccagccaccctattcgtgtggtatttttggcagaagaaaaagcaaaggtccggcgtgctgtgggacacgccttcacccccagaagtcgagcgagcggtgctcgatgacgggatttaccgcataatgcagcggggactgcttggtagaagtcaggttggcgtaggggtgttccaggaaaacgtctttcacactatgtggcacgtgaccaggggagctgttttaatgtatcaaggcaaacgtctggagccgagctgggcctccgtgaagaaggacctcatctcttacggtgggggatggcgcttgcagggctcgtggaatacaggcgaggaagtccaggtgattgcagtagagcctgggaaaaaccccaagaatgtccagaccgccccaggaacattcaaaactagcgaaggtgaggtgggcgctatcgccctggattttaagcccgggacctcaggatcccctattgttaaccgggaaggcaaaatcgtgggtctctacgggaatggagtcgtgacgacaagtggcacttatgtttctgcaatagctcaagccaaggcgagccaggagggcccactgcccgagatcgaagacgaggtgttcagaaagaggaaccttaccattatggatctgcatcctgggtccggaaaaacacgacggtacttgccggccatcgtccgcgaagcaattaagagaaaactaaggaccctgatcctcgctccaactcgggtggtagcctcagagatggctgaagcattaaagggtatgcccatacgatatcagaccacagccgtgaaatctgagcacacgggcaaggagattgttgacctgatgtgccatgccacttttaccatgagacttctgagccctgtccgcgtgccaaattacaacatgatcatcatggatgaagctcacttcacagaccccagttccattgcggcaagggggtatatcagcacccgtgtgggaatgggcgaggccgctgccatatttatgactgcaacacctccgggttctgtcgaagccttcccccaatcaaatgctgtaattcaggatgaggaacgggacatcccagagagatcctggaacagtgggtacgagtggattaccgattttcctggaaagacggtgtggttcgttcccagcatcaaatcgggcaatgacatagcgaactgtctcaggaagaatggcaaacgcgtgattcagttgtctcgaaagactttcgatacagaatatcagaaaaccaagaacaacgactgggactacgtcgtgaccactgatatctccgagatgggggccaattttagagcagaccgggttatcgatccaaggcgctgcctgaagcctgtgattctcaaagacggacccgaacgtgtcatcctggctggtccaatgccggtgacagtagccagcgcagcccaaagacggggcaggattgggcgcaaccataataaggagggagatcagtacatatatatgggccagcctcttaacaatgacgaggatcacgctcactggaccgaagccaaaatgctactggacaacatcaatacacccgagggtattatcccagcgttgttcgaacccgagcgagaaaagtcagcagccatcgatggggagtacagattacggggcgaggctaggaaaacttttgtggaactgatgcgcagaggagacctccctgtttggctgagttataaggtcgcctctgagggcttccagtactccgataggcggtggtgctttgacggggaacgtaacaatcaagtgcttgaggaaaacatggatgtggagatttggacgaaagagggagaacgcaagaagctgcgaccaagatggctcgacgctaggacctatagcgaccccttggcactgcgggagttcaaagaatttgccgctggtcgcagatcagtcagtggcgatctaatactggagatcgggaagctccctcagcatcttacacagagggcccagaatgcactggacaacttagttatgttgcacaatagcgaacaaggaggccgggcgtaccgacatgccatggaggagctgccggatactattgaaaccctcatgctgcttgctctgatcgccgtgctcacaggtggggtaaccttgttctttctgtccggcagaggattaggcaaaacttctattgggctactgtgtgtgatggcaagctccgctctcctttggatggcctcagtcgagccacactggatcgcagcctctataatcctggagttctttttgatggtgctgctcattcccgagcctgaccgccagaggacgccccaggataaccagctggcttatgttgtgatcggacttctcttcatgattctgaccgtcgcggccaatgagatgggtttgctggaaacaactaagaaagacttaggcatcgggcacgtagcagtggagaaccatcaccatgctaccatgctagatgttgacctgcacccagccagtgcctggacactctacgcagtggctaccactataattacacctatgatgcggcatacgatcgaaaacaccactgccaatatttcgcttacagcgatcgctaaccaagccgcaatactgatgggattggataagggctggcccatcagcaagatggacattggtgtcccactgctcgccctggggtgctactcccaggtgaatcctcttaccttaaccgctgcagtcctgatgctcgtggcccactatgcgatcattggcccgggattgcaggctaaagccacacgtgaggcacaaaagagaactgccgctggcatcatgaaaaaccccacggttgatgggatagtggccattgacctggatccagtagtgtacgacgcaaagtttgaaaaacagctaggacagatcatgctgctcatcctttgtacctctcagattctgttgatgaggacaacttgggctctgtgcgagtcaatcaccctcgccacaggccctctgaccactttatgggagggtagccccgggaagttctggaatacgacaatagcggtctccatggccaacattttccgcggaagttatcttgcaggcgctggtctggccttttctctcatgaaaagcctaggcgggggacggcgaggcaccggggcacaaggagaaactctgggcgagaaatggaagagacagttgaatcagctgtcaaaatccgagttcaacacctacaagaggagtggtatcatggaggttgaccgcagcgaagctaaagaggggctcaagcggggagagacaactaagcacgccgtgtctagaggcaccgccaaacttcgttggtttgtcgaaaggaatctggtgaagccagagggtaaagtaattgatttgggctgtgggcggggaggctggtcctattactgcgcggggctgaagaaagtgacagaagttaagggatatacgaaaggcggtcctgggcatgaggaacccatcccgatggctacctacggatggaacctcgtgaagttacactcaggcaaggacgtcttctttataccacctgagaaatgtgatactctgctttgcgacatcggcgagagctcgcccaatccaacaattgaagaggggcgcaccctgcgagtgctaaagatggtcgaaccctggctcagaggaaaccagttctgtatcaaaattctgaatccttacatgccgtctgtggttgagactttggagcaaatgcagaggaagcatggtggcatgctggtacggaaccccctcagtcgcaattccacacacgaaatgtattgggtgagctgcgggaccggaaacatcgtctcagcagtgaatatgacgtccagaatgcttctgaacaggtttaccatggcccaccgaaaaccaacatacgagcgggatgttgacttaggcgctggtactcgtcatgtggccgtcgaacctgaggtggcaaacctggatattatcgggcagagaatagaaaatattaagcacgagcataagtctacctggcactatgacgaggataacccctacaaaacatgggcctatcatggaagctacgaagtaaagcctagtggctccgctagctctatggtgaatggcgttgtcaaattgctcactaagccatgggacgtgatccccatggtgacccagatcgcgatgacagataccactcctttcgggcaacagcgcgtctttaaagagaaggttgacacgaggacaccaaaggccaaacggggaaccgcacagattatggaagtgactgctaagtggctgtggggtttcctatcaagaaacaaaaagccccgcatatgtaccagggaggaatttacacgaaaagtacggagtaatgccgcaatcggcgccgtgttcgtcgacgagaaccaatggaactccgctaaggaggccgtggaagatgagagattttgggaccttgttcacagggaacgcgagctgcacaagcaggggaaatgcgcgacgtgcgtgtataacatgatgggaaagcgtgagaagaagctcggcgagttcggtaaagcaaaggggagccgggccatttggtacatgtggctgggagctagattcttggagtttgaagccctgggcttcatgaatgaggatcattggttttctagggaaaactcgctctcaggcgtcgagggggagggacttcacaaactgggttacatcttacgcgacattagcaagatcccgggcgggaatatgtatgcagatgacaccgctggatgggatactcgaataacagaagacgatctgcagaacgaggccaagatcaccgacattatggaacctgagcatgctttgctcgccaaatccatcttcaagctgacttaccagaataaagtggtacgggttcaaagaccagcaaagaacggcacagtgatggatgtcattagtaggcgcgaccagagaggttctggacaggtgggaacctatggcctaaatacatttactaacatggaagcgcagcttatccggcaaatggagagcgagggcatattctccccctcagaactggagacccctaacctcgccgggagggtgctggattggttggaaaaacacggagtcgagcgtttaaagcgaatggctattagtggtgacgactgtgttgtgaagccaatcgatgaccgctttgccacggcactgaccgctctcaatgatatgggcaaagtaagaaaggacatcccccagtgggaaccgtctaaagggtggaacgattggcaacaggtgcctttctgcagccaccattttcaccaacttattatgaaggacggacgggagatagtcgtgccctgtaggaatcaggatgagctggttggccgcgccagagtgtcccagggtgcagggtggtcactacgggaaacagcctgcctgggaaaaagctacgcgcagatgtggcaactcatgtatttccataggcgagacttgcgtctggctgccaacgcaatctgttctgccgtcccagtggagtgggtacctacttccagaaccacatggagtattcacgctcatcaccagtggatgactaccgaagatatgcttagcgtttggaatcgcgtgtggatcgaggaaaacccctggatggaggacaagacgcacatttcgtcctggggcgatgtcccatacctgggcaagcgggaggaccagtggtgcgggtctctcatcggattaacagccagggcaacctgggctactaatatacaagtggccatcaaccaggttagacgcctgattggtaatgaaaactatttggactacatgacatcaatgaaacggtttaagaatgagagcgatcccgaaggcgcgctgtggtga

SEQ ID NO: 13978 - RNA, 9879 nt, synthetic construct
  misc_feature 1..9879: note = derived and/or modified CDS sequence (opt3) from DENV-1__JF937617__SS-prME
  source 1..9879: mol_type = other RNA
tccgtgaccatgctgctcatgcttatgcccacagcactggctttccacttgactacgagaggaggggagcctcatatggtcgtttccaagcaagaaagaggaaaatctttactgtttaagacctcagccggtgtgaatatgtgcacactgatcgccatggacctcggcgagctgtgtgaagatactatgacctacaaatgcccacggattacagaggcggaaccggacgatgtagactgttggtgcaatgctaccgatacttgggtgacatatgggacctgtagtcaaacgggagagcaccgccgagacaagcgtagcgtcgcccttgcaccccatgtgggcctgggtttggagactagaaccgaaacatggatgtcctctgagggggcctggaaacagatacagagggttgaaacttgggctctccggcaccctggattcaccgtgatcgcactgtttctggcccatgctattggcacatcgatcacccagaagggcattatcttcatactcttaatgctggtcacgccatcaatggccatgcgctgcgtggggatcggaagcagagattttgtagagggtcttagtggcgcgacttgggttgacgtggtcttggagcacgggtcctgtgtgacaaccatggcaaaggataaacccactctggacattgaactgctcaagacagaggtgaccaaccctgccatcctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggttgggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacgtaatgtggaaacagatatctaacgagctgaatcatatcttactggaaaacgacatgaagttcaccgtcgtggttggcgatgtggctgggattcttgcccagggcaaaaagatgatccgccctcaacccatggagtacaaatattcgtggaaaagctggggcaaggcgaagattatgggggccgacgtccagaatactacctttatcatagatggaccaaacacacctgaatgtcccgacgatcagagagcttggaatatctgggaggtggaggactacggcttcggtatttttactaccaacatctggttgaagctcagggattcctatacacaggtttgcgaccaccgtctgatgtcagcagccattaaagatagtaaggctgtgcacgccgacatggggtactggatcgaatctgagaaaaatgaaacgtggaagctagcacgggcgagcttcatagaggtaaagacctgtatttggccaaaatcccatactctgtggtcaaacggagtcctcgaaagcgagatgatcattcccaagatctatggcggtcctatatctcaacacaattaccgaccaggctacttcacacagaccgccgggccgtggcatctgggaaaacttgagttggattttgacctgtgcgaaggcactacagtggtggtcgatgagcactgcgggaacagaggaccctccttaaggaccacgactgttaccggcaagatcattcacgaatggtgttgccgcagttgtacactccctccactgcggttcagaggtgaggacgggtgctggtatggaatggagatcaggcccgtgaaagaaaaggaggaaaatcttgtaaagagcatggtgtctgctggctccggtgaggtcgactcatttagtctgggcttgctctgtattagcatcatgatagaagaggtgatgcgctcgcgatggtcccggaaaatgctgatgaccgggactctagttgtgttcctgctcctgattatgggacagcttacatggaacgatttgatccgtctgtgcatcatggtcggcgccaatgcatctgacagaatggggatgggaaccacatacttagctctcatggccacttttaagatgaggcctatgttcgcagtgggcctgctttttcgccggctgaccagcagagaggttctactcctgacgattggtttgtcactggtggccagtgtcgaattaccaaactccctcgaggaactgggggatggacttgctatgggcatcatgattctgaaattgctcacagacttccaatctcatcagctgtgggcgaccctactgagccttacttttataaagaccacattctccctccactatgcctggaaaactatggcaatggtactgtcaatcgtgagcttgtttcccctgtgtttaagtaccacgtctcagaagacaacctggctcccggttctgcttggctccctggggtgcaagcctttgactatgttcctcattgctgagaataaaatctggggaaggcgaagctggccactgaacgaaggtattatggccgtgggcatcgtctcgatactactgtcatctcttctcaagaacgatgtgcccctggccgggcctttgatcgctggaggcatgttaattgcatgttacgtaatcagtggttccagcgccgacctgtctctcgagaaagcggctgaggtgagctgggaagaggaagccgagcattccggggcatcacacaatattctggtcgaagttcaggatgacggaacaatgaagatcaaagatgaggagcgcgacgatacccttactatactgttgaaggccacactactggctgtgagtggcgtgtatcccctcagcattccagcaaccctgtttgtctggtacttctggcagaaaaagaagcagcggtctggcgtgctttgggacacgccttcacccccagaagttgagagagccgtattagatgacgggatctataggatcatgcagcgtggactgctcggtcgcagccaggtgggcgtcggggtgttccaagaaaacgtttttcatactatgtggcacgtgacccggggagcggtcttgatgtaccagggcaaaagactggagccgagttgggctagcgtgaagaaagacctcatttcctacggtgggggatggaggctgcagggctcttggaatacaggcgaggaagtacaggtcatagccgtggagcctgggaagaaccccaaaaatgttcaaaccgcaccaggaacattcaagactcccgaaggtgagatcggcgccattgctcttgattttaagcctgggacctcgggaagcccaatcgtgaaccgagaaggcaaaattgtcggtctgtatgggaatggagtggttacgacatcaggcacttacgtgtccgccatcgcacaggctaaggccagtcaggagggccccttgcctgagatagaagacgaggtcttccggaaacgcaacctaaccatcatggatctgcacccggggtctggaaagacaagaaggtatctcccagcgattgtgcgggaagccatcaaacgaaagttaagaaccctgattcttgcacccactcgcgtagtggctagcgagatggccgaagctctgaagggtatgcctatcaggtaccaaaccacagcagttaaatccgagcatacgggcaaggagatagtcgacctcatgtgccacgccacttttaccatgcgtttgctgtcaccagtgcgggtgcccaattataacatgattatcatggatgaagcccatttcacagacccttctagcatcgctgcgagagggtacattagtaccagggtcggaatgggcgaggcagccgctatctttatgactgccacaccgcccggttccgtagaagcattcccacagagcaatgccgtgatacaggatgaggaacgcgacattcctgagcgatcttggaactcagggtatgagtggatcaccgattttcccggaaaaacggtttggttcgtgccatccattaagagtggcaatgacatcgctaactgtctcaggaaaaatggcaagcgggtcatacagctgagcaggaagacttttgatacagaataccagaaaaccaagaacaacgactgggactacgtggttaccactgatatttcggagatgggggcgaatttccgcgccgaccgtgtgatcgatcctagacggtgccttaaacccgtcatcctaaaggacggaccagaaagggtgattctggcaggtccgatgcctgtaacagtggcttctgccgcacagcgccgaggcagaatcgggcggaaccacaataaagagggagatcagtatatttacatgggccagcccttgaacaatgacgaggatcatgcccactggaccgaagctaagatgttactggacaacataaatacaccagagggtatcattcccgccctcttcgaacctgagagggaaaagtccgcggcaatcgatggggagtatcgcctgagaggcgaggccaggaaaacttttgttgaacttatgcggcgtggagacctgccagtctggctcagctacaaggtggcttcagagggcttccaatatagtgatcgccgatggtgctttgacggggaaagaaacaatcaggtgttggaggaaaacatggatgtcgagatctggacgaaagagggagaaaggaagaaactgcggccccgctggctagacgccagaacctactctgaccctctggctctcagggagttcaaggaatttgcagccggtcggcgatccgttagcggcgatcttattctggagatagggaaattaccgcagcacttgacacagagagctcaaaatgccctggacaacctcgtgatgctgcataattcagaacagggaggccgcgcatataggcacgcgatggaggagcttccagatactatcgaaaccctgatgctcttggccctgattgctgtattaacaggtggggtgaccctattctttctgagtggccggggactcggcaagactagcatcgggcttctgtgtgtcatggcctcctctgtgttgctgtggatggcaagcgttgagccccattggattgctgcctccatcatactcgagttctttctgatggtgcttctcatccctgagcccgaccgtcagagaacgccacaggataaccaactggcatacgtcgtaattggattgctgttcatgatcttaaccgtggccgctaatgagatgggtctactggaaacaactaagaaagacctcggcattgggcacgcggccgttggaaaccaccatcacgcagctatgcttgatgtggacctgcatcctgcctcagcctggaccttgtacgcagtcgctacaaccatcataactcccatgatgaggcacacaattgagaacacgaccgccaatatctctctgactgcgattgctaaccaggccgcaatcctcatgggcctggataagggttggccaataagtaaaatggacatcggggtgcctcttttagccctgggctgctattcgcaggtcaatccgctcacattgaccgctgcagtgctgatgctagttgcccattacgcgattatcggacccggcctgcaagctaaggccacccgcgaagcacagaaacggacagccgctgggattatgaagaacccaactgtggatggaatcgtagccatagacctcgatcctgtggtctatgacgcaaagtttgagaaacagcttggccagattatgctgttgatcctgtgtacgagccaaatcctcctgatgcgaaccacatgggctttatgcgaatccattactcttgccaccggtcccctgacaaccctctgggaggggtctccaggaaagttctggaatactacgatcgcggtttcaatggccaacatatttagaggcagctacctagcaggagctggcctggccttctccttgatgaaaagtctagggggaggcaggcgcgggacaggagcacagggcgagaccctcggtgaaaagtggaaacggcagcttaatcagctgtctaagagcgagttcaacacttataagagatcagggattatggaagtggaccgttccgaggctaaagaaggattgaagaggggcgagaccacaaaacacgccgtcagtcggggtactgccaagctgcgctggtttgtggagcgaaatctcgtaaaacctgaaggcaaggtgatcgatttagggtgtggaagaggcgggtggagctactattgcgcgggactgaagaaagttaccgaggtgaagggctacacaaaaggtgggcccggacacgaagaaccgattccaatggctacgtacggctggaaccttgtcaagctgcattctggcaaagacgtgttctttatccctcccgaaaagtgtgataccctactctgcgacataggggagtcctcaccaaatcccactatcgaggaaggaaggacactgcgggtcttgaaaatggtggagccttggctgcgcggtaaccaattctgtattaagatcctcaatccgtatatgcccagcgttgtagaaacccttgagcagatgcagagaaagcacggcgggatgctggtgaggaacccattatcgcgaaattctactcatgagatgtactgggtcagttgcggaacaggcaacattgtgtccgcagttaatatgaccagccggatgctgttgaaccgttttacgatggcccacagaaaacctacctatgaacgcgatgtggacctcggtgctgggacaaggcacgtcgccgtggagcccgaagtagcaaacctggatatcattggacagcggatcgagaatataaagcatgaacacaaatcaacttggcattacgacgaggataacccttataagacctgggcctaccacggctcctatgaggtgaaaccatctggcagcgctagttccatggttaatggggtcgtgaagctacttacaaagccctgggacgtgattcctatggtcactcaaatcgcgatgaccgatacaaccccattcggacagcagagagtttttaaagaaaaggtggacactcgcacgcccaaagccaagaggggtacagcacaaatcatggaggtaaccgctaaatggctgtggggcttcctcagccgaaacaagaagccgcggatttgtactagagaagagtttaccaggaaagtgcgctctaatgccgcaataggggccgtcttcgtggacgaaaaccagtggaactcagctaaggaggccgttgaggatgaacgtttttgggacctggtgcatcgggagagagaattgcacaaacagggaaagtgcgcgacatgcgtctacaacatgatgggcaaaagggagaagaagctgggtgagttcgggaaagcaaagggaagtcgcgccatctggtacatgtggctcggcgctcgatttcttgagttcgaggccctgggcttcatgaatgaagatcactggttttcccgggagaacagcttatctggggtggaaggagagggtctgcataaattgggctatattctcagagacatctcgaagattcctgggggaaatatgtacgcagatgacacggctggctgggataccaggatcactgaggacgatctgcagaacgaagcccgcataacagacatcatggagccagaacacgctctacttgccaaatcaattttcaagctgacctatcaaaataaagtagttagagtgcagcggcccgcaaagaacggtactgtcatggatgtgatcagcaggcgtgaccagcgagggtccggacaggtgggcacatacggcctcaatacctttacaaacatggaggcgcaactgattcgccagatggaaagtgaggggatcttctctcctagcgagttggaaactccaaacttagccgagagagtcctggattggctcgaaaagtatggagttgagcggcttaaaaggatggctatatccggtgacgactgtgtggtaaagcccattgatgaccgctttgccaccgcactgacggctctaaatgatatgggcaaagtgagaaaggacatcccgcagtgggaaccttcaaaagggtggaacgattggcagcaagtccccttctgcagtcatcactttcaccagctgatcatgaaggacggacgggagattgtggttccatgtaggaatcaggatgagctcgtgggccgagcccgtgtctctcagggtgcagggtggagcttgagagaaaccgcctgcctgggaaagtcctacgcgcaaatgtggcagcttatgtatttccatcgccgggacctgaggctcgctgccaacgcaatatgttcagccgtgcctgtagattggatccccacaagcagaactacctggtctattcacgctcatcaccagtggatgacaactgaggacatgttatccgtttggaatcgcgtgtggatcgaagagaacccatggatggaagataaaacccatattagtagctggggcgacgtcccctacctgggcaagcgggaggaccaatggtgcgggtcgttgatcggactgacggccagggcaacatgggctaccaatatacaggtggccatcaaccaggttcgaagactcattggtaatgagaactaccttgattatatgacttccatgaaacggtttaagaatgaatctgaccctgagggcgcgctgtggtga

SEQ ID NO: 13979 - RNA, 9879 nt, synthetic construct
  misc_feature 1..9879: note = derived and/or modified CDS sequence (opt3) from DENV-1__JF937618__SS-prME
  source 1..9879: mol_type = other RNA
agcgtgaccatgctgctcatgcttatgcccacagccctggctttccacttgactacgcggggaggggagcctcatatgatcgtctccaagcaggaaaggggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaggacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaagcccctaccaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggatcgttcaaactggagaaggaagtggccgagacgcagcacggtacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgccagtgtggaactgccaaactccttagaggaactcggggatggactggctatgggcattatgatccttaaactgttgaccgacttccaatctcatcagctctgggcgactctgctaagcctgacctttattaagacaactttctcccttcactatgcctggaaaaccatggcaatggttctctcaatcgtgagcctgtttcccttgtgtctgagtacgacatctcagaagaccacttggttaccggtcctcctgggctcccttgggtgcaagcctctgacaatgttcttgatagctgagaataaaatctggggaaggcgaagctggccactcaacgaaggtattatggccgtaggcatcgtgtcgattctgctatcatctctgcttaagaacgatgttcccctcgccgggcctctgatcgctggaggcatgttgatagcatgttacgtgattagtggttccagcgccgacttatctctggagaaagcggctgaggtcagctgggaagaggaagccgagcattccggggcatcacacaatatcctcgtggaagtacaggatgacggaaccatgaagatcaaagatgaggagcgcgacgatactctgacaattcttctgaaggccaccttgctagctgtgagtggcgtctatcccctgagcataccagcaacgctctttgtttggtacttctggcagaaaaagaagcagcggtctggcgtgctgtgggacactccttcacccccagaagtggagagagccgtccttgatgacgggatctataggattatgcagcgtggattactgggtcgcagccaggtgggcgttggggtattccaagaaaacgtgtttcataccatgtggcacgtcacacggggagcggtgctcatgtaccagggcaaaagattggagccgagttgggctagcgttaagaaagacctgatctcctacggtgggggatggaggctccagggctcttggaataccggcgaggaagtgcaggtcattgccgtggagcctgggaagaacccccgaaatgtacaaacaactccaggaaccttcaaaacgcccgaaggtgaggtcggcgcaatcgccctggattttaagcctgggacatcgggaagcccaatagtgaaccgggaaggcaagatcgttggtctttatgggaatggagtggtcactacctcaggcacatacgtgtccgctattgcccaggcaaaagctagtcaggagggccccctgcctgagatcgaagacgaggttttccgcaagagaaacttgaccattatggatctacacccggggtctggaaaaactaggcggtatctgccagccatcgtgcgagaagcgataaagagaaaactccgcaccttaattctggcccccacaagggtcgtggcaagcgagatggctgaagcccttaagggtatgcctatccgttaccaaacgactgctgtaaagtccgagcataccggcaaagagatcgtggacctgatgtgccacgcaacatttaccatgcggctcttgtcaccagttagagtccccaattataacatgattatcatggatgaagcccatttcactgacccttctagcatagccgctagggggtacattagtacacgcgtgggaatgggcgaggcggcagccatctttatgaccgctacgccgcccggttccgtggaagccttcccacagagcaatgcagtcattcaggatgaggaacgagacatccctgagagatcttggaactcagggtatgagtggataactgattttcccggaaagacagtatggttcgtgccatccattaaaagtggcaatgacatcgccaactgtctgcggaagaatggcaaaagggttatccagctcagccgcaagacctttgataccgaataccaaaagactaaaaacaacgactgggactacgtggtcacaaccgatatttcggagatgggggctaatttccgtgcggacagagtgatcgatcctcggaggtgcctgaagcccgttattcttaaagacggaccagaacgcgtgatactagccggtccgatgcctgtcacagtggcatctgctgcccagcgaagaggccggatcgggaggaaccacaataaggagggagatcagtatatttacatgggccagcccctgaacaatgacgaggatcatgcacactggactgaagccaaaatgttgttagacaacatcaatacgccagagggtatcattcccgctctgttcgaacctgagcgcgaaaagtccgccgcgatagatggggagtatagactcaggggcgaggcacggaagacctttgtagaactgatgcgtcgcggagaccttccagtgtggctgagctacaaagttgcctcagagggcttccaatatagtgatcgaagatggtgctttgacggggaaaggaacaatcaggtcctcgaggaaaacatggatgtggagatctggacaaaggagggagaacggaaaaagttgcgccccagatggctggacgctaggacttactctgaccctctagccctgcgggagttcaaagaatttgctgcaggtcgaagatccgtgagcggcgatctcattcttgagatcgggaagctgccgcagcacttaacccagcgcgcccaaaatgctttggacaacctggtcatgctccataattcagaacagggaggcagggcctatcggcacgcaatggaggagctgccagatacaattgaaacccttatgctgctcgcgttgatcgccgttctgactggtggggtgacgttattctttctaagtggccgtggactgggcaaaaccagcatagggctcctttgtgtaatggcttcctctgtgctgttgtggacagccagcgtcgagccccattggatcgcagcttccattatcctggagttctttctcatggtgctgcttattcctgagcccgacagacagaggactccacaggataaccaactcgcctacgttgtgatcggactgttgttcatgatactgaccgtcgcagccaatgagatgggtttactagaaacaaccaagaaggacctgggcattgggcacgtagctgtgggaaaccaccatcacgcggccatgctcgatgttgaccttcatcctgcatcagcttggactctgtacgccgtggccacaacgatcattacccccatgatgcgccacactatcgagaacacaaccgcaaatatatctttgaccgctatcgccaaccaggcggctattctgatgggcctcgataaaggttggccaatcagtaagatggacattggggtccctctgcttgccttaggctgctatagccaggtgaatccgctgacactcactgcagccgtcttgatgctggtggctcattacgcaatcataggacccggcctacaagccaaagcgacgcgggaagctcagaagcgaaccgccgcagggattatgaaaaacccaacagttgatggaatcgtggccatcgacctggatcctgtagtgtatgacgctaagtttgagaagcagctcggccagattatgcttctgatcttgtgtactagccaaatactgctcatgagaaccacatgggccctgtgcgaatccattaccttagcaactggtccccttacgacactgtgggaggggtctccaggaaaattctggaataccactatcgctgtctcaatggccaacatttttaggggcagctacctcgcgggtgccggcctagcattctccctgatgaagagtctagggggaggccgccgggggaccggagctcagggcgagacactgggtgaaaaatggaagagacagctcaatcagctttctaaaagcgagttcaacacttataagcgttcagggatcatggaagttgacaggtccgaggccaaggaaggactgaaacggggcgagaccacaaagcacgcagtgagtcgcggtacggctaaattgcgatggtttgtcgagagaaatctggtgaagcctgaaggcaaagtaatagatctcgggtgtggaaggggcgggtggagctactattgcgccggattaaagaaggtgaccgaggttaaaggctacactaagggtgggcccggacacgaagaaccgatcccaatggccacatacggctggaacctggtgaaacttcattctggcaaggacgtcttctttattcctcccgaaaaatgtgataccctgctatgcgacatcggggagtcctcaccaaatcccactattgaggaaggacggacactccgcgtgctgaagatggtcgagccttggttgagaggtaaccaattctgtatcaaaattctgaatccgtatatgcccagcgtggttgaaaccctcgagcagatgcagaggaagcacggcgggatgcttgtacgaaacccactgtcgagaaattctacgcatgagatgtactgggtgagttgcggaaccggcaacatcgtctccgcggtgaatatgacaagccgtatgttactgaacagatttactatggctcaccgcaagcctacctatgaaagggatgttgacttgggtgcagggacacggcacgtggccgtcgagcccgaagtggctaacctcgatataattggacagagaatcgagaatatcaaacatgaacacaagtcaacttggcattacgacgaggataacccttataaaacctgggcctaccacggctcctatgaggtaaagccatctggcagcgcaagttccatggtgaatggggttgtcaaactgctaacaaagccctgggacgtgattcctatggtgacccaaatagccatgactgatacgacaccattcggacagcagcgcgtctttaaggaaaaagttgacaccaggactcccaaggctaaacgaggtaccgcgcaaatcatggaggtgacagccaagtggctttggggcttcctgagccggaacaaaaagccgagaatttgtacgagggaagagtttacccgcaaggtacgttctaatgcagctatcggggccgtgttcgtcgacgaaaaccagtggaactcagcaaaagaggccgtggaggatgaacggttttgggacctcgttcatagagagagggaactgcacaagcagggaaaatgcgctacttgcgtgtacaacatgatgggcaagcgcgagaaaaagttgggtgagttcgggaaggccaaaggaagtcgagcgatttggtacatgtggctgggcgcacggtttctcgagttcgaggcccttggcttcatgaatgaagatcactggttttccagagagaacagcctgtctggggtcgaaggagagggtttacataagctgggctatatcttgagggacatatcgaaaatccctgggggaaatatgtacgctgatgacacagccggctgggatacccgcattactgaggacgatctccagaacgaagcaagaatcacagacattatggagccagaacacgctctgctagccaagtcaatcttcaaacttacctatcaaaataaggtggtacgggttcagaggcccgctaaaaacggtacagtgatggatgtcataagccgtcgagaccagcgcgggtccggacaggtgggcacttacggcctgaatacctttacgaacatggaggcccaactcattagacagatggaaagtgaggggatcttctctcctagcgagctggaaaccccaaacttggcagagcgggtgttagattggctggaaaagtatggagtcgagaggctcaagcgcatggcgatctccggtgacgactgtgttgtgaaacccattgatgacagatttgccacagctcttactgccctgaatgatatgggcaaggtacggaaagacataccgcagtgggaaccttcaaaggggtggaacgattggcagcaagtgcccttctgcagtcatcactttcaccagctaatcatgaaagacggaagggagattgtcgtgccatgtcgaaatcaggatgagctggttggccgtgcaagagtgtctcagggtgctgggtggagcctccgcgaaaccgcctgcttgggaaagtcctacgcacaaatgtggcagctgatgtatttccatcggagggaccttagactggccgcgaacgctatctgttcagccgtccctgtggattggattcccacaagccgcactacctggtctatccacgcacatcaccagtggatgacgacagaggacatgctctccgtatggaatcgggtttggatagaagagaacccatggatggaagataagacccatatcagtagctggggcgacgtgccctacttaggcaaaagggaggaccaatggtgcgggtcgctgattggattgactgcccgagctacatgggccaccaatatccaggtcgcaattaaccaggtgagacggctgatcggtaatgagaactacctcgattatatgacttccatgaagaggtttaaaaatgaatctgaccctgagggcgctctttggtga

SEQ ID NO: 13980 - RNA, 9879 nt, synthetic construct
  misc_feature 1..9879: note = derived and/or modified CDS sequence (opt3) from DENV-1__JF937619__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctactcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggaagcttcaaacttgaaaaggaggtcgctgagacccagcacggtacggtgttggttcagattaagtacgaaggcacagatgcgccttgcaaaataccattctcgacccaagacgagaagggggtgactcagaacggacgcctgatcacagcaaatcccattgtaaccgataaagaaaagcctgtcaacatcgaggccgagccaccctttggcgaatcttatatagtgattggtgctggggagaaagccctcaagctgtcctggttcaagaaaggctcaagtatcggaaagatgtttgaagcaactgccagaggcgctaggcggatggccatccttggggacaccgcatgggatttcggaagcattggtggcgtttttacatccgtggggaaactggtccatcagatcttcggaacggcgtacggcgtgttgttttctggtgtaagctggaccatgaagattgggataggcgtgctcctgacttggttaggactgaattcacgaagtacatccctaagcatgacctgtatcgctgttggcctcgtcacactgtaccttggggtgatggtgcaggccgactctggatgcgtcattaactggaaaggccgcgagttgaagtgtggttcagggatcttcgttactaatgaagtgcacacctggacggagcaatataagtttcaggcagatagtccgaaaagactgagcgccgctatcggaaaggcctgggaggaaggcgtgtgcggtattaggtccgcaacacggctcgagaacataatgtggaaacagatctctaacgaactgaatcatattttactggagaacgacatgaagttcaccgtagtcgtgggcgacgttgctgggatccttgtgcagggaaaaaagatgattcgccctcaacccatggaatacaaatattcgtggaagagctggggcaaggccaaaatcataggggcggatgtccagaattccacttttatcattgacggaccaaacacccctgagtgtcccgatgaccagagagcctggaatatctgggaggtggaagattacggcttcggtatttttacaactaacatctggttgaagctcagggactcatatacccaggtttgcgatcaccgtctgatgagtgctgcaataaaagactctaaggccgtgcacgctgatatggggtactggattgagagcgaaaaaaatgagacatggaagctagcccgggcatccttcatcgaagtaaagacgtgtatttggccaaaatcacataccctgtggagcaacggagtcctcgagtctgagatgatcatacccaagatccacggcggtcctatttcccaacataattatcgaccaggctacttcactcagacagcggggccgtggcacctgggaaaacttgaattggactttgatctgtgcgagggcaccactgtggtggtcgacgaacactgcgggaacagaggacccagtttaaggacaaccacggttactggcaagatcattcatgagtggtgttgccgcagctgtaccctccctccactgcggttcagaggtgaggatgggtgctggtacggaatggaaatcaggcccgtgaaagagaaggaagagaatcttgtaaagtctatggtgtccgccggctcaggtgaagtcgacagttttagcctgggcttgctctgtatatcgattatgatcgaggaggtgatgcgctcccgatggtctcggaaaatgctgatgacagggaccctagctgttttctttctgctcatcatgggacagctgacttggaacgaccttattcgtttgtgcatcatggtgggcgccaatgcaagcgatagaatggggatgggaacaacctatctggctttaatggtcacattcaagatgaggcctatgtttgccgtgggcctcctgttccgccggcttacttcaagagaagttctgctactcaccattggtctgagtttggtggcatccgtcgagctgccaaactctttagaagagctcggggacggactggccatgggcataatgatccttaaactgttgacggattttcaaagctaccagctctgggctacactgctatccctgaccttcattaagactaccttttcacttcactatgcgtggaaaacaatggccatggtactcagcatcgtgagtctgttccccttgtgtctgtctactacctcccagaagacgacatggttaccggttctcctgggcagccttgggtgcaagcctctgaccatgtttttgattgcagaaaataaaatctggggaaggaagtcgtggccactcaacgagggtataatggctgtgggcatcgtctcaattctgctatctagtctgcttaaaaacgacgtgcccctcgccgggcctctgatcgccggaggcatgttgattgcttgttacgtaatctccggtagctctgcagatttaagcctggagaaggccgcggaagtgtcctgggaggaagaggctgaacattcaggggccagtcacaatatactcgtcgaggttcaggacgatggaactatgaaaattaaggacgaggaacgagatgacacactgaccatccttctgaaagcaactttgctagccgtgagcggcgtgtatcccctgtctatcccagctacactcttcgtctggcatttctggcaaaagaagaaacagcgctccggcgtgctgtgggataccccttcacccccagaggttgaacgggcagtacttgacgatgggatttacagaataatgcagaggggattactgggtcgtagtcaggtgggcgtcggggtgtttcaagagaacgttttccacacgatgtggcacgtgactcgcggagccgtcctcatgtatcagggcaagcggttggagccgagctgggcgtccgtgaaaaaggacctgatctcttacggtgggggatggagatttcagggctcgtggaataccggcgaagaggtacaggtcattgctgtggaacctgggaaaaaccccaagaatgttcaaacagccccaggaaccttcaagacacccgagggtgaagtgggcgcaatcgccctcgactttaaacctgggactagcggatcaccaattgtcaacagggagggcaagatcgtgggtctgtacgggaatggagttgtgaccacgtccggcacatatgtcagtgctatagcccaggcaaaagcttctcaggagggcccccttcctgaaatcgaggatgaagtgttccgaaagcggaacctgactattatggacttgcatccggggagcggaaaaacccgcagatacctaccagccatcgtaagggaggcgattaagcggaagctgcgaacactcatcttagcccccaccagagtggttgcatccgaaatggctgaggccctgaaaggtatgcctatacgctatcaaactaccgctgtcaagtcagagcacacaggcaaagaaattgtggatcttatgtgccatgcaacgtttactatgaggctgctctctccagtgcgtgtccccaattacaacatgatcatcatggacgaggcccacttcaccgatcctagcagtattgccgctcgggggtatatctccacaagagtaggaatgggcgaagcggcagccatatttatgaccgctactccgcccggtagcatggaggccttcccacagtctaatgcagtgattcaggacgaagagagggatatccctgagcgctcatggaactccgggtacgaatggattacagactttcccggaaagaccgtttggttcgtgccaagtatcaaagccggcaatgatatagctaactgtttgcgaaagaatggcaagagagtcattcagctgagccggaaaacgttcgacactgagtatcaaaagaaaaagaacaacgattgggactacgtggttacaaccgacatctcggaaatgggggcgaattttagggccgatcgcgtgatcgaccctcgtagatgcctcaaacccgtcattctgaaggatggaccagagcgggtgatccttgcaggtccgatgcctgtaaccgtggcttctgccgcacagaggcgcggccgaattgggagaaaccataataaggagggagaccagtacatatatatgggccagcccctaaacaatgatgaagaccacgcccactggactgaggctaaaatgctgttggataacatcaatacaccagaaggtattatccccgccttattcgagcctgaacgggagaagtccgcggcaatcgacggggagtacaggctgcgcggcgaagccagaaaaacctttgttgagctcatgaggcggggagatctgccagtctggcttagctataaggtggcttcagaaggcttccaatacagtgaccgtcgctggtgctttgatggggagcgaaacaatcaggtgctggaagagaacatggacgtcgagatttggacaaaagaaggagagagaaagaaactcaggccccggtggttggatgcccgcacttattctgaccctctggctctaagagaattcaaggagtttgcagccggtaggcggtccgttagcggcgacctgatactcgaaatcgggaagcttccgcagcatctgacgcagcgagctcaaaatgccttagataacttggtgatgctgcacaattcagagcagggaggcagagcataccgccatgcgatggaggaactcccagacaccattgagacactgatgcttctggccctcatcgctgtattgactggtggggtgaccctgttctttttaagtggcaaaggactaggcaagacaagcattgggctgctctgtgtcatggcctcctctgtgcttctgtggatggcaagcgttgaaccccactggatcgctgcctccataatcttggagttctttctgatggtgctcctgattcctgagcccgataggcagcggaccccacaggacaaccaacttgcatatgtcgtaatcggactcctgttcatgattttgactgtggccgctaatgaaatgggtctgttagagacgaccaaaaaggatctaggcatcgggcacgttgcggtggaaaaccatcaccatgccgcaatgctggacgtcgatctccaccctgcttcagcctggacactttacgccgtggcaactaccataattacacccatgatgcgtcataccatcgagaacactacagctaatatttctctgacggccatcgcgaaccaggctgccatattgatgggactggacaaaggctggccaatcagtaagatggatattggtgtccctctcctggcacttgggtgctactcgcaggtgaatccgttaaccctgactgccgctgttctcatgttggtggcacactatgccatcattggccccggactgcaagcgaaggctacaagagaagcccagaaaaggaccgcagccggcatcatgaagaacccaaccatagacgggattgtagctatcgatctagaccctgtgatctacgatgccaaatttgagaagcagctgggacagattatgctccttatcctgtgtacaagccaaatattgctgatgcgcactacgtgggcactctgcgagtccattaccctggctacaggccccttaactaccctttgggaaggttctccagggaaattctggaatacaaccatcgccgtctcaatggcgaacattttccggggaagctatctggccggcgcaggtctcgctttttccctaatgaagagtctgggcgggggacgaagaggcactggggcccagggagagacgttgggcgaaaagtggaaaaggcagctgaatcagctctctaagagcgagttcaacacatacaaacgctcaggtatcatggaagttgaccggtccgaggcaaaggaggggcttaaaagaggagaaaccactaagcacgctgtgagtcgtggcaccgccaagctgaggtggtttgtcgagcggaatttggtgaaacctgaaggtaaggtaatagacctgggctgtgggcgcggaggctggagctattactgcgccgggctcaaaaaggtgacagaggttaaaggatatactaagggcggtcccgggcatgaagagccgatcccaatggcgacctacggatggaacttagtgaaactgcactctggcaaggatgtcttctttattcctcccgagaagtgtgacacacttctgtgcgatatcggcgaatcctcaccaaatcccacgattgaggaagggcgaaccctaagagtgctcaaaatggtcgagccttggctgaggggaaaccaattctgtatcaagattttgaatccgtacatgcccagcgtggttgagactctggaacagatgcagcggaaacatggtggcatgctcgtacgcaacccactttcgagaaattctacacacgagatgtattgggtgagttgcgggaccggaaacatcgtctccgctgtgaatatgactagcaggatgctgttaaaccgatttacaatggcacaccggaagcctacctacgaacgtgacgttgatctgggcgccggtacgagacatgtggctgtcgagcccgaagtggccaacttggacataattgggcagcgcatcgagaatatcaaacacgagcataagtcaacctggcactatgatgaagacaacccttacaagacatgggcatatcatggatcctacgaggtaaaaccatctggcagcgccagttccatggtgaatggcgttgtcaagctcctgactaaaccctgggatgtgattcctatggtgacccaaatagctatgacagacactaccccattcgggcagcagagggtctttaaggaaaaagttgatacacggacccccaaggcgaagagaggaactgcccaaatcatggaggtgacggcacgctggctatggggtttccttagcaggaacaaaaagccgcgaatttgtacacgggaagagtttaccagaaaagtaaggtctaatgctgccatcggcgcagtgttcgtcgacgagaaccagtggaattcagccaaggaagctgtggaggacgatcgcttttgggacctggttcaccgtgaacgggagctccacaaacaggggaagtgcgccacttgcgtgtataacatgatgggaaagagagaaaaaaagctgggcgagttcggtaaagcgaaggggagtagggcaatttggtacatgtggttgggagcccgcttcctggagtttgaagctctcggcttcatgaatgaggatcattggttttcccgagaaaacagcctttctggcgtcgagggggagggactgcacaaattaggttacatcctgcgggacatatcgaagatccctggcgggaatatgtatgccgatgacaccgcaggatgggatacaagaattacggaagacgatttgcagaacgaggctaaaatcaccgacattatggaaccagagcatgccctcctggctaagtcaatcttcaagctaacttaccaaaataaagtggtaagggttcagcgccccgccaagaacggcacagtgatggatgtcataagcagacgggaccagaggggttccgggcaggtgggaacctatggccttaatacttttacaaacatggaagcacaactgattcgtcagatggagagtgagggcatcttcctccctaacgaactggagaccccaaatttggcggggcgagtgttagattggctggaaaaatacggagtcgagcgcctcaagagaatggccatctctggtgacgactgtgttgtgaaacccattgatgaccggtttgctacagcccttactgcactgaacgatatgggcaaggtaaggaaggacataccgcagtgggaacctagcaaagggtggaatgattggcagcaagtgcccttctgctcccaccactttcatcagctaatcatgaaggacggacgcgagattgtcgtgccatgtagaaaccaggatgagctggttggccgggctagggtgtcacagggtgccgggtggagtctccgagaaaccgcatgcttgggaaaatcttatgcccaaatgtggcagctgatgtacttccaccgtagagaccttcgcctggcggctaatgccatctgtagcgcagtccctgtggattgggtacccacgtcccggaccacatggtcaattcatgcccaccatcagtggatgactaccgaggacatgctcagcgtttggaacagggtgtggatcgaagagaatccatggatggaagataagacaagaatatcttcctgggaggacgtcccctatttaggcaaacgcgaggaccaatggtgcggcagtctgatcgggttgactgctcgggccacctgggcaacgaacattcaggtggctatcaatcaggttaggcgactgattggaaacgaaaattacagcgattacatgacatcgatgaagagatttaagaacgagtccgaacctgagggtgccctctggtga

SEQ ID NO: 13981 - RNA, 9879 nt, synthetic construct
  misc_feature 1..9879: note = derived and/or modified CDS sequence (opt3) from DENV-1__GU131827__SS-prME
  source 1..9879: mol_type = other RNA
tccgtgaccatgctgctcatgcttatgcccaccgcactggctttccacttgactacgcggggcggggaacctcatatgatcgtctccaagcaggaaaggggaaagtctttactgtttaagacctcagccggtgttaacatgtgcacactaattgccatggacctcggcgaactgtgtgaagatactatgacctacaaatgcccacggataacagaaaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcagaaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgccatcaactggaagggcagagaacttaaatgtggttcagggatcttcgtcaccaatgaggttcacacgtggacagaacaatataagtttcaggcagacagtccgaagaggttgagcgccgctattggaaaagcctgggaggagggcgtgtgcggtatacggtccgcaacccgcctggaaaacatcatgtggaagcagatttctaacgagctcaatcatatcctgttagaaaacgacatgaaattcactgtggtagtcggcgatgtggctgggattctggcccagggaaagaaaatgatcagacctcaacccatggagtacaagtattcgtggaaaagctggggcaaggcgaagataatcggggccgacgttcagaataccacatttattatcgatggaccaaacactcctgaatgtcccgacgatcagagggcttggaatatttgggaggtggaggactacggcttcggtatctttaccacaaacatatggcttaaattgcgtgattcctatacgcaggtctgcgaccaccggctcatgtcagcagccattaaggatagtaaagctgtgcacgccgacatggggtactggatcgaatctgagaagaatgaaacctggaaactggcacgagcgagcttcattgaggttaagacttgtatctggccaaagtcccatacactatggtcaaacggagtgctggaaagcgagatgataatccccaaaatttatggcggtcctatctctcaacacaattacagaccaggctacttcacccagactgccgggccgtggcatctcggaaagctggagcttgattttgacttgtgcgaaggcacaaccgtagtcgtggatgagcactgcgggaacaggggaccctccctgcgcacgactaccgtgacaggcaaaattatccacgaatggtgttgccggagttgtaccttacctccactcagattcaggggtgaggacgggtgctggtatggaatggagatacgccccgtcaaggaaaaagaggaaaatctggttaagagcatggtgtctgctggctccggtgaggtagactcatttagtcttggcctgttgtgtattagcatcatgatcgaagaggtgatgcgatcgcggtggtcccgtaagatgctcatgactgggacactggccgtcttctttctactgattatgggacagctcacctggaacgatctgatcagactttgcattatggtgggcgcaaatgcttctgacaggatggggatgggaacaacttacttggccctgatggcaaccttcaaaatgcgccctatgtttgccgttggcttactcttccggagactgacgagcagggaggtgcttctgctaacaataggtctctcactggtcgctagtgtggaattgccaaactccctggaggaattaggggatggactcgcgatgggcatcatgattctgaaacttctgaccgactttcaatctcatcagttgtgggccactctcctgagcctaaccttcatcaaaacaactttttccctgcactatgcatggaagaccatggctatggttctttcaattgtgagcctcttccccctgtgtttgagtacgacatctcagaaaaccacttggctgccggtcttactcggctccctggggtgcaagcctcttacaatgtttctgatcgccgagaataagatatggggacgacgcagctggccattgaacgaaggtatcatggccgtaggcattgtgtcgatcctcctgtcatctctactgaaaaacgatgttccccttgctgggcctctcattgcaggaggcatgctgatcgcctgttacgtgataagtggttccagcgcggacttgtctttagagaaggctgccgaggtcagctgggaagaggaagcagagcattccggggcctcacacaatattctggtggaagtacaggatgacggaaccatgaaaatcaaggatgaggagcgggacgatactctcacaatcctgcttaaagctaccctgttggcagtgagtggcgtctatcccctaagcattccagccacgctgttcgtttggtacttctggcaaaagaaaaagcagagatctggcgtgctctgggacactccttcacccccagaagtggagagggcggtcctggatgacgggatatatcgtatcatgcagcgcggacttttaggtcggagccaggtgggcgttggggtatttcaagaaaacgtgttccataccatgtggcacgtcacaagaggagctgtgctgatgtaccagggcaagaggctcgagccgagttgggccagcgttaaaaaggacttgatttcctacggtgggggatggcgactgcagggctcttggaataccggcgaggaagtgcaggtcatcgcagtggagcctgggaaaaaccccaagaatgtacaaacagccccaggaacttttaaaacccccgaaggtgaggtcggcgctattgccctcgatttcaagcctgggacgtcgggaagcccaatcgtgaaccgggaaggcaagatagttggtctgtatgggaatggagtggtcacaacttcaggcacctacgtgtccgcaatcgctcaggccaaagcgagtcaggagggcccccttcctgagattgaagacgaggtttttcgcaagagaaacctgacaatcatggatttgcacccggggtctggaaaaaccaggcggtatctaccagccattgtgcgagaagcaatcaagagaaaactgcgcactctcatattagctcccaccagggtcgtggccagcgagatggctgaagcactgaagggtatgcctattcgttaccaaacaacggccgtaaagtccgagcatactggcaaagagatcgtggaccttatgtgccacgccaccttcacaatgcggctgctctcaccagttagagtccccaattataacatgatcattatggatgaagctcattttaccgacccttctagcatcgcggcaagggggtacataagtactcgcgtgggaatgggcgaggccgctgccattttcatgacagcaaccccgcccggttccgtggaagcctttccacagagcaatgctgtcatccaggatgaggaacgagacattcctgagagatcttggaactcagggtatgagtggatcacggatttccccggaaagactgtatggtttgtgccatccataaaaagtggcaatgacattgcgaactgtttgcggaagaatggcaaaagggttatccagctgagccgcaagacattcgataccgaataccaaaagaccaaaaacaacgactgggactacgtggtcactacagatatctcggagatgggggccaatttccgtgcagacagagtgattgatcctcggaggtgcctcaagcccgttatcctgaaagacggaccagaacgcgtgattcttgctggtccgatgcctgtcaccgtggcctctgcagcccagcgaagaggccggatagggaggaaccacaataaggagggagatcagtatatctacatgggccagcccctaaacaatgacgaggatcatgctcactggacagaagccaaaatgctgttggacaacattaatactccagagggtatcgtacccgcgttatttgaacctgagcgcgaaaagtccgcagccatcgatggggagtatagactgaggggcgaggctcggaagacgttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatttggaccaaggagggagaacggaaaaagctccgccccagatggttggacgctaggacatactctgaccctctggcactacgggagtttaaagagttcgccgctggtcgaagatccgtcagcggcgatctgatactcgagatcgggaaacttccgcagcacctgactcagcgcgcccaaaatgcattagacaacttggttatgctgcataattcagaacagggaggcagggcgtatcggcacgccatggaggagctcccagataccattgaaacactgatgcttctggctctcatcgccgtgttgaccggtggggtaactctgtttttcttaagtggccgtggactaggcaaaacgagcattgggctgctctgtgtgatggcatcctctgtccttctgtggatggctagcgtggagccccattggatcgccgcatccataatcttggaatttttcctgatggttctcctgattcctgagcccgacagacagaggaccccacaggataaccaacttgcctacgtggtcatcggactcctgtttatgattttgacagtagctgcgaatgagatgggtctgttagaaactaccaagaaggacctaggcatcgggcacgtggccgttgagaaccaccatcacgcagctatgctggatgtggacctccatcctgcctcagcctggacactttacgcagtcgctaccactataattacacccatgatgcgccacacgatcgaaaacaccactgccaatatttctctgacagcgatcgctaaccaggccgcaatattgatgggactggataaaggctggccaatcagtaagatggacattggtgtgcctctcctggcccttgggtgctattcgcaggtcaatccgttaaccctgaccgctgcagtgctcatgttggttgcccattacgcgatcattggccccggactgcaagctaaagccacacgggaggcacagaagcgaactgccgctggcatcatgaaaaacccaacggtggatgggatagtagccattgacctagatcctgtggtctatgacgcaaagttcgaaaagcagctgggacagatcatgctccttatcctgtgtaccagccaaattttgctgatgagaacaacttgggctctctgcgagtccatcaccctggccacaggccccttaaccactctttgggagggttctccagggaaattttggaatacgacaatagcggtttcaatggccaacattttcaggggaagctacctggcaggcgctggtctcgccttctccctaatgaagagtctgggcgggggacgccggggcaccggggcacagggagaaactttgggcgagaaatggaagagacagctgaatcagctctctaaaagcgaatttaacacctataagcgttcaggtatcatggaggtggacaggtccgaagctaaggaggggcttaaacggggagagacaactaagcacgccgtcagtcgcggcaccgccaaactgcgatggttcgtggaaagaaatttggtaaagcctgagggtaaagtgattgatctgggctgtgggaggggaggctggagctactattgcgcggggctcaagaaggttacagaagtgaaaggatacacgaagggcggtcccgggcacgaggaaccgatcccaatggctacctacggatggaacttagtcaaactgcattctggcaaggacgtgtttttcatacctcccgagaaatgtgatactcttctgtgcgacatcggcgagtcctcaccaaatcccacaattgaagaggggcggaccctacgcgtcctcaagatggtggaaccttggctgagaggaaaccaattttgtatcaaaattttgaatccgtatatgcccagcgttgtagagactctggagcagatgcagaggaagcacggtggcatgctcgtgcgaaacccactttcgagaaattctacacatgaaatgtactgggtcagttgcgggaccggaaacatcgtgtccgcagttaatatgacgagccgtatgctgttaaacagattcaccatggcccaccgcaagcctacatatgagagggatgtggacctgggcgctggtactcggcacgtcgccgtggaacccgaggtagcaaacttggatattatcgggcagagaatagaaaatattaaacatgagcacaagtcaacctggcattacgacgaggataacccttataaaacatgggcctaccacggatcctatgaagtgaagccatctggcagcgctagttccatggttaatggcgtcgtgaaactcctgactaagccctgggacgtgatccctatggtcacccaaatcgcgatgacagataccactccatttgggcagcagcgcgttttcaaggagaaagtggacacgaggacacccaaggccaaacgaggaaccgcacaaattatggaagtaactgctaagtggctatggggttttcttagccggaacaaaaagccgagaatatgtaccagggaggagttcacacgcaaggtgcgttctaatgccgcaatcggcgccgtctttgtggacgagaaccagtggaactcagctaaagaggccgttgaagatgagcggttctgggacctggtgcatagagaaagggagctccacaagcaggggaaatgcgcgacgtgcgtctacaacatgatgggaaagcgcgagaagaagctgggcgagtttggtaaggcaaaagggagtcgagccatttggtacatgtggttgggagctcggttcctggagttcgaagccctcggctttatgaatgaggatcactggttctccagagaaaacagcctttctggcgtggagggggagggactgcataagttaggttatatcctgagggacatttcgaaaatccctggcgggaatatgtacgcagatgacaccgctggatgggatactcgcataacagaagacgatttgcagaacgaggccagaatcaccgacattatggaaccagagcacgctctcctggccaagtcaatctttaaactaacttatcaaaataaggtagttcgggtgcagaggcccgccaagaatggcacagtcatggatgtgattagccgtcgagaccagcgcggttccggacaggtgggaacctacggccttaatacattcactaacatggaagcgcaactgatcagacagatggagagtgagggcatattttctcctagcgaactcgagaccccaaacctggccgaacgggtcttggattggttagagaagtatggggttgaaaggctgaagcgcatggctatttccggagacgactgtgtggtaaaacccatcgatgacagattcgccacggcactcaccgctcttaatgatatgggtaaggtgcggaaagacatcccgcagtgggagccttcaaagggctggaacgattggcagcaagtccccttttgcagtcatcacttccaccagctgattatgaaagacgggagggagatagtggttccatgtcgaaatcaggatgagctagtgggacgtgccagagtctctcagggcgcaggttggagcctgcgcgagacagcctgcctcgggaagtcctacgcgcaaatgtggcagttgatgtattttcatcggagggacctgagacttgctgccaacgcaatctgttcagccgtgcctgtagattggattcccactagccgcaccacatggtctatccacgctcatcaccagtggatgactaccgaagacatgctgtccgtttggaatcgggtgtggattgaggaaaacccatggatggaggataagacgcatatcagtagctggggagacgtcccctacctcggcaaaagggaggaccaatggtgcggctcgttaatagggctgacagcccgagcaacctgggctactaatatccaggtggccattaaccaggttagacggttgatcggaaatgaaaactacctggattatatgacatccatgaagaggttcaaaaatgagtctgaccctgaaggtgcgctctggtga

SEQ ID NO: 13982 - RNA, 9879 nt, synthetic construct
  misc_feature 1..9879: note = derived and/or modified CDS sequence (opt3) from DENV-1__GU131831__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatatcctatgtgatgtgtaccggtagcttcaaactggagaaggaacttgccgagacgcagcacggaacagtcttggtgcagatcaagtacgagggcaccgacgctccttgcaaaattccattctcgactcaagatgaaaagggggttacacagaacggacgcctgatcaccgcgaatcccatagtgactgacaaagagaagcctgtaaacattgaagcagagccaccctttggcgagtcttatatcgtcatcggtgccggggaaaaagctctcaagctgtcctggttcaagaaaggctcaagtattggaaagatgtttgaggccaccgcaagaggcgccaggcggatggctatccttggggatacagcctgggacttcggaagcattggtggcgtgtttacgtccgttgggaaactggtgcatcagatattcggaaccgcatacggcgtcttgttttctggtgtgagctggactatgaagatcgggattggcgtactcctgacatggttaggactaaattcacgaagtacctccctaagcatgacatgtatcgcggtgggcctcgttactctgtaccttggggtcatggtgcaggctgattctggatgcgtgatcaactggaaaggccgcgaattgaagtgtggttcagggattttcgtcaccaatgaggttcacacgtggacagaacaatataagtttcaggccgacagtccgaaaagactgagcgcagccataggaaaggcttgggaggagggcgtgtgcggtatcaggtccgccacccggctcgaaaacattatgtggaaacagatctctaacgagctgaatcatattttactggaaaacgacatgaagttcactgtggtagtcggcgatgtggcagggatccttgctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggattcctatacgcaggtctgcgaccaccgtctgatgtcagctgcaatcaaagatagtaaggccgtgcacgctgacatggggtactggattgaatctgagaaaaatgaaacctggaagctagcccgggcatccttcatcgaggttaagacttgtatatggccaaaatcccatacactgtggtcaaacggagtgctcgaaagcgagatgatcattcccaagatctatggcggtcctatttctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagatcatacacgaatggtgttgccgcagttgtaccctccctccactgcggttcagaggtgaggacgggtgctggtatggaatggagattaggcccgtcaaagaaaaggaggaaaatcttgttaagagcatggtgtctgccggctccggtgaggtagactcatttagtctgggcttgctctgtatcagcatcatgattgaagaggtgatgcgctcgcgatggtcccggaaaatgctgatgactgggacactagctgtcttctttctgctcatcatgggacagctgacctggaacgatcttattcgtttgtgcataatggtgggcgccaatgcatctgacagaatggggatgggaacaacttacctggctttaatggccaccttcaagatgaggcctatgtttgcagttggcctcctgttccgccggcttacgagcagagaggtgctgctactcacaatcggtctgtcattggtcgccagtgtggaactgccaaactccttagaggaactcggggatggactggctatgggcattatgatccttaaactgttgaccgactttcaatctcatcagctctgggcgactctgctaagcctgaccttcattaagacaactttttcccttcactatgcctggaaaaccatggcaatgatcctctcaatagttagcctgttccccttgtgtctgagtacgacatctcagaagaccacttggttaccggtgctcctgggctcccttgggtgcaagcctctgacaatgtttttgatcgctgagaataaaatttggggaaggcgaagctggccactcaacgaaggtatcatggccgtcggcattgtatcgatcctgctatcatctctgcttaagaacgatgtgcccctcgccgggcctctgatagctggaggcatgttgattgcatgttacgttatcagtggttccagcgccgacttatctctggagaaagcggctgaggtgagctgggaagaggaagccgagcattccggggcatcacacaatatcctcgtcgaagtgcaggatgacggaaccatgaagattaaagatgaggagcgcgacgatactctgacaatacttctgaaggccaccttgctagctgtaagtggcgtgtatcccctgagcatcccagcaacactcttcgtctggtacttctggcagaagaagaagcagcggtctggcgttctgtgggacactccttcacccccagaagtggagagagccgtgcttgatgacgggatttataggatcatgcagcgtggattactgggtcgcagccaggtcggcgtgggggtttttcaagaaaacgtattccataccatgtggcacgtgacacggggagcggtcctcatgtaccagggcaaaagattggagccgagttgggctagcgtgaagaaagacctgatttcctacggtgggggatggaggctccagggctcttggaataccggcgaggaagttcaggtgatcgccgtcgagcctgggaagaaccccaaaaatgtgcaaacagcaccaggaacttttaagacccccgaaggtgaggtaggcgccatagctctggatttcaagcctgggacgtcgggaagcccaatcgtcaaccgagaaggcaaaattgtgggtctttatgggaatggagttgtgacaacttcaggcacctacgtctccgccatcgcacaggctaaggccagtcaggagggccccctgcctgagattgaagacgaggtgtttcggaaacgcaacttgacaatcatggatctacacccggggtctggaaagaccagaaggtatctgccagcgatagttcgggaagccattaaacgaaagctcagaactttaatcctggcacccacccgcgtggtcgctagcgagatggccgaagctcttaagggtatgcctatcaggtaccaaacaacggcagtgaaatccgagcatactggcaaggagattgtagacctgatgtgccacgccaccttcacaatgcgtctcttgtcaccagtgcgggttcccaattataacatgatcataatggatgaagcccattttaccgacccttctagcattgctgcgagagggtacatcagtactagggtcggaatgggcgaggcagccgctattttcatgacagccaccccgcccggttccgtggaagcatttccacagagcaatgccgtgatccaggatgaggaacgcgacatacctgagcgatcttggaactcagggtatgagtggattacggatttccccggaaaaactgtctggtttgtaccatccatcaagagtggcaatgacatcgctaactgtctgaggaaaaatggcaagcgggtgattcagctcagcaggaagacattcgataccgaataccagaaaaccaagaacaacgactgggactacgttgtgactacagatatctcggagatgggggcgaatttccgcgccgaccgtgtcattgatcctagacggtgcctgaaacccgtgatacttaaggacggaccagaaagggttatcctagcaggtccgatgcctgtgaccgtcgcttctgccgcacagcgccgaggcagaattgggcggaaccacaataaagagggagatcagtatatctacatgggccagcccctgaacaatgacgaggatcatgcccactggacagaagctaagatgttgttagacaacatcaatactccagagggtattatacccgccctgtttgaacctgagagggaaaagtccgcggcaatcgatggggagtatcgcctcagaggcgaggccaggaaaacgttcgtggaactgatgcggcgtggagaccttccagtatggctgagctacaaggtggcttcagagggctttcaatatagtgatcgccgatggtgcttcgacggggaaagaaacaatcaggttctcgaggaaaacatggatgtcgagatttggaccaaagagggagaaaggaagaaattgcggccccgctggctggacgccagaacatactctgaccctctagctctgagggagtttaaggagttcgcagccggtcggcgatccgtgagcggcgatctcatccttgagattgggaaactgccgcagcacttaactcagagagctcaaaatgccttggacaacctggtgatgctccataattcagaacagggaggccgcgcatataggcacgcgatggaggagctgccagataccatcgaaacacttatgctgctcgccttgatagctgtcctgaccggtggggttactttatttttcctaagtggccggggactgggcaagacgagcatcgggctcctttgtgtgatggcctcctctgtactgttgtggatggcaagcgtggagccccattggattgctgcctccatcattctggaatttttcctcatggtcctgcttatccctgagcccgaccgtcagagaaccccacaggataaccaactcgcatacgtggttataggactgttgtttatgattctgacagtggccgctaatgagatgggtttactagaaactaccaagaaagacctgggcatcgggcacgtcgcggtagagaaccaccatcacgccgcaatgctcgatgtggaccttcatcctgcttcagcctggacactgtacgccgttgcaaccactattatcacacccatgatgaggcacacgatagaaaacaccactgctaatatctctttgacagccattgcgaaccaggctgccatcctgatgggactcgataagggctggccaattagtaaaatggacatcggtgtgcctctgcttgcattagggtgctattcgcaggtcaatccgctgaccctcaccgccgctgtgttgatgctggtcgcacattacgccataattggccccggactacaagcgaaggctacacgcgaggcccagaaacggactgcagccggcatcatgaagaacccaacggtggatgggatcgttgctattgacctggatcctgtggtatatgacgccaagttcgaaaaacagctcggacagatcatgcttctgatattgtgtaccagccaaattctgctcatgcgaacaacttgggcactgtgcgagtccatcaccttagctacaggcccccttaccactctgtgggagggttctccagggaagttttggaatacgacaattgccgtgtcaatggcgaacatcttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtataatggaggtcgaccgttccgaagcaaaagaggggctgaagaggggagagacaactaaacacgctgttagtcggggcaccgccaagttgcgctggttcgtggaacgaaatctggtcaaacctgagggtaaggtgatcgatctcggctgtgggagaggaggctggagctactattgcgccgggttaaagaaagtaacagaagtgaagggatacacgaaaggcggtcccgggcacgaggaaccgattccaatggcgacctacggatggaacctggttaaacttcattctggcaaagacgtgtttttcatccctcccgagaagtgtgatactctgctatgcgacattggcgagtcctcaccaaatcccacaatcgaagaggggaggaccctccgggtcctgaaaatggtggaaccttggttgcgcggaaaccaattttgtattaagatcctgaatccgtatatgcccagcgtcgtggagactctcgagcagatgcagagaaagcacggtggcatgcttgttaggaacccactgtcgcgaaattctacacatgaaatgtactgggtaagttgcgggaccggaaacatagtgtccgctgtcaatatgacgagccggatgttactgaaccgtttcaccatggcacacagaaaacctacatatgagcgcgatgtggacttgggcgccggtactaggcacgttgctgtggaacccgaggtcgccaacctcgatattatcgggcagcggatcgaaaatattaagcatgagcacaaatcaacctggcattacgacgaggataacccttataagacatgggcataccacggatcctatgaagtgaaaccatctggcagcgccagttccatggtaaatggcgtggttaagctgctaactaagccctgggacgtcatacctatggtgacccaaatcgctatgacagataccactccatttgggcagcagagagtgttcaaagagaaggtcgacacgcgcacacccaaagcgaagaggggaaccgcccaaattatggaagttactgcaaaatggctttggggttttctgagccgaaacaagaagccgcggatctgtaccagagaggagttcacaaggaaagtgcgctctaatgctgccattggcgcagtatttgtggacgagaaccagtggaactcagccaaggaggctgtcgaagatgagcgtttctgggacctcgtgcatcgggaaagagagctgcacaaacaggggaagtgcgccacgtgcgtttacaacatgatgggaaaaagggaaaagaagttgggcgagtttggtaaagcgaaggggagtcgcgcaatctggtacatgtggctgggagcccgattcctcgagttcgaagctcttggctttatgaatgaggatcactggttctcccgggaaaacagcctgtctggcgtggagggggagggattacataaactgggttatatattgagagacatctcgaagattcctggcgggaatatgtacgccgatgacaccgcaggatgggatactaggatcacagaagacgatctccagaacgaggctcgcattaccgacatcatggaaccagagcacgccctgctagctaaatcaatatttaaacttacttatcaaaataaagtcgtgagagtacagcggcccgccaagaacggcacagttatggatgtgattagcaggcgtgaccagcgaggttccgggcaggtcggaacctacggcctgaatacattcactaacatggaagcacaactcatccgccagatggagagtgagggcatcttttctcctagcgaactggagaccccaaacttggcggaaagagtgttagattggctggagaagtatggggtggaacggctcaaaaggatggccatttccggagacgactgtgtcgttaagcccatagatgaccgcttcgctacggcccttaccgcactgaatgatatgggtaaagtgagaaaggacatcccgcagtgggagccttcaaaaggctggaacgattggcagcaagtacccttttgcagtcatcacttccaccagctaattatgaaggacgggcgggagatcgtggtcccatgtaggaatcaggatgaactggtgggacgagctcgtgtttctcagggcgccggttggagcctcagagagacagcatgcttggggaagtcctacgcccaaatgtggcagctgatgtattttcatcgccgggaccttaggctggcggctaacgccatttgttcagcagtgcctgtcgattggatccccactagcagaaccacatggtctatacacgcccatcaccagtggatgactaccgaagacatgctctccgtgtggaatcgcgtatggatcgaggaaaacccatggatggaggataaaacgcatattagtagctggggagacgttccctacttaggcaagcgggaggaccaatggtgcggctcgctgatcgggttgacagctagggccacctgggcaactaatattcaggtggctatcaaccaggtccgaagactgattggaaatgaaaactacctcgattatatgacatccatgaaacggttcaagaatgagtctgaccctgaaggtgccctttggtga

SEQ ID NO: 13983 - RNA, 9879 nt, synthetic construct
  misc_feature 1..9879: note = derived and/or modified CDS sequence (opt3) from DENV-1__EU482789__SS-prME
  source 1..9879: mol_type = other RNA
agcgtgaccatgctgctcatgcttatgcccaccgcactggctttccacttgactacgagaggaggggaacctcatatgatcgtcaccaagcaggaaaggggaaaatccttactgtttaagacatctgccggtgttaatatgtgcactttaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaacttctcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaaatggaggggaagattgtacagtacgaaaacctgaaatattccgtgatcgtcaccgtgcacactggagaccagcatcaagttggtaatgagtcaacggaacacggcacaaccgccactattacaccccaggcgcctacaagtgagatccagttaaccgactacggggccctgactctcgattgtagcccaaggacaggacttgacttcaacgaaatggtgctgttgacgatgaaggagaaatcttggctggtccataagcagtggtttctggatctcccgctgccctggacctccggcgcatcaactagccaagagacatggaatcggcaggaccttctggtgaccttcaaaacagctcacgccaagaagcaggaagtagttgtgttgggtagtcaagagggggctatgcacactgccctcaccggcgcaacggaaatccagacctctggaacaactaccatttttgccggccatctgaaatgccgtttaaagatggataaactgacactaaaggggatgtcctatgtcatgtgtactgggtcgttcaaactcgagaaggaagtggctgagacccagcacggtacggtcctggtgcagataaagtacgagggcacagacgcgccttgcaaaatcccattctcgacccaagatgaaaagggggttactcagaacggacgccttattacagcaaatcccatcgtgaccgacaaagagaagcctgtaaacatagaagccgagccaccctttggcgagtcttatattgtcatcggtgctggggaaaaagccttgaagctgtcctggttcaagaaaggctcaagtatcggaaagatgtttgaggcaactgccagaggcgctaggcggatggccattctcggggataccgcatgggacttcggaagcatcggtggcgtgtttacatccgttgggaaactggtgcatcagattttcggaacggcgtacggcgtcctattttctggtgtgagctggaccatgaagatagggatcggcgtactgttgacttggctcggactaaattcacgaagtacatccttaagcatgacctgtattgctgtgggcctggttacactatacctcggggtcatggtgcaggccgattctggatgcgtgatcaactggaaaggccgcgaactgaagtgtggttcagggatcttcgtcactaatgaggttcacacctggacggaacaatataagtttcaggcagacagtccgaaaagacttagcgccgctattggaaaggcctgggaggagggcgtgtgcggtataaggtccgcaacacggttggaaaacatcatgtggaaacagatttctaacgagctgaatcatatcctcctggaaaacgacatgaagttcaccgtggtagtcggcgatgtggttgggattttagctcagggcaagaagatgatccgccctcaacccatggagcacaaatactcgtggaaaagctggggcaaggccaaaataatcggggcggacgtgcagaatactacctttattatcgatggaccaaacacacctgaatgtcccgacgatcagagagcctggaatatttgggaggtcgaggactatggcttcggtatctttactaccaacatatggctgaaacttagggattcctacacacaggtgtgcgaccaccgtttgatgtcagctgcaattaaagatagtaaggccgttcatgctgacatggggtattggatcgaatctgagaaaaatgaaacgtggaagctcgcccgggcatccttcattgaggtgaagacctgtatctggccaaaatcccacactctgtggtcaaacggagtactagaaagcgagatgataatccccaagatttacggcggtcctatctctcaacataattatcgaccaggctacttcacacagaccgcggggccgtggcacctgggaaaactcgagctggattttgacctttgcgaaggcactacagtcgtggtggatgagcactgcgggaacagaggaccctccttgaggaccacgactgtcaccggcaagattatccatgaatggtgttgccgcagttgtacactgcctccattacggttcaaaggtgaggacgggtgctggtacggaatggagataagacccgttaaggaaaaggaggaaaatctcgtgaaaagcatggtatctgccggctccggtgaggtggactcatttagtctgggccttctgtgtattagcatcatgatcgaagaggtcatgaggtcgcgctggtcccgaaagatgttgatgaccgggactctcgctgtgttcctgctactgattatgggacagctcacatggaacgatctgatccggctttgcattatggttggcgccaatgcatctgaccgtatggggatgggaaccacatatttggctctgatggccacttttaaaatgagacctatgttcgcagtgggcttactctttaggcgcctgaccagccgggaggtccttctgctaacgataggtctctcactggtggccagtgttgaattgccaaactccctggaggaattaggggatggactcgctatgggcatcatgattctgaaacttctgacagacttccaatctcaccagttgtgggcgaccctcctgagcctaacttttatcaaaaccacactgtcccttcattacgcctggaagactatggcaatggtgctctcaattgtcagcctgttccccttgtgtctgagtaccacgtctcagaagacaacctggttaccggtactcctgggctcccttgggtgcaaacctctgactatgtttttgatcgctgagaataagatatggggaagaaaaagctggccactcaacgaaggtatcatggccgtgggcgttgtgtcgattctgctatcatctctgcttaagaacgatgtccccctcgccgggcctctgatcgctggaggcatgttgattgcatgttatgtgatcagtggttccagcgccgacttatctctggagaaagcggctgaggtaagctgggaagaggaagccgagcactccggggcatcacataatatactcgtggaagtccaggatgacggaacaatgaagattaaagatgaggagagggacgataccctgactatccttctgaaggccacattgctagctgttagtggcgtgtaccccctgagcatcccagcaaccctcttcgtgtggtatttttggcaaaagaaaaagcagcgatctggcgtcctgtgggacacgccttcacccccagaagtggagcgcgccgttcttgatgacgggatttaccggataatgcagagaggattactgggtaggagccaggtaggcgtgggggtcttccaagaaaacgtgttccacactatgtggcacgttacccgtggagcggtgctcatgtatcagggcaaacgcttggagccgagttgggctagcgtcaagaaagacctgatctcctacggtgggggatggcggctccagggctcttggaatacaggcgaggaagtgcaggtaattgccgtcgagcctgggaagaaccccaagaatgtgcaaaccgcaccaggaacatttaaaactcccgaaggtgaggttggcgccatcgctctggatttcaagcctgggacctcgggaagcccaattgtgaacagagaaggcaaaatcgtcggtctttacgggaatggagtggttacgacatcaggcacttatgtgtccgccatagcacaggctaaggccagtcaggagggccccctgcctgagatcgaagacgaggtctttaggaaacgaaacttgaccattatggatctacatccggggtctggaaagacacggcgctacctgccagcgatcgtgagagaagccattaagaggaaactccggaccttaatcctggcacccactcgagtagtggctagcgagatggccgaagctcttaagggtatgcctataagatatcaaaccacagcagttaaatccgagcacacgggcaaggagattgtcgacctgatgtgccatgccactttcaccatgcgcctcttgtcaccagtgagggtgcccaattacaacatgatcatcatggatgaagcccactttacagacccttctagcattgctgcgcgtgggtatatcagtacccgggtcggaatgggcgaggcagccgctatattcatgactgccacaccgcccggttccgtagaagcatttccacagagcaatgccgtgattcaggatgaggaaagagacatccctgagaggtcttggaactcagggtacgagtggattaccgatttccccggaaaaacggtttggtttgtgccatccatcaagagtggcaatgacatagctaactgtctgcgcaagaatggcaaacgagtcattcagctcagcagaaagactttcgatacagaatatcagaagaccaagaacaacgactgggactacgtggttaccactgatatctcggagatgggggcgaattttcgggccgacagggtgatcgatcctcgccgttgcctgaaacccgtcattcttaaggacggaccagaaagagtgatcctagcaggtccgatgcctgtaacagtggcttctgccgcacagcggaggggccgcattgggcgaaaccataataaggagggagatcagtacatatatatgggccagcccctgaacaatgacgaggatcacgcccactggaccgaagctaaaatgttgttagacaacatcaatacaccagagggtattatccccgccctgttcgaacctgagagagaaaagtccgcggcaatcgatggggagtaccggctcaggggcgaggcccgcaaaactttcgttgaactgatgagaaggggagaccttccagtctggctgagctataaggtggcttcagagggctttcaatacagtgatcggcgttggtgcttcgacggggaacgcaacaatcaggtgctcgaggaaaacatggatgtcgagatttggacgaaagagggagaacgaaagaaattgagacccaggtggctggacgcccggacctattctgaccctctagctctgcgcgagtttaaggagttcgcagccggtagaaggtccgttagcggcgatctcatacttgagatcgggaagctgccgcagcatttaacacagcgggctcaaaatgccttggacaacctggtgatgctccacaattcagaacagggaggccgagcatacagacatgcgatggaggagctgccagatactattgaaacccttatgctgctcgccttgatcgctgtactgacaggtggggtgaccttatttttcctaagtggccgcggactgggcaaaactagcattgggctcctttgtgtcatggcctcctctgtgctgttgtggatggcaagcgttgagccccactggatcgctgcctccataatcctggaatttttcctcatggtgctgcttattcctgagcccgacaggcagcggacgccacaggataaccaactcgcatatgtcgtaatcggactgttgtttatgattctgaccgtggccgctaatgagatgggtttactagaaacaactaagaaagacctgggcatcgggcacgttgcggtggagaaccatcaccatgccaccatgctcgatgtcgaccttcaccctgcatcagcttggacactgtacgccgtggccaccactataattacacccatgatgcgtcatacgatcgaaaacaccactgcaaatatttctttgacagctatcgccaaccaggcggctatactgatgggactcgataagggctggccaatcagtaaaatggacattggtgtccctctgcttgccttagggtgctacagccaggtgaatccgctgaccctcaccgcagccgttttgatgctggtggctcactatgcaatcattggccccggactacaagccaaggcgacaagagaggctcagaagaggactgccgcaggcatcatgaaaaacccaacggtagatgggatagtggccattgacctggatcctgtcgtttacgacgctaagttcgaaaaacagctcggacagatcatgcttctgatcttgtgtaccagccaaattctgctcatgcgcacaacttgggccctgtgcgagtccatcaccttagcaacaggcccccttaccactctgtgggagggttctccagggaagttttggaatacgacaatagctgtgtcaatggccaacattttccggggaagctatctcgcgggcgccggtctagcattttccctgatgaaaagtttgggccgagggagaaggggaaccggcgctcagggggaaactctgggagagaagtggaagcgccagctcaatcagctttctaaaagcgagttcaacatctacaagcggtcaggcattatggaggtcgacagatccgaagccaaagagggtctgaagcgtggggagaccacaaggcacgcagtgagtcggggaactgctaaattgcgctggttcgtagaacgaaatctggtgaagcctgagggcaaggttatcgatctcggttgtggcagagggggatggagctattactgcgccggcctaaagaaggtgaccgaagtcaaagggtatacaaagggaggccccggtcatgaggaaccgataccaatggccacgtacgggtggaacctggtgaaacttcactctggaaaggacgtctttttcacccctcccgagaaatgtgatactctgctatgcgacatcggcgagtcctcaccaaatcccacaattgaagagggcaggaccctccgggtgctgaagatggttgaaccttggttgcgcgggaaccaattttgtatcaagattctgaatccgtacatgcccagcgtagtggagactctcgagcagatgcagagaaaacatggaggtatgcttgtcaggaacccactgtcgcgaaattctacacacgaaatgtattgggtgagttgcggcaccgggaacatcgtttccgcggtgaatatgacgagccggatgttactgaaccgtttcaccatggctcacagaaagcctacatacgagcgcgatgtcgacttgggagcaggcactaggcatgtggccgtagaacccgaggtggctaacctcgatattatcggtcagcggatagaaaatattaaacacgagcataagtcaacctggcactatgacgaggataacccttacaaaacatgggcctatcatgggtcctacgaagttaagccatctggaagcgcaagttccatggtcaatggcgtggtgaagctgctaactaaaccctgggacgtcatccctatggttacccaaatcgccatgacagataccactccatttggccagcagagagtgttcaaggagaaagtagacacgcgcacacccaaggctaaaagggggaccgcgcaaattatggaagtgactgcccgatggctttggggatttctgagccggaacaagaagccgagaatatgtaccagggaggagttcacacgcaaagtccgttctaatgcagctatcggtgccgtgtttgttgacgagaaccagtggaactcagcaaaggaggccgtggaagatgagcggttctgggacctcgtccagaaagaaagagagctgcacaagcagggcaaatgcgctacgtgcgtgtataacatgatggggaagagggaaaagaaattgggagagtttggcaaggccaaaggtagtcgcgcgatttggtacatgtggctgggggcacgattcctcgagtttgaagcccttggattcatgaatgaggatcactggttctcccgggaaaacagcctgtctggcgtagagggcgaggggttacataagctgggatacatcttgagagacatttcgaaaatccctggtggcaatatgtatgctgatgacaccgccgggtgggatactaggataacagaagacgatctccaaaacgaggcaaagatcaccgacattatggaaccagagcacgctctgctagccacttcaatctttaaacttacataccagaataaggttgtgcgcgtccagagacccgctaagagcggaaccgtgatggatgtgatttcccggagggaccagcgtggcagtggtcaagtcgggacatatggactgaacactttcaccaatatggaagcccagctcatccgacagatggagtctgagggcatatttctgcctagcgaattggagacgccaaacttagcagaacgcgttctggattggctcgagaaatacggcgtggaaagacttaagcggatggcgatttccggggacgactgtgtagtgaaacccatcgatgacaggttcgccaccgctctgacagccctaaacgatatgggaaaggtccgcaaagacatcccgcagtgggagccttcaaagggttggaatgattggcaacaggtgcccttttgcagtcatcacttccaccagctgattatgaaggacggcagagagatagttgtgccatgtcggaaccaggatgaactcgtcgggagggcacgagtgtctcaaggagctggctggagcttgcgtgagactgcctgcctgggtaaatcctatgcacagatgtggcagcttatgtactttcatagacgcgacctgcggctcgccgcgaatgctatctgttcagccgtacctgttgattgggtgcccaccagcaggacaacttggtctattcacgcacatcaccaatggatgaccacggaagacatgttatccgtctggaacagagtgtggatcgaggaaaatccatggatggaggataagacacatgttagtagctggggagacgtgccctatctgggaaaacgcgaggaccagtggtgcggctcgttgattggcctgaccgcccgggctacttgggcctccaacatccaggtcgcaataaatcaggtgaggcgactcatcgggaacgaaaattaccttgattacatgacatctatgaagagattcaaaaacgagggagaccctgaaggtgctctgtggtga

SEQ ID NO: 13984 - RNA, 9879 nt, synthetic construct
  misc_feature 1..9879: note = derived and/or modified CDS sequence (opt3) from DENV-1__EU482790__SS-prME
  source 1..9879: mol_type = other RNA
agcgtgaccatgctgctcatgcttatgcccacagccctggctttccacttgactacgagaggaggggaacctcatatgatcgtctccaagcaggaaaggggaaaatctttactgtttaagacctcagccggtgttaacatgtgcacactgattgccatggacctcggcgagttctgtgaagatactatgacctacaaatgcccacggattacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcagcagtacctctcaagagacttggaatcggcaggaccttctggtaacatttaaaaccgcacacgctaagaagcaggaagttgtggtcttgggttcccaagagggggccatgcacacagctctcactggcgccaccgaaatccagacgagcggaaccacaactattttcgcaggccatctgaaatgccgtttaaagatggataaactgaccctaaaggggatgtcgtatgtgatgtgtacaggatctttcaaactcgagaaggaagtcgccgagactcagcacggtaccgtgctggttcagataaagtacgagggcacggacgtgccttgcaaaatcccattttccacacaagatgaaaagggggtaacccagaacggacgccttattactgctaatcccatcgtcacagacaaagagaagcctgtgaacatagaagcggagccacccttcggcgagtcatatattgttatcggtgcaggggaaaaagccttgaagctgagttggtttaagaaaggcagctccatcggaaagatgttcgaggctaccgccagaggcgcaaggcggatggccattctcggggatactgcttgggactttggatctatcggtggcgtgttcaccagcgtcgggaaactggtgcatcagatttttggaacagcctacggcgtacttttctcaggtgtgagttggacgatgaagatagggatcggcgttctgttgacctggctcggactaaattcccgaagcacttctttatcaatgacatgtattgcagtcggcctggtgaccctatacctcggggtgatggtccaggcggatagtggatgcgttatcaactggaaaggccgcgaactgaagtgtggtagcgggatctttgtgacaaatgaggtgcacacttggaccgaacaatataagttccaggctgactccccgaaaagactttctgccgcaattggaaaggcctgggaggagggcgtatgcggtataaggtcggctacgcggttggaaaacatcatgtggaaacagattagcaacgagctgaatcatatcctcctggaaaacgacatgaagttaacagtcgtggttggcgatgtggccgggattctggcacagggcaagaagatgatccgccctcaacccatggagtacaaatattcctggaagtcatggggcaaggctaaaataatcggggccgacgtccagaataccacttttattatcgatggaccaaacacccctgaatgtcccgacgatcagagagcgtggaatatttgggaggtggaggactacggcttcggtatctttacaactaacatatggcttaagttgagggatagttatacccaggtttgcgaccaccgtctcatgtctgccgctattaaagatagcaaggcagtgcacgccgacatggggtactggatcgaatccgagaaaaatgaaacatggaagctggctcgggcctcattcattgaggtaaagacgtgtatctggccaaaaagccataccctatggtctaacggagtcctggaatccgagatgataatccccaagatttatggcggtcctatcagtcaacacaattaccgaccaggctacttcactcagacagcagggccgtggcatctcggaaaactggagcttgattttgacttgtgcgaaggcaccactgtggtggtcgatgagcactgcgggaacagaggacccagcctgaggacaaccacggttactggcaagattatccacgaatggtgttgccgctcttgtaccttacctccactccggttcaaaggtgaggacgggtgctggtatggaatggagataagacccgtgaaggaaaaggaggaaaatctggtaaaatccatggtgtcagcgggcagtggtgaggtcgacagcttttcgcttggcctgttgtgtatttccatcatgatcgaagaggtgatgaggtctcgctggagccgaaagatgctcatgacagggaccctggccgttttctttctactgattatgggacagctcacttggaacgatctgatccggctttgcattatggtgggcgctaatgcctcagaccgtatggggatgggaacaacctacttggcactgatggctacattcaaaatgagacctatgtttgccgtcggcttactcttcaggcgcctgacaagtcgggaggtgcttctgctaaccataggtctctccctggttgcatctgtggaattgccaaacagcctggaggaattaggggatggactcgccatgggcatcatgattctgaaacttctgacggactttcaatcccatcagttgtgggctacactcctgtcactaaccttcatcaaaactacctttagcctgcactatgcgtggaagacaatggccatggtccttagtattgtatctctcttccccctgtgtttgtccactaccagccagaagacgacatggctgccggtgttactcggctcgctggggtgcaaacctcttaccatgtttctgatcgcagagaataagatatggggaagaaaatcatggccattgaacgaaggtatcatggctgttggcattgtgtctatcctcctgagttccctactgaagaacgatgtcccccttgccgggcctctcattgccggaggcatgctgatcgcttgttacgtgataagcggttctagcgcagacttgtccttagagaaagccgcggaggtatcatgggaagaggaagctgagcatagtggggccagccacaatattctggtggaagtccaggatgacggaactatgaagatcaaagatgaggagagggacgatacactcaccatcctgcttaaggcaactctgttggccgtttctggcgtgtatcccctatccattccagctacactgttcgtgtggtacttctggcaaaagaaaaagcagcgatcaggcgtcctctgggacacccctagtcccccagaagtggagcgcgcagttctggatgacgggatatatcggatcatgcagagaggacttttaggtaggagccaggtaggcgtgggggtctttcaagaaaacgtgttccatacgatgtggcacgttactcgtggagccgtgctgatgtaccagggcaaacgcctcgagccgtcctgggcgtctgtcaagaaagacttgatttcgtacggtgggggatggcggctgcagggcagctggaataccggcgaggaagtgcaggtaatcgctgtcgagcctgggaagaaccccaagaatgtgcaaacagccccaggaacctttaaaacatcagaaggtgaggttggcgcaattgccctcgatttcaagcccgggacttccggaagtcctatcgtgaacagagaaggcaaaatagtcggtctgtatgggaatggagtggttaccacgtctggcacatacgtgagcgctatcgcccaggcaaaggcttcccaggagggcccacttcccgagattgaagacgaggtctttaggaaacgaaacctgactatcatggatttgcaccctgggtcaggaaagacccggcgctatctaccggccattgtgagagaagcgatcaagaggaaactgcggacactcatattagccccaacccgagtagtggcatctgagatggctgaagccctgaagggtatgcccattagataccaaactaccgctgttaaaagcgagcatacaggcaaggagatcgtcgaccttatgtgccacgcaacgttcactatgcgcctgctcagtcctgtgagggtgccaaattataacatgatcattatggatgaagcccattttaccgacccctccagcatcgccgctcgtgggtacatatctacacgggtcggaatgggcgaggcggcagccattttcatgaccgctactcctccgggttcagtagaagcctttccccagtccaatgcagtgatccaggatgaggaaagagacattccagagaggagttggaacagcgggtatgagtggatcacagatttccctggaaaaaccgtttggtttgtgccctcgataaagtctggcaatgacattgccaactgtttgcgcaagaatggcaaacgagtcatccagctgtccagaaagacgttcgatactgaataccaaaagactaagaacaacgactgggactacgtggttaccaccgatatcagcgagatgggggctaatttccgggcggacagggtgattgatccacgccgttgcctcaaacctgtcatcctgaaggacggacccgaaagagtgattcttgccggtccaatgccggtaactgtggcatcagctgcccagcggaggggccgcatagggcgaaaccacaataaggagggagatcagtatatctacatgggccagcctctaaacaatgacgaggatcatgcacactggacagaagccaaaatgctgttggacaacattaatacccccgagggtatcatcccagctttatttgaacccgagagagaaaagagtgccgcgattgatggggagtatcggctgaggggcgaggcacgcaaaacattcgttgaactcatgagaaggggagacctgcctgtctggctttcttacaaggtggcctccgagggctttcaatatagcgatcggcgttggtgcttcgacggggaacgcaacaatcaggtgctggaggaaaacatggatgtcgagatatggactaaagagggagaacgaaagaaactcagaccaaggtggttggacgctcggacgtactcagaccccctggccctacgcgagtttaaggagttcgctgcaggtagaaggagtgttagcggcgatctgatcctcgagattgggaaacttcctcagcacctgacccagcgggcccaaaatgctttagacaacttggtgatgctgcataattccgaacagggaggccgagcctatagacacgcaatggaggagctcccggatacaatcgaaactctgatgcttctggcgctcattgccgtattgaccggtggggtgacactgtttttcttatctggccgcggactaggcaaaaccagcatcgggctgctctgtgtcatggcttcctcagtgcttctgtggatggcctctgttgagccacattggatagcagctagtatcattttggaatttttcctgatggtgctcctgatccccgagcctgacaggcagcggactccccaggataaccaacttgcctacgtcgtaattggactcctgtttatgatcttgacggtggcagccaatgagatgggtctgttagaaaccacaaagaaagacctaggcatagggcacgttgctgtggagaaccaccatcacgcggccatgctggatgtcgacctccatccagcatcggcttggactctttacgccgtggccaccacaattatcacccctatgatgcgtcacactattgaaaacacaacggcaaatatcagcctgaccgctatagccaaccaggcggctatcttgatgggactggataagggctggcccatttccaaaatggacatcggtgtcccactcctggcccttgggtgctattctcaggtgaatcctttaactctgacagcagccgttctcatgttggtggctcattacgcaattatcggcccgggactgcaagccaaggcgaccagagaggctcagaagaggaccgccgcaggcataatgaaaaaccccacagtagatgggattgtggccatcgacctagatccagtcgtttatgacgctaagttcgaaaaacagctgggacagatcatgctccttattctgtgtacttcacaaatcttgctgatgcgcacgacctgggccctctgcgagagcataacactggcaactggccctttaaccacactttgggagggttcccccgggaagttttggaataccactattgctgtgagtatggccaacatcttccggggatcttacctggcgggcgccggtctcgcattcagcctaatgaaatcactgggcgggggacgaagaggcacgggggctcagggagaaacattgggcgagaagtggaagaggcagctgaatcagctctccaaaagtgaatttaacacctataagcgcagcggtattatggaggtcgaccggtctgaagccaaagaggggcttaagagaggagagactaccaaacacgcagtgtcccgtggcacagctaagctgaggtggttcgtagaacggaatttggtgaagccagagggtaaagttatcgatctgggctgtgggcgcggaggctggtcatactattgcgccgggctcaagaaagtgactgaagtcaagggatacaccaaaggcggtcctgggcacgaggaacccataccgatggccacatacggatggaacttagtgaagctgtatagcggcaaagacgtctttttcatcccacctgagaagtgtgatacgcttctgtgcgacattggcgagtcgtctcccaatccaaccatcgaagaggggcgaactctaagagtgctcaagatggttgaaccctggctgaggggaaaccaattttgtattaaaatcttgaatccttacatgccgagtgtagtggagacactggagcagatgcagcggaagcatggtggcatgctcgtccgcaaccccctttccagaaatagcacccacgaaatgtattgggtgtcatgcgggactggaaacattgtttccgcggtgaatatgacatctaggatgctgttaaaccgattcaccatggctcatcggaaaccaacgtacgagcgtgatgtcgacctgggcgcaggtaccagacacgtggccgtagaacctgaggtgcccaacttggatatcatagggcagcgcattgaaaatatcaagcacgagcataaaagcacatggcactatgacgaggataacccttacaagacttgggcttatcatggaagttacgaagttaagccatccggcagcgcctcttcaatggtcaatggcgtggtgaaactcctgaccaagccctgggacgtcatccctatggttacacaaattgcaatgactgataccacaccatttgggcagcagagggtgttcaaagagaaggtagacacccggactcccaaagccaagagaggaacggctcaaataatggaagtgacagcgaagtggctatggggttttcttagtcgcaacaaaaagccgaggatctgtacccgagaggagttcactcggaaagtcagatccaatgccgcaattggcgctgtgtttgttgacgagaaccagtggaatagcgccaaggaggcagtggaagatgagaggttctgggacctggtccaccgcgaacgtgagctccataaacaggggaagtgcgcaacctgcgtgtacaacatgatgggaaagcgggagaaaaagctgggcgagtttggtaaagctaaggggtctagagccatctggtatatgtggttgggagcgaggttcctggagttcgaagcactcggctttatgaatgaggatcactggttctcgcgcgaaaactcacttagcggcgtagagggggagggactgcacaaattaggttacattctgcgagacatctccaagatacctggcgggaatatgtatgccgatgacacagctggatgggatacgcggatcaccgaagacgatttgcagaacgaggccaaaattactgacatcatggaaccagagcatgcactcctggctaagagtatttttaagctaacataccaaaataaagttgtgagagtccagaggcccgccaagaacggcaccgtgatggatgtgatctctcgcagagaccagcggggtagcgggcaggtcggaacttatggccttaatacattcaccaacatggaagctcaactgataaggcagatggagtccgagggcatattttcacctagtgaactcgagacaccaaacctggccgggcgtgttttggattggttagaaaaacacggagtggagcgactgaagcgcatggcaatctctggtgacgactgtgtagtgaaacccatcgatgacagattcgcgactgccctcaccgctcttaatgatatgggcaaggtccggaaggacattccgcagtgggaacctagcaaagggtggaacgattggcagcaagtgcccttttgctcccatcacttccaccagctgataatgaaggacggaagggagatcgttgtgccatgtcgcaatcaggatgagctagtcggcagagcccgggtgtcacagggtgcagggtggagcctgagggaaacggcttgcctcggaaaatcttacgcccaaatgtggcagttgatgtattttcatcgacgtgacctgagacttgcagccaacgcgatttgttccgctgtacctgttgattgggtgcccaccagtcgcacaacttggagcatccacgcccatcaccagtggatgaccacagaggacatgctgtcggtctggaatcgggtgtggattgaagagaacccatggatggaagataagactcatatctcctcttggggcgacgttccctacctcggcaaaagggaggaccaatggtgcgggtcattaataggactgaccgcaagagccacgtgggctacaaatatccaggtggccattaaccaggtccgccggttgatcggtaatgagaactacctggattatatgaccagcatgaagaggttcaagaatgaaagtgaccctgagggcgcactctggtga

SEQ ID NO: 13985 - RNA, 9879 nt, synthetic construct
  misc_feature 1..9879: note = derived and/or modified CDS sequence (opt3) from DENV-1__EU482791__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacggcatgaagttcaccgtggtagtcggggacgtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtaccagcattatgatcgaagaggtcatgaggtcgcgctggtcccgaaagatgctcatgactggaacactggctgtgttcctactgctcatcatgggccagctgacctggaacgaccttattcggttgtgcatcatggttggggccaatgcatctgatcgtatgggaatgggcacaacttatctggctttaatggccacctttaaaatgagacctatgttcgcagtgggtctcctgtttaggcgccttacgagccgggaggtcctgctactcacaattgggctgtcattggtggccagtgttgaactgccaaactccttagaggaactcggagacggcctggctatgggcataatgatccttaagctgttgaccgatttccaatctcaccagctctgggcgactctgctaagcctgacctttattaaaacaactctttccctccattacgcctggaagaccatggcaatggtgctgtcaatcgtcagcttgttccccctgtgtttaagtacgacatctcagaagaccacttggctcccggtactgcttgggtccctgggatgcaaacctttgacaatgtttctcattgctgagaataagatctggggtagaaaaagctggccactgaacgaaggcataatggccgtgggggttgtgtcgatcctactgtcatctcttctcaagaacgacgtccccctggccggacctttgattgctggcggtatgttaatcgcatgttatgtgattagtgggtccagcgccgatctgtctctcgagaaagcggctgaggtaagctgggaagaggaagccgagcactccggagcatcacataatatcctggtggaagtccaggacgatggcaccatgaagataaaagacgaggagagggatgacactcttacaattctgttgaaggccaccctactggctgttagtggcgtgtaccccctcagcatcccagcaacgctgttcgtgtggtatttttggcaaaagaaaaagcagcgatctggggtcctttgggatactccttcacccccagaagtggagcgcgccgttttagacgatggaatctaccggattatgcagagaggtctgctcggcaggagccaggtaggggtgggagtcttccaagaaaacgtgttccacaccatgtggcacgttacacgtggcgcggtgttgatgtatcagggtaaacgcctggagccgagttgggctagcgtcaagaaagacctcatatcctacgggggaggctggcggctgcagggctcttggaataccggggaggaagtgcaggtaatcgccgtcgagcctggaaagaaccccaagaatgtgcaaacagcaccaggtacttttaaaacccccgaaggcgaggttggggccattgctcttgacttcaagcctggaacgtcgggcagcccaatcgtgaacagagaaggtaaaattgtcgggctgtacggaaatggcgtggttacaacttcaggcacctatgtgtccgccatcgcacaggctaaggccagtcaggaggggcccttgcctgagatagaagatgaggtctttaggaaacgaaacctaacaatcatggacctgcatccgggatctggtaagacccggcgctacctcccagcgattgtgagagaagccatcaagaggaaattacggactctgattcttgcacccacccgagtagtggctagcgagatggccgaagctctgaagggcatgcctatcagatatcaaacaacggcagttaaatccgagcacactgggaaggagatagtcgatctcatgtgccatgccaccttcacaatgcgcttgctgtcaccagtgagggtgcccaattacaacatgattatcatggacgaagcccactttaccgatccttctagcatcgctgcgcgtggatatattagtactcgggtcggcatgggtgaggcagccgctatcttcatgacagccaccccgcccgggtccgtagaagcatttccacagagcaatgccgtgatacaggacgaggaaagagatattcctgagaggtcttggaactcaggatacgagtggatcacggacttccccggcaaaactgtttggtttgtgccatccattaagagtggcaatgatatcgctaactgtctccgcaagaatgggaaacgagtcatacagctgagcagaaagacattcgacaccgaatatcagaaaaccaagaacaacgattgggactacgtggttactacagacatttcggagatgggagcgaattttcgggccgatagggtgatcgaccctcgccgttgccttaaacccgtcatcctaaaggatggtccagaaagagtgattctggcaggcccgatgcctgtaaccgtggcttctgccgcacagcggagggggcgcatcggacgaaaccataataaggagggcgaccagtacatttatatgggtcagcccttgaacaatgatgaggaccacgcccactggacagaagctaaaatgttactggataacataaatactccagaggggatcattcccgccctcttcgaacctgagagagaaaagtccgcggcaatcgacggcgagtaccggctgaggggagaggcccgcaaaacgttcgttgaacttatgagaaggggcgatctgccagtctggctcagctataaggtggcttcagaggggtttcaatacagtgaccggcgttggtgcttcgatggagaacgcaacaatcaggtgttggaggaaaacatggacgtcgagatctggaccaaagagggtgaacgaaagaaactgagacccaggtggctagatgcccggacatattctgaccctctggctctccgcgagtttaaggagttcgcagccggcagaaggtccgttagcggggaccttattctggagataggaaagttaccgcagcatttgactcagcgggctcaaaatgccctggataacctcgtgatgctgcacaattcagaacagggcggtcgagcatacagacatgcgatggaggagcttccagacaccatcgaaacactgatgctcttggccctgattgctgtattaaccgggggcgtgactctatttttcctgagtggacgcggcctcgggaaaacgagcatcggacttctgtgtgtcatggcctcctctgtgttgctgtggatggcaagcgttgagccccactggattgctgcctccatcatactcgaatttttcctgatggtgcttctcatccctgagcccgataggcagcggaccccacaggacaaccaactggcatatgtcgtaattggtttgctgtttatgatcttaacagtggccgctaatgagatgggcctactggaaactaccaagaaagatctcgggattggacacgttgcggtggagaaccatcaccatgccacaatgcttgacgtcgatctgcaccctgcatcagcttggaccttgtacgccgtggccactacaatcataacgcccatgatgcgtcataccattgaaaacactacagcaaatatctctctgaccgctattgccaaccaggcggctatcctcatgggcctggacaagggttggccaataagtaaaatggatatcggggtccctcttttagccctgggctgctacagccaggtgaatccgctcaccttgacagcagccgttctgatgctagtggctcactatgcaattatcggacccggcctgcaagccaaggcgactagagaggctcagaagaggacggccgcagggattatgaaaaacccaaccgtagacggaatcgtggccatagatctcgaccctgtcgtttacgatgctaagttcgaaaaacagcttggccagattatgctgttgatcctgtgtacaagccaaatcctcctgatgcgcactacctgggccttatgcgagtccattacacttgcaaccggtcccctgactacgctctgggaggggtctccaggaaagttttggaatacaaccatcgctgtgtcaatggccaacatattccggggcagctatctagcgggtgccggcctggcattttccttgatgaaaagtctagggggaggccgaagagggactggagctcagggcgaaaccctcggtgagaagtggaagaggcagcttaatcagctgtctaaaagcgagttcaacatttacaagcgctcagggatcatggaggtcgaccggtccgaagccaaagagggattgaagagaggcgagacaactcgtcacgcagtgagtaggggtaccgctaaactgcggtggttcgtagaacgcaatctcgtgaagcctgagggcaaggttattgacttagggtgtggacgaggcgggtggagctattactgcgccggactgaaaaaggtgacagaagtcaaaggctatacgaagggtgggcccggacatgaggaaccgatcccaatggccacctacggctggaaccttgtgaaactgcactctggcaaggatgtctttttcactcctcccgagaaatgtgacacactactctgcgatataggggagtcctcaccaaatcccaccatcgaagagggaagaactctgagggtgttgaagatggttgaaccttggctgcggggtaaccaattttgtattaagatcctcaatccgtacatgcccagcgtagtggagacacttgagcagatgcagcgcaaacatggcgggatgctggtcagaaacccattatcgagaaattctacccacgaaatgtattgggtgagttgcggaacgggcaacattgtttccgcggtgaatatgaccagccgaatgctgttgaaccggttcacaatggctcaccgtaagcctacttacgagagagacgtcgatctcggtgcagggacccgccatgtggccgtagaacccgaggtggctaacctggacatcattggacagaggatcgaaaatataaaacacgagcataagtcaacatggcactatgatgaggacaacccttacaaaacttgggcctatcatggctcctacgaagttaagccatctggcagcgcaagttccatggtcaatggggtggtgaagctacttaccaaaccctgggatgtcattcctatggttacacaaatcgccatgaccgacactacgccatttggacagcagcgggtgttcaaggagaaagtagatacaagaacccccaaggctaaacgcggtactgcgcaaatcatggaagtgaccgccaggtggctgtggggctttctcagccgaaacaagaagccgcggatttgtacaagagaggagttcacgaggaaagtccgctctaatgcagctataggggccgtgtttgttgacgagaaccagtggaactcagcaaaggaggccgtggaagacgagcgtttctgggatctggtccagaaagaacgggagttgcacaagcagggaaaatgcgctacctgcgtgtataacatgatgggcaagagagaaaagaaactgggtgagtttgggaaggccaaaggaagtagggcgatctggtacatgtggctcggcgcacgcttccttgagtttgaagccctgggcttcatgaatgaggaccactggttctcccgagaaaacagcttatctggggtagagggagagggtctgcataagttgggctacattctccgggatatctcgaaaattcctgggggaaatatgtatgctgacgatactgccggctgggacacaagaatcaccgaagatgacctgcaaaacgaggcaaagataactgatatcatggaaccagagcacgctctacttgccacatcaatttttaaactgacctaccagaataaggttgtgagggtccagcgccccgctaagaacggtacagtgatggacgtgatcagcagacgggatcagagggggtccggacaagtcggcacttatggcctcaataccttcacgaacatggaagcccagctgattcgtcagatggagagtgaggggatctttttgccttctgaattagagaccccaaacctggcagaacgagttctcgactggcttgagaaatacggagtggaacgcctgaagagaatggcgataagcggtgatgactgtgtagtgaaacccattgacgatcggttcgccacagctctaactgccctgaatgacatgggcaaggtcaggaaagatatcccgcagtgggagccttccaaggggtggaacgactggcaacaggtgcccttttgctcacatcacttccaccagctcatcatgaaggatggacgcgagattgttgtgccatgtagaaatcaggacgaattggtcggccgggcaagggtgagtcaaggtgctgggtggtctctgcgagagaccgcctgccttggaaaaagctatgcacagatgtggcagctgatgtactttcatcgtagagatctccgcttagccgcgaacgctatatgttccgccgtacctgttgactgggtgcccacatcacggactacctggagcatccacgcacatcaccaatggatgacgacagaagatatgctgtctgtctggaatagggtgtggattgaggaaaacccatggatggaggacaagacccatgtttccagttggggcgatgtgccctatttgggcaaaagagaggaccagtggtgcgggagcctgatcggactcactgcccgcgctacatgggcctcgaatattcaggtcgcaatcaaccaggtgcggaggcttataggtaatgaaaactacctggactacatgacctccatgaagcgattcaaaaatgagggcgatcctgaaggggctctatggtga

SEQ ID NO: 13986 - RNA, 9879 nt, synthetic construct
  misc_feature 1..9879: note = derived and/or modified CDS sequence (opt3) from DENV-1__EU482792__SS-prME
  source 1..9879: mol_type = other RNA
tccgtgaccatgctgctcatgcttatgcccacggccctggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgagactgaaccggacgatgtggactgttggtgcaatgcgacagatacctgggtaacgtatgggacttgttcacaaaccggagagcaccgccgagacaagcgtagtgtggctcttgcaccccatgtcggcctgggtttggagacaagaactgaaacctggatgagctccgagggggcatggaaacagatccagagggtggaaacatgggccctccggcaccctggattcaccgttattgctctgtttctggcccatgccatcggcacgtctattactcagaagggcatcatattcatcctcttaatgctggtgacaccatcgatggctatgcgctgcgtcgggattggatcaagagattttgtggagggtcttagcggcgccacctgggtagacgttgtgttggagcacgggagttgtgtcactacaatggcgaaggataaacccaccctggacatcgaactactcaagacggaggtgaccaaccctgcagtgctgaggaaactttgcattgaagccaagatctccaatacaactaccgattctcggtgtccaacacaaggagaggctactctgatggaagaacaagacgccaacttcgtctgccgccgaacctttgttgatagaggctggggtaatgggtgtggattgttcggcaaaggcagcctcataacatgcgcaaagtttaagtgcgtgaccaaactggaggggaagattgtacagtacgaaaacttaaaatattccgtgatcgtcactgtgcacacgggagaccagcatcaagttggtaatgagtcaacagaacacggcaccactgctaccattacaccccaggcccctaccagtgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtcatgtgtaccggatcgttcaaactggagaaggaagtggccgagacgcagcacggtacagtccttgtgcagataaagtacgagggcaccgacgctccttgcaaaatcccattctcgactcaagatgaaaagggggttacacagaacggacgcttgattaccgcgaatcccatcgtgactgacaaagagaagcctgtaaacatagaagcagagccaccctttggcgagtcttatattgtcatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtgtttacgtccgttgggaaacttgtgcatcagattttcggaaccgcatacggcgtcctgttttctggtgtgagctggactatgaagatagggatcggcgtattgctcacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatcttcgtcaccaatgaggttcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtggtagtcggcgatgtggttgggattctggcacagggcaaaaagatgatccgccctcaacccatggagcacaaatactcgtggaaaagctggggcaaggctaagataatcggggccgacgtgcagaataccacatttattatcgatggaccaaacactcctgaatgtcccgacgatcagagagcgtggaatatttgggaggtcgaggactatggcttcggtatctttaccacaaacatatggcttaagttgagggattcctacacacaggtgtgcgaccaccgtctcatgtcagccgctattaaagatagtaaggcagttcatgccgacatggggtattggatcgaatctgagaaaaatgaaacctggaagctggctcgggccagcttcattgaggtgaagacttgtatctggccaaaatcccacacactatggtcaaacggagtactggaaagcgagatgataatccccaagatttacggcggtcctatctctcaacataattatcgaccaggctacttcacccagactgcagggccgtggcacctcggaaaactggagcttgattttgacttgtgcgaaggcacaaccgtcgtggtggatgagcactgcgggaacagaggaccctccctgaggacgactaccgtcacaggcaagattatccatgaatggtgttgccgcagttgtaccttacctccactccggttcaaaggtgaggacgggtgctggtacggaatggagataagacccgttaaggaaaaggaggaaaatctggtgaaaagcatggtatctgcgggctccggtgaggtggactcatttagtcttggcctgttgtgtattagcatcatgatcgaagaggtcatgaggtcgcgctggtcccgaaagatgctcatgactgggacactggccgtgttcctactgctcattatgggacagctgacctggaacgatcttatccggttgtgcattatggttggcgctaatgcctctgaccgtatggggatgggaacaacttatctggcattaatggctacctttaaaatgagacctatgttcgccgtgggcctcctgtttaggcgccttacgagccgggaggtcctgctactcacaataggtctgtcattggtggcaagtgttgaactgccaaactccttagaggaactcggggatggactggccatgggcatcatgattcttaagctgttgaccgacttccaatctcaccagctctgggctactctgctaagcctgacctttatcaaaacaactctttccctccattacgcgtggaagaccatggccatggtgctgtcaattgtcagcttgttccccctgtgtttaagtacgacatctcagaagaccacttggctcccggtactgcttggctccctggggtgcaaacctttgacaatgtttctcatcgcagagaataagatatggggaagaaaaagctggccactgaacgaaggtatcatggctgtgggcgttgtgtcgattctactgtcatctcttctcaagaacgatgtccccctggccgggcctttgatcgccggaggcatgttaattgcttgttatgtgatcagtggttccagcgcagacctgtctctcgagaaagccgcggaggtaagctgggaagaggaagctgagcactccggggcctcacataatatactggtggaagtccaggatgacggaaccatgaagattaaagatgaggagagggacgatactcttacaatcctgttgaaggcaaccctactggccgttagtggcgtgtaccccctcagcatcccagctacgctgttcgtgtggtatttttggcaaaagaaaaagcagcgatctggcgtcctttgggacactccttcacccccagaagtggagcgcgcagttttagatgacgggatttaccggataatgcagagaggactgctcggtaggagccaggtaggcgtgggggtcttccaagaaaacgtgttccacaccatgtggcacgttacacgtggagccgtgttgatgtatcagggcaaacgcctggagccgagttgggcgagcgtcaagaaagacctcatctcctacggtgggggatggcggctgcagggctcttggaataccggcgaggaagtgcaggtaattgctgtcgagcctgggaagaaccccaagaatgtgcaaacagccccaggaacttttaaaacccccgaaggtgaggttggcgcaatcgcccttgatttcaagcctgggacgtcgggaagcccaattgtgaacagagaaggcaaaatcgtcggtctgtacgggaatggagtggttacaacttcaggcacctatgtgtccgctatagcccaggcaaaggctagtcaggagggccccttgcctgagatcgaagacgaggtctttaggaaacgaaacctaacaattatggatctgcatccggggtctggaaagacccggcgctacctcccagccatcgtgagagaagcgattaagaggaaattacggactctgatccttgcccccacccgagtagtggcaagcgagatggctgaagccctgaagggtatgcctataagatatcaaacaacggctgttaaatccgagcacactggcaaggagattgtcgacctcatgtgccatgcaaccttcacaatgcgcttgctgtcaccagtgagggtgcccaattacaacatgatcatcatggatgaagcccactttaccgacccttctagcattgccgctcgtgggtatatcagtactcgggtcggaatgggcgaggcggcagccatattcatgacagctaccccgcccggttccgtagaagcctttccacagagcaatgcagtgattcaggatgaggaaagagacatccctgagaggtcttggaactcagggtacgagtggattacggatttccccggaaaaactgtttggtttgtgccatccatcaagagtggcaatgacatagccaactgtctccgcaagaatggcaaacgagtcattcagctgagcagaaagacattcgataccgaatatcagaaaaccaagaacaacgactgggactacgtggttactacagatatctcggagatgggggctaattttcgggcggacagggtgatcgatcctcgccgttgccttaaacccgtcattctaaaggacggaccagaaagagtgatcctggccggtccgatgcctgtaaccgtggcatctgctgcccagcggaggggccgcattgggcgaaaccataataaggagggagatcagtacatatatatgggccagcccttgaacaatgacgaggatcacgcacactggacagaagccaaaatgttactggacaacatcaatactccagagggtattatccccgctctcttcgaacctgagagagaaaagtccgccgcgatcgatggggagtaccggctgaggggcgaggcacgcaaaacgttcgttgaacttatgagaaggggagacctgccagtctggctcagctataaggtggcctcagagggctttcaatacagtgatcggcgttggtgcttcgacggggaacgcaacaatcaggtgttggaggaaaacatggatgtcgagatttggaccaaagagggagaacgaaagaaactgagacccaggtggctagacgctcggacatattctgaccctctggccctccgcgagtttaaggagttcgctgcaggtagaaggtccgttagcggcgatcttatactggagatcgggaagttaccgcagcatttgactcagcgggcccaaaatgctctggacaacctcgtgatgctgcacaattcagaacagggaggccgagcctacagacatgcaatggaggagcttccagataccattgaaacactgatgctcttggcgctgatcgccgtattaaccggtggggtgactctatttttcctgagtggccgcggactcggcaaaacgagcattgggcttctgtgtgtcatggcttcctctgtgttgctgtggatggccagcgttgagccccactggatcgcagcttccataatcctcgaatttttcctgatggtgcttctcattcctgagcccgacaggcagcggaccccacaggataaccaactggcctatgtcgtaatcggattgctgtttatgattttaacagtggcagccaatgagatgggtctactggaaactaccaagaaagacctcggcatcgggcacgttgctgtggagaaccatcaccatgcgacaatgcttgatgtcgacctgcaccctgcctcagcatggaccttgtacgctgtggccactacaataattacgcccatgatgcgtcataccatcgaaaacactacagccaatatttctctgaccgcaatcgctaaccaggccgcgatactcatgggactggataagggctggccaatcagtaaaatggacattggtgtccctcttttagctctggggtgctacagccaggtgaatccgctcaccttgacagccgcagttctgatgctagtggcccactatgctatcattggccccggactgcaagcaaaggccactagagaggcgcagaagaggacggctgccggcatcatgaaaaacccaaccgtagatgggatagtggcaattgacctcgatcctgtcgtttacgacgccaagttcgaaaaacagcttggacagatcatgctgttgatcctgtgtacaagccaaattctcctgatgcgcactacctgggctttatgcgagtccatcacacttgccaccggccccctgactacgctctgggagggttctccagggaagttttggaatacaaccatagcagtgtcaatggctaacattttccggggaagctatctagccggcgcgggtctggccttttccttgatgaaaagtctgggcgggggacgaagaggcactggggcacagggagaaaccctcggcgagaagtggaagaggcagcttaatcagctgtctaaaagcgagttcaacatctacaagcgctcaggtattatggaggtcgaccggtccgaagctaaagaggggttgaagagaggagagacaactcgtcacgccgtgagtaggggcaccgcaaaactgcggtggttcgtagaacgcaatctcgtgaagcctgagggtaaggttatcgatttaggctgtgggcgaggaggctggagctattactgcgctgggctgaaaaaggtgacagaagtcaaaggatatacgaagggcggtcccgggcatgaggaaccgataccaatggccacctacggatggaaccttgtgaaactgcactctggcaaggacgtctttttcactcctcccgagaaatgtgatacactactctgcgacatcggcgagtcctcaccaaatcccaccattgaagaggggagaactctgagggtgttgaagatggttgaaccttggctgcggggaaaccaattttgtatcaagattctcaatccgtacatgcccagcgtagtggagacacttgagcagatgcagcgcaaatatggtggcatgctggtcagaaacccattatcgagaaattctacccatgaaatgtactgggtgagttgcgggacgggaaacatcgtttccgccgtgaatatgaccagccgaatgctgttgaaccggttcacaatggcgcaccgtaagcctacttatgagagagatgtcgacctcggcgctggtacccgccacgtggcagtagaacccgaggtggccaacctggatattatcgggcagaggatagaaaatattaaacatgagcacaagtcaacatggcattacgacgaggataacccttataaaacttgggcttaccacggatcctatgaagttaagccatctggcagcgccagttccatggtcaatggcgtggtgaagctacttaccaaaccctgggacgtcatccctatggttacacaaatcgcaatgaccgatactacgccatttgggcagcagcgggtgttcaaggagaaagtagacacaagaacccccaaggccaaacgcggaactgctcaaattatggaagtgaccgcgaggtggctgtggggttttctcagccgaaacaagaagccgcggatatgtacaagagaggagttcacgaggaaagtccgctctaatgccgcaatcggcgctgtgtttgttgacgagaaccagtggaactcagccaaggaggcagtggaagatgagcgtttctgggacctggtccagaaagaacgggagttgcataagcaggggaaatgcgcaacctgcgtgtacaacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgtagagggggagggactgcacaagttgggttatatcctccgggacatttcgaaaatccctggcgggaatatgtacgccgatgacactgctggatgggatacaagaataaccgaagacgatctgcaaaacgaggccaagatcactgacattatggaaccagagcatgcactacttgctacatcaatctttaaactgacctatcagaataaggttgtgagggtccagcgccccgccaagaacggcacagtgatggatgtgattagcagacgggaccagaggggttccgggcaagtcggaacttacggcctcaataccttcacgaacatggaagctcagctgatccgtcagatggagagtgagggcatatttttgccttctgaattagagaccccaaacctggccgaacgagttctcgattggcttgagaaatatggggtggaacgcctgaagagaatggcaattagcggagacgactgtgtagtgaaacccatcgatgaccggttcgcgacagccctaactgctctgaatgatatgggtaaggtcaggaaagacatcccgcagtgggagccttccaagggctggaacgattggcaacaggtgcccttttgctcacaccatttccaccagctcattatgaaggacgggcgcgagatagttgtgccatgtagaaatcaggatgaattggtcggacgggccagggtgagtcaaggcgcaggttggtctctgcgagagaccgcttgccttgggaaaagctacgcccagatgtggcagctgatgtattttcaccgtagagacctccgcttagcagccaacgcgatctgttccgctgtacctgttgattgggtgcccacatcacggactacctggagcattcatgcccaccatcaatggatgacgacagaagacatgctgtctgtctggaatagggtgtggatcgaggaaaacccatggatggaggataagacccacgtttccagttggggagacgtgccctacttgggcaaaagagaggaccagtggtgcggcagcctgattgggctcactgcacgcgccacatgggcttcgaatatccaggtcgccataaaccaggtgcggaggcttatcggaaatgaaaactacctggattatatgacctccatgaagcgattcaaaaatgagggtgaccctgaaggcgcactatggtga

SEQ ID NO: 13987 - RNA, 9879 nt, synthetic construct
  misc_feature 1..9879: note = derived and/or modified CDS sequence (opt3) from DENV-1__EU482707__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccaaactccttagaggaactcggagatggcctggcgatgggcatcatgattcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccctgagcattccagccaccctctttgtttggtacttctggcaaaagaagaaacagcgctctggggtgctgtgggacacgccttcacccccagaagtggagcgggcggtccttgatgacggaatatatagaatcatgcagaggggtttactgggccgtagccaggtgggggttggagtattccaagaaaacgtgtttcatactatgtggcacgtcacccgcggcgctgtgctcatgtaccagggtaagcggttggagccgagttgggccagcgttaaaaaggacctgatttcctacgggggaggctggagactcaggggctcttggaatacaggggaggaagtgcaggtcatcgcagtggagcctggcaaaaatcccaagaatgtacagaccgccccaggtacattcaagactcccgaaggcgaggtcggggctattgccctggattttaaacctggaacctcgggcagcccaatcgtgaaccgagaaggtaagatagttgggctttatggaaatggcgtggtcacgacatcaggcacttacgtgtccgcaatcgctcaagccaaagcgagtcaggaggggcccctgcctgagattgaagacgaggttttccggaagcgcaacttgaccatcatggatctacacccgggatctggtaaaacaagaaggtatctgccagccattgtgcgggaagcaatcaagcgaaagctcagaaccttaatactggctcccactcgcgtcgtggccagcgagatggctgaagcacttaaaggcatgcctattaggtaccagaccacagccgtaaagtccgagcatacggggaaagagatcgtggacctgatgtgccacgccacttttaccatgcgtctcttgtcaccagttcgggtccccaattataacatgatcattatggatgaagctcatttcacagacccttctagcatcgcggcaagaggatacataagtaccagggtgggcatgggtgaggccgctgccatttttatgactgcaacaccgcccgggtccgtggaagccttcccacaaagcaatgctgtcatccaggatgaggaacgcgacattcctgagcgatcttggaactcaggatatgagtggatcaccgattttcccggcaagacggtatggttcgtgccatccataaaaagtggcaatgacattgcgaactgtctgagaaagaatgggaagcgggttatccagctcagcaggaaaacttttgatacagaataccagaagaccaaaaacaacgactgggactacgtggtcaccactgatatctcggagatgggagccaatttccgcgcagaccgtgtgattgatcctagacggtgcctgaagcccgttatccttaaagacggtccagaaagggtgattctagctggcccgatgcctgtcacagtggcctctgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggaaaaatccgcagccgtagatggcgagtatcgcctcagaggagaggctaggaagacttttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatttggacgaaggagggtgaaaggaaaaagttgcggccccgctggctggacgctagaacctactctgaccctctagcactgagggagttcaaagaatttgccgctggccggcgatccgtcagcggggatctcatacttgagatcggaaagctgccgcagcacttaacacagagagcccagaatgcattggacaacctggttatgctccataattcagaacaaggcggtcgcgcgtataggcacgccatggaggagctgccagatactattgaaacccttatgctgctcgctttgatcgccgtgctgacagggggcgtaaccttattctttctaagtggacggggcctggggaagactagcattggactcctttgtgtgatggcatcctctgtcctgttgtggatggctagcgtggagccccattggatcgccgcatccataatcctggagttctttctcatggttctgcttattcctgagcccgaccgtcagagaacgccacaggataaccagctcgcctacgtggtcatcggtctgttgttcatgattctgaccgtagctgcgaatgagatgggcttactagaaacaactaaaaaggacctggggatcggacacgtggccgttgagaaccaccatcacgcagctatgctcgatgtggaccttcatcctgcctcagcctggaccctgtacgcagtcgctacaaccataattactcccatgatgaggcacacaatcgaaaacacgaccgccaatatttctttgactgcgatcgctaaccaagccgcaatactgatgggcctcgataaaggttggccaatcagtaagatggacattggggtgcctctgcttgccttaggctgctattcgcaggtcaatccgctgacactcaccgctgcagtgttgatgctggttgcccattacgcgatcattggacccggcctacaggctaaagccacccgcgaggcacaaaagcggacagccgctgggatcatgaagaacccaactgtggatggaatagtagccattgacctggatcctgtggtctatgacgcaaaatttgaaaagcagctcggccagatcatgcttctgatcttgtgtacgagccagattctgctcatgcgaaccacatgggctctgtgcgagtccatcactttagccaccggtccccttacaaccctgtgggaggggtctccaggaaaattctggaatactacgatagcggtttcaatggccaacatttttagaggcagctacctcgcaggagctggcctagccttctccctgatgaagagtctagggggaggcaggcgcgggacaggagcacaaggcgaaaccctgggtgagaaatggaagcggcagctcaatcagctttctaagagcgagttcaacacttataaaagatcagggatcatggaggtggaccgttccgaagctaaggagggactgaaaaggggcgagaccacaaagcacgccgtcagtcggggtactgccaaattgcgctggtttgtggaacgaaatctggtaaagcctgagggcaaggtgattgatctcgggtgtggaagaggcgggtggagctactattgcgcgggactaaagaaggttaccgaagtgaaaggctacacaaagggtgggcccggacacgaggaaccgatcccaatggctacgtacggctggaacctggtcaaacttcattctggcaaggacgtgttctttatacctcccgagaaatgtgataccctgctatgcgacatcggggagtcctcaccaaatcccactattgaagagggaaggacactccgggtcctgaagatggtggaaccttggttgcgcggtaaccagttctgtatcaagattctgaatccgtatatgcccagcgttgtagaggcactcgagcaaatgcagagaaaacacggcgggatgcttgtgaggaacccactgtcgcgaaattctacccatgaaatgtactgggtcagttgcggaactggcaacatcgtgtccgccgttaatatgacaagccggatgttactgaaccgttttaccatggctcacagaaagcctacgtatgagcgcgatgtggacttgggtaccgggacaaggcacgtcgccgtggaacccgaggtagcaaacctcgatattatcggacagcggatagaaaatattaaacatgagcacaagtcaacttggcattacgacgaggataacccttataaaacctgggcctaccacggctcctatgaagtgaagccatctggcagcgctagttccatggttaatggggtcgtgaagctgctaacaaaaccctgggacgtgatccctatggtcactcagatcgcgatgaccgatacaaccccattcggacaacagagagtttttaaggagaaagtggacactcgcacgcccaaggccaaaaggggtacagcacagattatggaagtaaccgctcgatggctttggggcttcctgagccggaacaagaagccgagaatatgtactagggaggaatttacccgcaaagtgcgttctaatgccgcaatcggggccgtcttcgtggacgagaaccaatggaactcagctaaggaggccgttgaagatgagcggttttgggacctcgtgcatagagaaagggagctgcacaaacagggaaagtgcgcgacatgcgtctacaacatgatgggcaaacgcgaaaagaagttgggtgagttcgggaaagcaaagggaagtcgagccatttggtacatgtggctgggcgctcggtttctcgagttcgaagcccttggcttcatgaatgaggatcactggttttccagagaaaacagcctgtctggggtggagggagagggtttacataaactgggctatatcttgagggacatttcgaagatccctgggggaaatatgtacgcagatgacacggctggctgggatacccgcataactgaagacgatctccagaacgaggccaaaatcacagacattatggaaccagagcacgctctgctagccaaggcaatcttcaaacttacctatcagaataaggtagttagagtgcaacggcccgcgaagaacggtactgtcatggatgtgatttcaaggcgtgaccagcgagggagcggacaggtgggcacatacggcctgaatacctttacaaacatggaagcccagctcatccgccaaatggagtccgaggggatattcagtccttctgaactggagactccaaacttggctgaaagagccttagattggctggagaaatatggagtcgaacggctcaagaggatggcaattagcggtgacgactgtgttgtgaaacccatcgatgaccgctttgctaccgcccttacggcactgaatgatatgggcaaggtaagaaaagacatcccgcagtgggagccttccaaggggtggaacgattggcaacaggtgcccttctgctcacatcactttcaccaactaattatgaaggacggacgggagatagtcgtgccatgtaggaatcaggatgaactggttggccgagcccgtgtgagtcagggtgcggggtggtctctcagagagaccgcttgcttgggaaaaagctacgcccagatgtggcaactgatgtatttccatcgccgggaccttaggctggcagccaacgctatctgttccgccgtccctgtggattgggtacccacatcaagaactacctggagcattcacgcacatcaccagtggatgacaactgaagacatgctctctgtttggaatcgcgtgtggatcgaggaaaacccatggatggaggataagacccatatttccagttgggaggacgtcccctacttaggcaaacgggaagaccagtggtgcggcagcctgatcgggttgacggctagggccacatgggcgaccaatatacaagtggctatcaaccaggttcgaagactgattggaaatgagaactacctcgattatatgacttcgatgaagcggtttaaaaatgaatccgaccctgagggtgccctttggtga

SEQ ID NO: 13988 - RNA, 9879 nt, synthetic construct
  misc_feature 1..9879: note = derived and/or modified CDS sequence (opt3) from DENV-1__EU482708__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaacatgtgcacactaattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgagagagccgtgctggatgacgggatatataggatcatgcagcgtggacttttaggtcgcagccaggttggcgtaggggtgtttcaagaaaacgtcttccataccatgtggcacgtgacacggggagcggttctgatgtaccagggcaaaagactcgagccgagttgggctagcgtgaagaaagacttgatttcctacggtgggggatggaggctgcagggctcttggaataccggcgaggaagtccaggtgatcgccgtagagcctgggaagaaccccaaaaatgtccaaacagcaccaggaacttttaagacccccgaaggtgaggtgggcgccattgctctcgatttcaagcctgggacgtcgggaagcccaatcgttaaccgagaaggcaaaatagtgggtctgtatgggaatggagtcgtgacaacttcaggcacctacgtttccgccatcgcacaggctaaggccagtcaggagggcccccttcctgagattgaagacgaggtgtttcggaaacgcaacctgacaatcatggatttgcacccggggtctggaaagaccagaaggtatctaccagcgattgtccgggaagccatcaaacgaaagctgagaactctcatattagcacccacccgcgtggtagctagcgagatggccgaagctctgaagggtatgcctattaggtaccaaacaacggcagtgaaatccgagcatactggcaaggagatcgttgaccttatgtgccacgccaccttcacaatgcgtctgctctcaccagtccgggtgcccaattataacatgatcattatggatgaagcccattttaccgacccttctagcatcgctgcgagagggtacataagtactagggtgggaatgggcgaggcagccgctattttcatgacagccaccccgcccggttccgtcgaagcatttccacagagcaatgccgtaatccaggatgaggaacgcgacattcctgagcgatcttggaactcagggtatgagtggatcacggatttccccggaaaaactgtgtggtttgttccatccataaagagtggcaatgacattgctaactgtttgaggaaaaatggcaagcgggtgatccagctgagcaggaagacattcgataccgaataccagaaaaccaagaacaacgactgggactacgtcgtgactacagatatctcggagatgggggcgaatttccgcgccgaccgtgttattgatcctagacggtgcctcaaacccgtgatcctgaaggacggaccagaaagggtcattcttgcaggtccgatgcctgtgaccgtagcttctgccgcacagcgccgaggcagaatagggcggaaccacaataaagagggagatcagtatatctacatgggccagcccctaaacaatgacgaggatcatgcccactggacagaagctaagatgctgttggacaacattaatactccagagggtatcatccccgccttatttgaacctgagagggaaaagtccgcggcaattgatggggagtatcgcctgagaggcgaggccaggaaaacgttcgtggaactcatgcggcgtggagacctgccagtttggcttagctacaaggtcgcttcagagggctttcaatatagtgatcgccgatggtgcttcgacggggaaagaaacaatcaggtgctggaggaaaacatggatgtggagatatggaccaaagagggagaaaggaagaaactccggccccgctggttggacgccagaacatactctgaccctctggctctaagggagtttaaggagttcgcagccggtcggcgatccgtcagcggcgatctgatctcagagattgggaaactcccgcagcaccttactcagagagctcaaaatgccctggacaacttagttatgttgcataatagtgaacagggaggccgcgcatataggcacgcgatggaggagctgccagataccatcgaaacactcatgctgcttgccctgattgctgtgctcaccggtggggtaactttgtttttcctgagcggccggggattaggcaagacgtccatcgggctactgtgtgtgatggcctctagcgtcctcctttggatggcatccgtggagccccattggatagctgcctcaatcattctggaatttttcttgatggttctgctcatccctgagcccgaccgtcagagaaccccacaggataaccaactggcatacgtggtcattggacttctctttatgatcctgacagtagccgctaatgagatgggtttgctggaaactaccaagaaagacttaggcatagggcacgtggcggttgagaaccaccatcacgccgcaatgctagatgtggacctgcatcctgcttctgcctggacactctacgccgtcgcaaccactattatcacacccatgatgaggcacacgattgaaaacaccactgctaatatcagtcttacagccatagcgaaccaggctgccatcctgatgggattggataagggctggccaatttcgaaaatggacatcggtgtgcctctgctcgcactggggtgctatagccaggtcaatccgcttaccttaaccgccgctgtgctgatgctcgttgcacattacgccattatcggccccggattgcaagcgaaggctacacgcgaggcccagaaacggactgcagccggcataatgaagaacccaacggtggatgggattgtagctatcgacctggatcctgtggtctatgacgccaagttcgaaaaacagctaggacagatcatgctgctcattctttgtacctcccaaatcctgttgatgcgaacaacttgggcactgtgcgagtctataaccctcgctacaggccccctgaccactttatgggagggttcaccagggaagttttggaatacgacaattgccgttagcatggcgaacatcttcagaggatcctaccttgccggcgcaggtctggctttcagtctcatgaaatctctaggcgggggaaggcgcggcaccggggcccagggagaaactctgggcgagaagtggaaacggcagttgaatcagctgagcaagtcagaatttaacacctataagagatccggtattatggaggtggaccgtagtgaagcaaaagaggggctcaagaggggagagacaactaaacacgctgtcagccggggcaccgccaaacttcgctggttcgtggaacgaaatctggtaaaacctgagggtaaggtgatcgatttgggctgtgggagaggaggctggtcttactattgcgccgggctgaagaaagttacagaagtgaagggatacacgaaaggcggtcccgggcacgaggaaccgataccaatggcgacctacggatggaacctcgtcaagttacattccggcaaagacgtgtttttcatccctcccgagaagtgtgatactctgctttgcgacattggcgagtcaagcccaaatcccacaatcgaagaggggaggaccctgcgggtcctaaaaatggtggaaccttggctccgcggaaaccaattttgtattaagatcctgaatccgtatatgccctcggttgtagagactttggagcagatgcagagaaagcacggtggcatgctggtgaggaacccactctctcgaaatagtacacatgaaatgtactgggtctcctgcgggaccggaaacattgtgagcgctgttaatatgacgtcacggatgcttctgaaccgtttcaccatggcacacagaaaacctacatatgagcgcgatgtggacttaggcgccggtactaggcacgtcgctgtggaacccgaggtagccaacctggatatcatagggcagcggattgaaaatatcaagcatgagcacaaatccacctggcattacgacgaggataacccttataagacatgggcataccacggatcttatgaagtgaaaccaagcggcagtgcctccagcatggttaatggcgtcgtgaagttgctcactaagccctgggacgtgatccctatggtcacccaaattgctatgacagataccactccatttgggcagcagagagttttcaaagagaaggtggacacgcgcacacccaaagcgaagaggggaaccgcccaaataatggaagtaactgcaaaatggctgtggggttttctatctcgaaacaagaagccgcggatctgtaccagagaggagttcacaaggaaagtgcgctcaaatgctgccattggcgcagtctttgtggacgagaaccagtggaatagtgccaaggaggctgttgaagatgagcgtttctgggaccttgtgcatcgggaaagagagctgcacaaacaggggaagtgcgccacgtgcgtctacaacatgatgggaaaaagggaaaagaagctcggcgagtttggtaaagcgaaggggtcccgcgcaatctggtacatgtggctgggagcccgattcttggagttcgaagctctgggctttatgaatgaggatcactggttcagccgggaaaactctctctcgggcgtggagggggagggacttcataaactgggttatattttaagagacatctcaaagatacctggcgggaatatgtacgccgatgacaccgcaggatgggatactaggatcacagaagacgatctgcagaacgaggctcgcattaccgacatcatggaaccagagcacgccttgctcgctagaagcatttttaaactgacttatcaaaataaggtagttcgggtgcagaggcccgccaaaaacggcacagtcatggatgtgatctcccgtcgagaccagcgcggtagtggacaggtgggaacctacggcctaaatacattcactaacatggaagcacaacttataagacagatggagtctgagggcatttttagcccttccgaactggagaccccaaacctcgcggaacgggtcctggattggttggagaagtatggggttgaaaggttaaagcgcatggccatctcaggagacgactgtgtggtaaaacccatcgatgacagattcgctacggccctgaccgcactcaatgatatgggtaaggtgcggaaagacattccgcagtgggagcctagtaagggctggaacgattggcagcaagtccccttttgctctcatcacttccaccagcttataatgaaagacgggagggagatcgtggttccatgtcgaaatcaggatgaactggtgggacgtgctagagtcagccagggcgccggttggtccctacgcgagacagcatgcctggggaagtcatacgcccaaatgtggcagctcatgtattttcatcggagggacttgagactggcggctaacgccatttgtagcgcagtgcctgtagattggatccccacttctcgcaccacatggtccattcacgcccatcaccagtggatgactaccgaagacatgcttagtgtttggaatcgggtgtggatcgaggaaaacccatggatggaggataagacgcatataagctcgtggggagacgtcccctacctgggcaaaagggaggaccaatggtgcggctccctcatcgggttaacagctcgagccacctgggcaactaatattcaggtggctatcaaccaggttagacggctgattggaaatgaaaactacttggattatatgacatctatgaagaggttcaaaaatgagtcagaccctgaaggtgccctgtggtga

SEQ ID NO: 13989 - RNA, 9879 nt, synthetic construct
  misc_feature 1..9879: note = derived and/or modified CDS sequence (opt3) from DENV-1__EU482709__SS-prME
  source 1..9879: mol_type = other RNA
agcgtgaccatgctgctcatgcttgtccccacagccctggctttccacttgactacgagaggaggggaacctcatatgatcgtttccaagcaggaaagaggaaaatctttactgtttaagacctcagccggtgtgaatatgtgcacactaattgccatggacctcggcgaactgtgtgaagatactatgacctacaaatgcccacggattacagagaccgaaccggacgatgtagactgttggtgcaatgcgactgatacatgggtgacctatgggacgtgtagtcaaactggagagcaccgccgagacaagcgtagcgtcgctcttgcaccccatgtgggcctgggtttggagaccagaacagaaacttggatgtcctctgagggggcatggaaacagatccagagggttgaaacctgggccctccggcaccctggattcacagtgattgctctgtttctggcacatgccatcggcacctcgattacgcagaagggcatcatattcatcctcttaatgctggtcactccatcaatggctatgcgctgcgtggggattggaagcagagattttgtagagggtcttagtggcgccacatgggttgacgtggtcttggagcacgggtcctgtgtgaccactatggcgaaggataaacccacactggacatcgaactactcaagaccgaggtgacgaaccctgcagtcctgaggaaactttgcattgaagccaagatctctaataccacaactgatagccggtgtccaacccaaggagaggctacactggttgaagaacaagacgccaacttcgtgtgccgccgaacttttgtagatagaggctggggtaatgggtgtggattgttcggcaaaggctccctcataacctgcgcaaagtttaagtgcgtgacaaaactggaggggaagattgtccagtacgaaaacttaaaatattcagtgatcgttaccgtgcacactggagaccagcatcaagtcggtaatgagagtacggaacacggcacaaccgctactattacaccccaagcccctaccaccgagatccagctgactgactacggggcgctcacacttgattgtagcccaaggacgggactggacttcaacgaaatggtgttgctaaccatgaaggagaaatcttggctggtacataagcagtggtttctcgatctgccgcttccctggacttccggcgcctcaacaagccaagagacctggaatcggcaggacctgttggttacattcaaaactgcacacgctaagaagcaggaagtggtcgtgctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtcatgtgtaccggatcgttcaaactggagaaggaagtggccgagacgcagcacggtacagttcttgtgcagataaagtacgagggcaccgacgctccttgcaaaatcccattctcgactcaagatgaaaagggggtaacacagaacggacgcttgattaccgcgaatcccatcgtcactgacaaagagaagcctgtgaacatagaagcagagccaccctttggcgagtcttatattgttatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtgtttacgtccgtcgggaaacttgtgcatcagattttcggaaccgcatacggcgtactgttttctggtgtgagctggactatgaagatagggatcggcgttttgctcacatggctgggattaaattcacgaagtacctccctgagcatgacatgtattgcggtcggcctagtgactctctacctgggggtgatggtccaggctgattctggatgcgttatcaactggaaaggccgcgaacttaagtgtggttcagggatcttcgtgaccaatgaggtgcacacgtggacagaacaatataagtttcaggccgacagtccgaaaagattgagcgcagccattggaaaggcttgggaggagggcgtatgcggtataaggtccgccacccggctggaaaacatcatgtggaaacagatttctaacgagctcaatcatatcctgttagaaaacgacatgaagttcactgtcgtggttggcgatgtggcagggattctggctcagggcaaaaagatgatccgccctcaacccatggagtacaaatattcgtggaaaagctggggcaaggccaagataatcggggcggacgtccagaataccacatttattatcgatggaccaaacactcctgaatgtcccgacgatcagagagcctggaatatttgggaggtggaggactacggcttcggtatctttaccacaaacatatggcttaagttgagggattcctatacgcaggtttgcgaccaccgtctcatgtcagctgcaattaaagatagtaaggccgtgcacgctgacatggggtactggatcgaatctgagaaaaatgaaacctggaagctggcccgggcatccttcattgaggtaaagacttgtatctggccaaaatcccatacactatggtcaaacggagtcctggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtggtggtcgatgagcactgcgggaacagaggaccctccctgaggacgactaccgttacaggcaagattatccacgaatggtgttgccgcagttgtaccttacctccactccggttcagaggtgaggacgggtgctggtatggaatggagataaggcccgtgaaagaaaaggaggaaaatctggtaaagagcatggtgtctgccggctccggtgaggtcgactcatttagtcttggcctgttgtgtattagcatcatgatcgaagaggtgatgcgctcgcgatggtcccggaaaatgctcatgactgggacactggctgttttctttctactgattatgggacagctcacctggaacgatctgatccgtctttgcattatggtgggcgccaatgcatctgacagaatggggatgggaacaacttacttggctctgatggccaccttcaagatgaggcctatgtttgcagtcggcttactcttccgccggctgacgagcagagaggtgcttctgctaacaataggtctctcactggttgccagtgtggaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtcctttcaattgtaagcctcttccccctgtgtttgagtacgacatctcagaagaccacttggctgccggtgttactcggctccctggggtgcaagcctcttacaatgtttctgatcgctgagaataaaatatggggaaggcgaagctggccattgaacgaaggtatcatggccgttggcattgtgtcgatcctcctgtcatctctactgaagaacgatgtcccccttgccgggcctctcattgctggaggcatgctgatcgcatgttacgtgataagtggttccagcgccgacttgtctttagagaaagcggctgaggtaagctgggaagaggaagccgagcattccggggcatcacacaatattctggtggaagtccaggatgacggaaccatgaagatcaaagatgaggagcgcgacgatactctcacaatcctgcttaaggccaccctgttggctgttagtggcgtgtatcccctaagcattccagcaacgctgttcgtgtggtacttctggcagaaaaagaagcagcggtctggcgtcctctgggacactccttcacccccagaagtggagagagccgttctggatgacgggatatataggatcatgcagcgtggacttttaggtcgcagccaggtaggcgtgggggtctttcaagaaaacgtgttccataccatgtggcacgttacacggggagcggtgctgatgtaccagggcaaaagactcgagccgagttgggctagcgtcaagaaagacttgatttcctacggtgggggatggaggctgcagggctcttggaataccggcgaggaagtgcaggtaatcgccgtcgagcctgggaagaaccccaaaaatgtgcaaacagcaccaggaacttttaagacccccgaaggtgaggttggcgccattgctctcgatttcaagcctgggacgtcgggaagcccaatcgtgaaccgagaaggcaaaatagtcggtctgtatgggaatggagtggttacaacttcaggcacctacgtgtccgccatcgcacaggctaaggccagtcaggagggcccccttcctgagattgaagacgaggtctttcggaaacgcaacctgacaatcatggatttgcacccggggtctggaaagaccagaaggtatctaccagcgattgtgcgggaagccatcaaacgaaagctgagaactctcatattagcacccacccgcgtagtggctagcgagatggccgaagctctgaagggtatgcctattaggtaccaaacaacggcagttaaatccgagcatactggcaaggagatcgtcgaccttatgtgccacgccaccttcacaatgcgtctgctctcaccagtgcgggtgcccaattataacatgatcattatggatgaagcccattttaccgacccttctagcatcgctgcgagagggtacataagtactagggtcggaatgggcgaggcagccgctattttcatgacagccaccccgcccggttccgtagaagcatttccacagagcaatgccgtgatccaggatgaggaacgcgacattcctgagcgatcttggaactcagggtatgagtggatcacggatttccccggaaaaactgtttggtttgtgccatccataaagagtggcaatgacattgctaactgtttgaggaaaaatggcaagcgggtcatccagctgagcaggaagacattcgataccgaataccagaaaaccaagaacaacgactgggactacgtggttactacagatatctcggagatgggggcgaatttccgcgccgaccgtgtgattgatcctagacggtgcctcaaacccgtcatcctgaaggacggaccagaaagggtgattcttgcaggtccgatgcctgtaaccgtggcttctgccgcacagcgccgaggcagaatagggcggaaccacaataaagagggagatcagtatatctacatgggccagcccctaaacaatgacgaggatcatgcccactggacagaagctaagatgctgttggacaacattaatactccagagggtatcatccccgccttatttgaacctgagagggaaaagtccgcggcaattgatggggagtatcgcctgagaggcgaggccaggaaaacgttcgttgaactcatgcggcgtggagacctgccagtctggcttagctacaaggtggcttcagagggctttcaatatagtgatcgccgatggtgcttcgacggggaaagaaacaatcaggtgctggaggaaaacatggatgtcgagatatggaccaaagagggagaaaggaagaaactccggccccgctggttggacgccagaacatactctgaccctctggctctaagggagtttaaggagttcgcagccggtcggcgatccgttagcggcgatctgatcctcgagattgggaaacttccgcagcacctgactcagagagctcaaaatgccttagacaacttggtgatgctgcataattcagaacagggaggccgcgcatataggcacgcgatggaggagctcccagataccatcgaaacactgatgcttctggccctcattgctgtattgaccggtggggtgactctgtttttcttaagtggccggggactaggcaagacgagcatcgggctgctctgtgtcatggcctcctctgtgcttctgtggatggcaagcgttgagccccattggatagctgcctccatcattttggaatttttcctgatggtgctcctgatccctgagcccgaccgtcagagaaccccacaggataaccaacttgcatacgtcgtaattggactcctgtttatgatcttgacagtggccgctaatgagatgggtctgttagaaactaccaagaaagacctaggcatagggcacgttgcggtggagaaccaccatcacgccgcaatgctggatgtcgacctccatcctgcttcagcctggacactttacgccgtggcaaccactattatcacacccatgatgaggcacacgattgaaaacaccactgctaatatctctctgacagccatagcgaaccaggctgccatcttgatgggactggataagggctggccaattagtaaaatggacatcggtgtccctctcctggcacttgggtgctatagccaggtgaatccgttaaccctgaccgccgctgttctcatgttggtggcacattacgccattatcggccccggactgcaagcgaaggctacacgcgaggcccagaaacggactgcagccggcataatgaagaacccaacggtagatgggattgtggctatcgacctagatcctgtcgtttatgacgccaagttcgaaaaacagctgggacagatcatgctccttattctgtgtaccagccaaatcttgctgatgcgaacaacttgggcactctgcgagtccataaccctggctacaggccccttaaccactctttgggagggttctccagggaagttttggaatacgacaattgccgtgtcaatggcgaacatcttcagaggaagctacctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctataagagatcaggtattatggaggtcgaccgttccgaagcaaaagaggggcttaagaggggagagacaactaaacacgctgtgagtcggggcaccgccaagctgcgctggttcgtagaacgaaatttggtgaaacctgagggtaaggttatcgatctgggctgtgggagaggaggctggagctactattgcgccgggctcaagaaagtgacagaagtcaagggatacacgaaaggcggtcccgggcacgaggaaccgataccaatggcgacctacggatggaacttagtgaagctgcattctggcaaagacgtctttttcatccctcccgagaagtgtgatactcttctgtgcgacattggcgagtcctcaccaaatcccacaatcgaagaggggaggaccctacgggtgctcaaaatggttgaaccttggctgcgcggaaaccaattttgtattaagatcttgaatccgtatatgcccagcgtagtggagactctggagcagatgcagagaaagcacggtggcatgctcgtcaggaacccactttcgcgaaattctacacatgaaatgtactgggtgagttgcgggaccggaaacattgtttccgctgtgaatatgacgagccggatgctgttaaaccgtttcaccatggcacacagaaaacctacatatgagcgcgatgtcgacctgggcgccggtactaggcacgtggctgtagaacccgaggtggccaacttggatatcatagggcagcggattgaaaatatcaagcatgagcacaaatcaacctggcattacgacgaggataacccttataagacatgggcataccacggatcctatgaagttaaaccatctggcagcgccagttccatggtcaatggcgtggtgaagctcctgactaagccctgggacgtcatccctatggttacccaaattgctatgacagataccactccatttgggcagcagagagtgttcaaagagaaggtagacacgcgcacacccaaagcgaagaggggaaccgcccaaataatggaagtgactgcaaaatggctatggggttttcttagccgaaacaagaagccgcggatctgtaccagagaggagttcacaaggaaagtccgctctaatgctgccattggcgcagtgtttgttgacgagaaccagtggaactcagccaaggaggctgtggaagatgagcgtttctgggacctggtccatcgggaaagagagctccacaaacaggggaagtgcgccacgtgcgtgtacaacatgatgggaaaaagggaaaagaagctgggcgagtttggtaaagcgaaggggagtcgcgcaatctggtacatgtggttgggagcccgattcctggagttcgaagctctcggctttatgaatgaggatcactggttctcccgggaaaacagcctttctggcgtagagggggagggactgcataaattaggttatattctgagagacatctcgaagatacctggcgggaatatgtacgccgatgacaccgcaggatgggatactaggatcacagaagacgatttgcagaacgaggctcgcattaccgacatcatggaaccagagcacgccctcctggctaaatcaatttttaagctaacttatcaaaataaagttgtgagagtccagcggcccgccaagaacggcacagtgatggatgtgatcagcaggcgtgaccagcgaggttccgggcaggtcggaacctacggccttaatacattcactaacatggaagcacaactgatacgccagatggagagtgagggcatattttctcctagcgaactcgagaccccaaacctggcggaaagagttttggattggttagagaagtatggggtggaacggctgaaaaggatggccatctccggagacgactgtgtagtgaagcccatcgatgaccgcttcgctacggccctcaccgcacttaatgatatgggtaaagtcagaaaggacattccgcagtgggagccttcaaaaggctggaacgattggcagcaagtgcccttttgcagtcatcacttccaccagctgataatgaaggacgggcgggagatcgttgtgccatgtaggaatcaggatgagctagtcggacgagctcgtgtgtctcagggcgccggttggagcctgagagagacagcatgcctcgggaagtcctacgcccaaatgtggcagttgatgtattttcatcgccgggacctgaggcttgcggctaacgccatttgttcagcagtacctgttgattggatccccactagcagaaccacatggtctattcacgcccatcaccagtggatgactaccgaagacatgctgtccgtgtggaatcgcgtctggatcgaggaaaacccatggatggaggataaaacgcatataagtagctggggagacgtgccctacctcggcaagcgggaggaccaatggtgcggctcgttaatcgggctgacagctagggccacctgggcaactaatattcaggttgctatcaaccaggtgcgaagattgattggaaatgaaaactacctggattatatgacatccatgaaacggttcaagaatgagtctgaccctgaaggtgccctctggtga

SEQ ID NO: 13990 - RNA, 9879 nt, synthetic construct
  misc_feature 1..9879: note = derived and/or modified CDS sequence (opt3) from DENV-1__EU482710__SS-prME
  source 1..9879: mol_type = other RNA
agcgtgaccatgctgctcatgcttatgcccaccgccctggctttccacttgactacgagaggaggggaacctcatatgatcgtaaccaagcaggaaaggggaaaatccttactgtttaagacatctgccggtgttaacatgtgcactttaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaacactcgtggaaaagctggggcaaggccaaaatcataggggcggacgtccagaatactacctttatcattgatggaccaaacacacctgaatgtcccgacgatcagagagcctggaatatctgggaggtggaggactacggcttcggtatttttactaccaacatctggcttaagttgagggattcctatacacaggtttgcgaccatcgtctcatgtcagctgcaataaaagatagtaaggccgtgcacgctgacatggggtactggattgaatctgagaaaaatgaaacgtggaagctggcccgggcatccttcatcgaggtaaagacctgtatttggccaaaatcccatactctatggtcaaacggagtcctggaaagcgagatgatcatacccaagatctatggcggtcctatttctcaacacaatcaccgaccaggctacttcacacagaccgcggggccgtggcatctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtatggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatacctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgtcagcttgttccccctgtgtttaagtaccacgtctcagaagacaacctggctcccggtgctgcttggctccctggggtgcaaacctttgactatgtttctcattacagagaataagatctggggaagaaaaagctggccactgaacgaaggtataatggctgttggcgtggtctcgatcctactgtcatctcttctcaagaacgatgtgcccctggccgggcctttgattgccggaggcatgttaatcgcttgttatgtaattagtggttccagcgcagacctgtctctcgagaaagccgcggaggtgagctgggaagaggaagctgagcactccggggcctcacacaatatcctggtcgaagttcaggatgacggaaccatgaagataaaagatgaggagagggacgatactcttacaattctgttgaaggcaaccctactggccgtgagtggcgtgtaccccctcagcatcccagctacgctgttcgtctggtatttttggcaaaagaaaaagcagcgatctggcgtgctttgggacactccttcacccccagaagttgagcgcgcagtattagatgacgggatctaccggattatgcagagaggactgctcggtaggagccaggtgggcgtcggggtgttccaagaaaacgttttccataccatgtggcacgtgacacgtggagccgtcttgatgtatcagggcaaacgcctggagccgagttgggcgagcgtgaagaaagacctcatatcctacggtgggggatggcggctgcagggctcttggaataccggcgaggaagtacaggtcatcgctgtggagcctgggaagaaccccaagaatgttcaaacagccccaggaacttttaaaacccccgaaggtgaggtgggcgcaattgcccttgatttcaagcctgggacgtcgggaagcccaatcgtcaacagagaaggcaaaattgtgggtctgtatgggaatggagttgtgacaacttcaggcacctacgtctccgctatcgcccaggcaaaggctagtcaggagggccccttgcctgagatagaagacgaggtgtttaggaaacgaaacctaacaatcatggatctgcatccggggtctggaaagacccggcgctacctcccagccattgtaagagaagcgatcaagaggaaattacggactctgattcttgcccccacccgagtggttgcaagcgagatggctgaagccctgaagggtatgcctatcagatatcaaacaacggctgtcaaatccgagcacactggcaaggagatagtggacctcatgtgccatgcaaccttcacaatgcgcttgctgtcaccagtgagggtccccaattacaacatgattatcatggatgaagcccactttaccgacccttctagcatcgccgctcgtgggtatattagtactcgggtaggaatgggcgaggcggcagccatcttcatgacagctaccccgcccggttccgtggaagcctttccacagagcaatgcagttatacaggatgaggaaagagacattcctgagaggtcttggaactcagggtacgagtggatcacggatttccccggaaaaactgtgtggtttgtcccatccattaagagtggcaatgacatcgccaactgtctccgcaagaatggcaaacgagtgatacagctgagcagaaagacattcgataccgaatatcagaaaaccaagaacaacgactgggactacgttgtgactacagatatttcggagatgggggctaattttcgggcggacagggtcatcgatcctcgccgttgccttaaacccgtgatcctaaaggacggaccagaaagagtaattctggccggtccgatgcctgtgaccgttgcatctgctgcccagcggaggggccgcatcgggcgaaaccacaataaggagggagatcagtatatttacatgggccagcccttgaacaatgacgaggatcatgcacactggacagaagccaaaatgttactggacaacataaatactccagagggtatcattcccgctctcttcgaacctgagagagaaaagtccgccgcgatcgatggggagtaccggctgaggggcgaggcacgcaaaacgttcgtcgaacttatgagaaggggagacctgccagtgtggctcagctataaggtggcctcagagggctttcaatacagtgatcggcgttggtgcttcgacggggaacgcaacaatcaggtcttggaggaaaacatggatgttgagatctggaccaaagagggagaacgaaagaaactgagacccaggtggctagacgctcggacatattctgaccctctggccctccgcgagtttaaggagttcgctgcaggtagaaggtccgtgagcggcgatcttatttcagagatagggaagctgccgcagcatttaactcagcgggcccaaaatgctttggacaacctggtaatgctccacaatagtgaacagggaggccgagcctacagacacgcaatggaggagctgccagataccatcgaaacacttatgctgctcgcgttgattgccgtgctgaccggtggggtcactttatttttcctaagcggccgcggactgggcaaaacgtccatcgggctcctttgtgtgatggcttctagcgttctgttgtggatggcctccgtggagccccattggattgcagcttcaatcatactggaatttttcctcatggtcctgcttatccctgagcccgacaggcagcggaccccacaggataaccaactcgcctatgtagtgattggactgttgtttatgatcctgacagttgcagccaatgagatgggtttactagaaactaccaagaaagacctgggcattgggcacgtggctgtcgagaaccatcaccatgcgacaatgctcgatgtggaccttcaccctgcctctgcatggaccctgtacgctgtcgccactacaatcataacgcccatgatgcgtcacaccattgaaaacactacagccaatatcagtttgaccgcaattgctaaccaggccgcgatcctgatgggactcgataagggctggccaatatcgaaaatggacatcggtgtgcctctgcttgctttagggtgctatagccaggttaatccgctgaccctcacagccgcagtgttgatgctggtagcccattacgctattatcggccccggactacaagcaaaggccactagagaggcgcagaagaggacggctgccggcattatgaaaaacccaaccgtggatgggatcatagcaattgacctggatcctgtcgtttacgacgccaagttcgaaaaacagctcggacagatcatgcttctgatcttgtgtacatcccaaattctgctcatgcgcactacctgggctctgtgcgagtctatcacattagccaccggcccccttactacgctgtgggagggttcaccagggaagttttggaatacaaccatagcagtgagcatggctaacattttccggggatcctatctcgccggcgcgggtctagcctttagtctgatgaaatctttgggcgggggacgaagaggcactggggcacagggagaaaccctgggcgagaagtggaagaggcagctcaatcagcttagcaaatcagagttcaacatctacaagcgctccggtattatggaggtcgaccggagtgaagctaaagaggggctgaagagaggagagacaactcgtcacgccgtgagcaggggcaccgcaaaattgcggtggttcgtagaacgcaatctggtgaagcctgagggtaaggttatcgatctcggctgtgggcgaggaggctggtcttattactgcgctgggctaaagaaggtgacagaagtcaaaggatatacgaagggcggtcccgggcatgaggaaccgataccaatggccacctacggatggaacctggtgaaacttcactccggcaaggacgtctttttcactcctcccgagaaatgtgatacactgctatgcgacatcggcgagtcaagcccaaatcccaccattgaagaggggagaactctcagggtgctgaagatggttgaaccttggttgcggggaaaccaattttgtatcaagattctgaatccgtatatgccctcggtagtggagacactcgagcagatgcagcgcaaacacggtggcatgcttgtcagaaacccactgtctaggaatagtacccatgaaatgtactgggtgtcctgcgggacgggaaacatcgttagcgccgtgaatatgacctcacgaatgttactgaaccggttcacaatggcgcaccgtaagcctacttacgagagagatgtcgacttgggcgctggtacccgccatgtggcagtagaacccgaggtggccaacctcgatattatcgggcagaggatagaaaatattaaacacgagcataagtccacatggcactatgacgaggataacccttacaaaacttgggcttatcacggatcttacgaagttaagccaagcggcagtgcctccagcatggtcaatggcgtggtgaagctgctaaccaaaccctgggacgtcatccctatggttacacaaatcgcaatgaccgatactacgccatttgggcagcagcgggtgttcaaggagaaagtagacacaagaacccccaaggccaaacgcggaactgctcaaattatggaagtgaccgcgaggtggctttggggttttctgtctcgaaacaagaagccgcggatatgtacaagagaggagttcacgaggaaagtccgctcaaatgccgcaatcggcgctgtgtttgttgacgagaaccagtggaatagtgccaaggaggcagtggaagatgagcgtttctgggacctcgtccagaaagaacgggagctgcataagcaggggaaatgcgcaacctgcgtgtataacatgatgggaaagagagaaaagaaattgggcgagtttggtaaggctaaagggtccagggccatttggtacatgtggctgggagcgcgcttcctcgagtttgaagcacttggcttcatgaatgaggatcactggttcagccgagaaaactctctgtcgggcgtagagggggagggattacataagctgggttatatcttgcgggacatttcaaaaatccctggcgggaatatgtacgccgatgacactgctggatgggatacaagaataaccgaagacgatctccaaaacgaggccaagatcactgacattatggaaccagagcacgcactgctagctacaagcatctttaaacttacctaccagaataaggttgtgagggtccagcgccccgccaagaacggcacagtgatggatgtgatttccagacgggaccagaggggtagtgggcaagtcggaacttatggcctgaataccttcacgaacatggaagctcagctcatccgtcagatggagtctgagggcatatttctgcctagcgaattggagaccccaaacttagccgaacgagttctggattggctcgagaaatacggggtggaacgccttaagagaatggcaatttccggagacgactgtgtagtgaaacccatcgatgaccggttcgcgacagccctgactgctctaaatgatatgggtaaggtcaggaaagacatcccgcagtgggagccttcaaagggctggaacgattggcaacaggtgcccttttgcagtcaccatttccaccagctgattatgaaggacgggcgcgagatagttgtgccatgtagaaatcaggatgaactcgtcggacgggccagggtgtctcaaggcgcaggttggagcttgcgagagaccgcttgcctggggaaatcctatgcccagatgtggcagcttatgtactttcatcgtagagacctgcgcctcgcagccaacgcgatctgttcagctgtacctgttgattgggtgcccacaagccggactacctggtctattcacgcccatcaccaatggatgacgacagaagacatgttatccgtctggaatagggtgtggatcgaggaaaacccatggatggaggataagacccacgttagtagctggggagacgtgccctatctgggcaaaagagaggaccagtggtgcggctcgttgattgggctgactgcacgcgccacatgggcttccaatatccaggtcgccataaaccaggtgcggaggctcatcggaaatgaaaactaccttgattatatgacctctatgaagcgattcaaaaatgagggtgaccctgaaggcgcactgtggtga

SEQ ID NO: 13991 - RNA, 9879 nt, synthetic construct
  misc_feature 1..9879: note = derived and/or modified CDS sequence (opt3) from DENV-1__EU482712__SS-prME
  source 1..9879: mol_type = other RNA
agcgtgaccatgctgctcatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaaattatggcggtcctatctcccagcacaactaccgaccaggctactttacacaaaccgccgggccgtggcatctgggaaagctcgagctggatttcgacctttgcgaaggcactacagtcgtggtggatgagcactgcgggaatagaggacccagtttgaggaccacgactgtcaccggcaaaattatccacgaatggtgttgccgcagctgtacactgcctccattacggtttaagggtgaggacgggtgctggtatggaatggagattagacccgttaaggaaaaagaggaaaacctcgtgaagtctatggtatccgctggctcaggtgaggtggacagtttcagcctgggccttctgtgtatctcgataatgattgaagaggtcatgaggtcccgctggtctcgaaaaatgttgatgaccgggactctcgccgtgctgtttctactgatcatgggacagctcacatggaatgatctgatccggctttgcattatggttggcgcaaacgctagcgaccgtatggggatgggaaccacatacttggccctgatggcaactttcaagatgagacctatgtttgccgtgggcttactcttcaggcgcctgacctcacgggaggtccttctgctaacgatcggtctcagtctggtggcttccgttgaattgccaaattctctggaggaattaggggatggactcgcgatgggcattatgatactgaaacttctgacagactttcagagccatcaattgtgggccaccctcctgtccctaactttcatcaagaccacattttcactgcactatgcatggaagactatggctatggtgcttagcattgtcagtctcttccccctgtgtttgtctaccacgtcccagaaaacaacctggctgccggtattactcggcagcctggggtgcaagcctcttactatgtttctgatcgccgagaacaaaatttggggaagaaagtcgtggccattgaacgaaggtatcatggccgtgggcatagtttcaatcctcctgtctagtctactgaaaaatgatgtgccccttgctgggcctctcattgcaggaggcatgctgatcgcctgttacgtcatttccggtagctctgcggacttgagcttagagaaggctgccgaggtgtcctgggaagaggaagcagagcattcaggggccagtcacaacatcctggtagaagtgcaggatgacggaacaatgaaaataaaggatgaggagagggacgataccctcactattctgcttaaggctacactgttggcagtcagcggcgtttatcccctatctatcccagccaccctgttcgtgtggtacttctggcagaaaaagaaacaacgatccggcgtgctctgggacacgccttcacccccagaagtcgagcgcgcggtgctggatgacgggatctatcggattatgcagagaggacttttaggtaggagtcaggttggcgtaggggtgtttcaggaaaatgtcttccatactatgtggcacgtgacccgtggagctgttctgatgtaccaaggcaagcgcctcgagccgagctgggcctccgtgaaaaaggacttgatatcttacggtgggggatggcggctgcagggctcgtggaacacaggcgaggaagtccaggtgatcgcagtagagcctgggaagaatcccaaaaacgtccagaccgccccaggaacatttaagactagcgaaggtgaggtgggcgctattgccctcgatttcaaacccgggacctcaggatcccctatcgttaatagagaaggcaagattgtgggtctgtatgggaacggagtcgtgacgacaagtggcacttacgtttctgcaatcgctcaagccaaagcgagccaggagggcccacttcccgagatagaagacgaggtgtttaggaagcgaaatctgaccatcatggatttgcaccctgggtccggaaagacacggcgctatctaccggccattgtcagagaagcaatcaaaaggaagctgcggaccctcattttagctccaactcgagtggtagcctcagagatggctgaagcactgaaaggtatgcccatcagataccagaccacagccgtgaagtctgagcatacgggcaaagagatagttgaccttatgtgccacgccactttcaccatgcgcctgctcagccctgtcagggtgccaaactataatatgattatcatggatgaagctcattttacagaccccagttccatcgcggcacgtgggtacattagcacccgggtgggaatgggcgaggccgctgccatcttcatgactgcaacacctccgggttctgtcgaagcctttccccaatcaaacgctgtaatacaggatgaggaaagagacattccagagaggtcctggaatagtgggtatgagtggatcaccgatttccctggaaagacggtgtggtttgttcccagcattaagtcgggcaacgacatcgcgaattgtttgcgcaaaaacggcaagcgagtgatacagctgtctagaaaaactttcgatacagaataccagaagaccaaaaacaatgactgggactacgtcgtgaccactgatatttccgagatgggggccaacttccgggcagacagggttatcgatccacgccgttgcctcaagcctgtgatcctgaaggacggacccgaaagagtcattcttgctggtccaatgccggtgacagtagccagcgcagcccaacggaggggccgcatcgggcgaaatcacaacaaagagggagatcagtatatttacatgggccagcctctaaataacgacgaggatcatgctcactggaccgaagccaagatgctgttggacaatataaacacacccgagggtatcattccagcgttatttgaacccgagagagaaaaatcagcagccatcgatggggagtatcggctgaggggcgaggctcgcaagactttcgtggaactcatgagaaggggagacctgcctgtttggcttagttacaaagtcgcctctgagggctttcagtattccgatcggcgttggtgcttcgacggggaacgcaataaccaagtgctggaggaaaatatggatgtggagatctggacgaaggagggagaacgaaagaaactcagaccaaggtggttggacgctcggacctacagcgaccccctggcactacgcgagtttaaagagttcgccgctggtagaaggtcagtcagtggcgatctgattctcgagatagggaaacttcctcagcacctgacacagcgggcccagaacgcattagacaatttggttatgctgcataacagcgaacaaggaggccgagcgtatagacacgccatggaggagctcccggatactatcgaaaccctgatgcttctggctctcattgccgtgttgacaggtggggtaaccctgtttttcttatccggccgcggactaggcaagacttctatcgggctgctctgtgtgatggcaagctccgtccttctgtggatggcttcagtggagccacattggattgccgcatctatcatattggaatttttcctgatggttctcctgatccccgagcctgacaggcagcggacgccccaggataatcagcttgcctacgtggtcattggactcctgtttatgatcttgaccgtagctgcgaacgagatgggtctgttagaaacaactaaaaaggacctaggcattgggcacgtggccgttgagaaccaccatcacgcagctatgctggatgtggacctccatccagccagtgcctggaccctttacgcagtcgctacaaccatcataactcctatgatgcgtcacacaattgaaaatacgaccgccaacatctcgctgactgcgattgctaatcaagccgcaatcttgatgggactggataaaggctggcccataagcaagatggacatcggtgtgccactcctggcccttgggtgctattcccaggtcaaccctttaacactgaccgctgcagtgctcatgttggttgcccattacgcgattatcggcccgggactgcaggctaaggccaccagagaggcacaaaagaggacagccgctggcattatgaagaatcccactgtggatgggatcgtagccatagacctagatccagtggtctatgacgcaaaattcgaaaagcagctgggacagattatgctccttatcctgtgtacgtctcagatcttgctgatgcgcaccacatgggctctctgcgagtcaattactctggccaccggccctttaacaaccctttgggagggtagccccgggaaattttggaacactacgatcgcggtttccatggccaatatattccggggaagttacctggcaggcgctggtctcgccttctctctaatgaaaagcctgggcgggggacgaagaggcacaggggcacaaggagaaaccttgggcgagaagtggaaaaggcagctgaaccagctctcaaagtccgaatttaatacttataaacgcagtggtattatggaggtggaccggagcgaagctaaggaggggcttaaaagaggagagaccacaaagcacgccgtctctcgtggcactgccaagctgaggtggttcgtggaacggaacttggtaaaaccagagggtaaggtgatcgatctgggctgtgggcgcggaggctggtcctactattgcgcggggctcaaaaaggttaccgaagtgaaaggatacacaaagggcggtcctgggcacgaggaacccattccgatggctacgtacggatggaatttagtcaaactgcattcaggcaaggacgtgtttttcatcccacctgagaagtgtgatacccttctgtgcgacataggcgagagctcgcccaacccaactatcgaagaggggcgaacactaagagtcctcaaaatggtggaaccctggctgaggggaaatcagttttgtattaagatcttgaacccttatatgccgtctgttgtagagaccctggagcaaatgcagcggaaacacggtggcatgctcgtgcgcaatccccttagtagaaactccactcatgaaatgtactgggtcagctgcgggacaggaaatattgtgtcagcagttaacatgacctccaggatgctgttaaaccgattcacgatggcccaccggaagccaacctatgagcgtgatgtggacctgggcgctggtacaagacacgtcgccgtggaacctgaggtagcaaatttggatatcattgggcagcgcatcgaaaacataaaacatgagcacaagtctacttggcattacgacgaggataatccctataagacctgggcctaccacggaagctatgaagtgaaacctagtggctccgctagctctatggttaacggcgtcgtgaagctcctgacaaaaccatgggacgtgattcccatggtcactcagatcgcgatgaccgatacaaccccttttgggcaacagagggttttcaaggagaaagtggacactcggacgccaaaggccaagagaggaacagcacagatcatggaagtaaccgctaaatggctatggggttttctttcacgcaataagaaacccaggatttgtactcgagaggagttcacccggaaggtgagaagtaacgccgcaataggcgccgtctttgtggacgagaatcaatggaactccgctaaagaggccgttgaagatgagaggttctgggacctggtgcatcgcgaacgtgagctccacaagcaggggaagtgcgcgacatgcgtctacaatatgatgggaaaacgggaaaagaaactgggcgagtttggtaaggcaaaagggagcagagccatctggtacatgtggttgggagctaggttcctggagttcgaagccctcggctttatgaacgaggatcactggttctctcgcgaaaattcgctttcaggcgtggagggggagggactgcataagttaggttatattctgcgagacatcagcaaaattccgggcgggaacatgtacgcagatgacacggctggatgggatacccggatcactgaagacgatttgcagaatgaggccaagataacagacatcatggaacctgagcacgctctcctggccaagtccatttttaaactaacctatcagaacaaggtagttagagtgcaaaggccagccaagaatggcactgtcatggatgtgatcagtcgcagagaccagcggggttctggacaggtgggaacatacggccttaacaccttcacaaacatggaagcgcagctgattaggcaaatggagagcgagggcatcttttccccctcagaactcgagactcctaatctggccgggcgtgtcttggattggttagaaaagcatggagttgagcgactgaaacgcatggctataagtggtgacgactgtgtggtaaagccaattgatgacagattcgccaccgcactcacggctcttaacgatatgggcaaggtgcggaaagacatcccccagtgggaaccgtctaaggggtggaatgattggcagcaggtccctttttgcagccaccacttccatcaactgatcatgaaagacggaagggagattgtggttccctgtcgcaaccaggatgagctagtgggcagagcccgggtctcccagggtgcagggtggtcactgagggaaaccgcctgcctcggaaagagctatgcgcagatgtggcaattgatgtactttcaccgacgtgacctgagacttgctgccaatgcaatatgttctgccgtgccagtagattgggttcctacatcccgcactacctggagtatccatgctcaccatcagtggatgacaactgaggacatgctgagcgtgtggaaccgggtctggattgaagagaatccctggatggaagataaaacccacatctcgtcctggggcgacgtgccatatctcggcaagagggaggaccagtggtgcgggtctttaattggactgacggccagagcaacatgggctaccaacatccaagttgccataaatcaggtgcgccggttgatcggtaacgagaattacctggattacatgacttcaatgaagaggttcaaaaacgaaagcgaccccgagggcgcgctctggtga

SEQ ID NO: 13992 - RNA, 9879 nt, synthetic construct
  misc_feature 1..9879: note = derived and/or modified CDS sequence (opt3) from DENV-1__EU249490__SS-prME
  source 1..9879: mol_type = other RNA
agcgtgaccatgctgctaatgcttatgcccaccgcactggctttccacttgactacgaggggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagacggactttcgatacagaataccagaaaaccaagaacaacgactgggactacgtcgtgaccactgatatctccgagatgggggccaattttagggcagaccgcgttatcgatccacgtagatgcctgaaacctgtgattctcaaggacggacccgaacgggtcatcctggctggtccaatgccggtgacagtagccagcgcagcccaaaggcgcggccgaattgggagaaaccacaataaggagggagatcagtatatatacatgggccagcctcttaacaatgacgaggatcatgctcactggaccgaagccaaaatgctactggacaacatcaatacacccgagggtattatcccagcgttgttcgaacccgagcgggaaaagtcagcagccatcgatggggagtataggttacgcggcgaggctagaaaaacttttgtggaactgatgaggcggggagacctccctgtttggctgagttacaaggtcgcctctgagggcttccagtattccgatcgtcgctggtgctttgacggggaacgaaacaatcaagtgcttgaggaaaacatggatgtggagatttggacgaaagagggagaaagaaagaaactgaggccacggtggctcgacgctcgcacctacagcgaccccttggcactgagagagttcaaggaatttgccgctggtaggcggtcagtcagtggcgatctaatactggagatcgggaagctccctcagcaccttacacagcgagcccagaatgcactggacaacttagttatgttgcataatagcgaacaaggaggcagagcgtatcgccacgccatggaggagctgccggatactattgaaaccctcatgctgcttgctctgatcgccgtgctcacaggtggggtaaccttgttctttctgtccggcaggggattaggcaaaacttctattgggctactgtgtgtgatggcaagctccgctctcctttggatggcctcagtcgagccacattggatcgcagcctctataatcctggagttctttttgatggtgctgctcattcccgagcctgaccggcagcgtacgccccaggataaccagctggcttacgttgtgatcggacttctcttcatgattctgaccgtcgcggccaatgagatgggtttgctggaaacaactaagaaagacttaggcatcgggcacgtagcagtggagaaccaccatcacgctgccatgctagatgttgacctgcatccagccagtgcatggaccctctacgctgtggccacaaccataattactcctatgatgagacacacaatcgaaaacacgaccgcgaatatttcgcttactgctatcgccaaccaagcagccatactgatgggattggataagggctggcccatcagcaaaatggacattggtgtcccactgctcgctctggggtgctattcccaggtgaatcctcttacattaaccgcagccgtcctgatgctcgtggcgcattacgctatcattggcccgggattgcaggccaaggcaaccagggaggcccaaaagcgcacagctgccggcatcatgaaaaaccccactgttgatgggatagtggcaattgacctggatccagtagtgtatgacgctaagtttgaaaaacagctaggacagatcatgctgctcatcctttgtacgtctcagattctgttgatgcggaccacatgggccctgtgcgagtcaatcactctcgcgaccggccctctgacaaccttatgggagggtagccccgggaagttctggaatactacgatagccgtctccatggcaaacattttccgaggaagttaccttgctggcgccggtctggcattttctctcatgaaaagcctaggcgggggaagaaggggcacaggggctcaaggagaaaccctgggcgagaagtggaagcgccagttgaatcagctgtcaaaatccgagttcaacacttataagcggagtggtatcatggaggttgacagaagcgaagccaaagaggggctcaagcgtggagagaccacaaaacacgccgtgtctaggggcactgcgaaacttcggtggtttgtcgaacgcaatctggtgaagccagagggtaaagtaattgatttgggctgtgggcgaggaggctggtcctactattgcgctgggctgaagaaagtgaccgaagttaagggatacacaaaaggcggtcctgggcacgaggaacccatcccgatggcaacgtacggatggaacctcgtgaagttacattcaggcaaagacgtcttctttataccacctgagaagtgtgataccctgctttgcgacatcggcgagagctcgcccaatccaactattgaagaggggagaacactgagggtgctaaagatggtcgaaccctggctccggggaaaccagttctgtatcaaaattctgaatccttatatgccgtctgtggttgagaccttggagcaaatgcagcgcaagcacggtggcatgctggtaagaaaccccctcagtagaaattccactcatgaaatgtactgggtgagctgcgggacaggaaacatcgtctcagccgtgaatatgacctcccgaatgcttctgaaccggtttacgatggctcaccgtaaaccaacctatgagagagatgttgacttaggcgccggtacacgccacgtggcagtcgaacctgaggtggccaacctggatattatcgggcagaggatagaaaatattaagcatgagcacaaatctacttggcattacgacgaggataacccctataagacctgggcttaccacggaagctatgaagtaaagcctagtggctccgcgagctctatggtgaatggcgttgtcaaattgctcacaaagccatgggacgtgatccccatggtgactcagatcgccatgaccgatacaacccctttcgggcaacagcgggtctttaaagagaaggttgacactagaacgccaaaagcaaagcgcggaacagctcagattatggaagtgaccgccaagtggctgtggggtttcctatcaaggaacaaaaagccccgaatatgtactcgggaggaatttaccagaaaagtaaggagtaatgcagccatcggcgctgtgttcgtcgacgagaaccaatggaactccgccaaggaggcggtggaagatgagcgcttttgggaccttgttcatcgtgaacgggagctgcacaaacaggggaagtgcgcaacatgcgtgtacaacatgatgggaaagagagagaaaaagctcggcgagttcggtaaagccaaggggagcagggctatttggtacatgtggctgggagcccgcttcttggagtttgaagcactgggcttcatgaatgaggatcactggttttctcgagaaaactcgctctcaggcgtcgagggggagggacttcataaactgggttatatcttacgggacattagcaagatcccgggcgggaatatgtacgctgatgacacggccggatgggataccagaataactgaagacgatctgcagaacgaggctaaaatcacagacattatggaacctgagcacgccttgctcgcaaagtccatcttcaagctgacctatcagaataaagtggtaagggttcaacgcccagcgaagaacggcactgtgatggatgtcattagtagacgggaccagaggggttctggacaggtgggaacatacggcctaaatacctttacaaacatggaagcccagcttatccgtcaaatggagagcgagggcatattctccccctcagaactggagactcctaacctcgctgggcgagtgctggattggttggaaaaacatggagtcgagcgcttaaagagaatggccattagtggtgacgactgtgttgtgaaaccaatcgatgaccggtttgcaaccgctctgacggccctcaatgatatgggcaaggtaaggaaggacatcccccagtgggaaccgtctaaagggtggaacgattggcaacaggtgcctttctgcagccaccactttcatcaacttattatgaaggacggacgcgagatagtcgtgccctgtagaaatcaggatgagctggttggccgggcaagggtgtcccagggtgccgggtggtcactacgagaaaccgcgtgcctgggaaaaagctatgctcagatgtggcaactcatgtacttccaccgtagagacttgcgcctggccgcaaacgccatctgttctgctgtcccagtggattgggtacctacatcccggactacctggagtattcatgcccaccatcagtggatgacaactgaggacatgcttagcgtttggaatagggtgtggatcgaagagaacccctggatggaagataagacccacatttcgtcctggggcgacgtcccatatctgggcaaaagagaggaccagtggtgcgggtctctcatcggattaacggcacgcgctacatgggccaccaatatacaagtggcgatcaaccaggttcggaggctgattggtaatgagaactacttggattacatgacttcaatgaagcgatttaagaatgaaagcgaccccgagggcgctctgtggtga

SEQ ID NO: 13993 - RNA, 9879 nt, synthetic construct
  misc_feature 1..9879: note = derived and/or modified CDS sequence (opt3) from DENV-1__EU249491__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggatcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggccatggtgcaggcagattctggatgcgtgatcaactggaaaggccgcgaacttaagtgtggttcagggatcttcgtcactaatgaggttcacacctggacggaacaatataagtttcaggccgacagtccgaaaagattgagcgctgccattggaaaggcatgggaggagggcgtgtgcggtataaggtccgctacacggctggaaaacatcatgtggaaacagatttctaacgagctcaatcatatcctgttagaaaacgacatgaagctgaccgtggtagtcggcgatgtggccgggattcttggacagggcaaaaagatgatccgccctcaacccatggagtacaaatattcgtggaaaagctgggggaaggcgaaaataatcggagccgacgctcagaatactaccttcattatcgatggcccaaacacacctgaatgtcccgacgatcagagagcatggaatatttgggaggttgaggactacggttttgggatcttcactaccaacatatggttgaagctcagggattcctatacacaggtgtgcgaccaccgtctgatgtcagccgctattaaagatagtaaggccgtccacgcagacatgggatactggatcgaatctgagaaaaatgaaacgtggaagctagcgcgggccagctttattgaggtgaagacctgtatctggccaaaatcccatactctgtggtcaaacggcgttctcgaaagcgagatgataatccccaagatttatggtggccctatctctcaacacaattaccgaccagggtacttcacacagaccgctggaccgtggcatctgggcaaacttgagttggatttcgacctgtgcgaagggactacagtggtagtcgatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtgaaagaaaaggaggaaaatcttgtcaagagcatggtttctgccggttccggcgaggtggactcattcagtctggggttgctctgtattagcatcatgatcgaagaggtaatgcgctcgcgatggtcccggaaaatgctgatgaccggaactctagcagtgtttttcctgctcattatgggccagctgacatggaacgatcttatccgtttgtgcattatggtcggggctaatgcctctgacagaatgggaatgggcaccacatacctggcattaatggccacttttaagatgaggcctatgttcgctgtgggtctcctgtttcgccggcttaccagcagagaggttctgctactcacgatagggctgtcattggtggcgagtgtcgaactgccaaactccttagaggaactcggagatggcctggccatgggcatcatgattcttaaactgttgacagacttccaatctcatcagctctgggcaaccctgctaagcctgacttttatcaagaccacattctcccttcactatgcttggaaaactatggccatggtgctctcaattgttagcctgtttcccttgtgtctgagtaccacgtctcagaagacaacctggttaccggtgctcctggggtcccttggatgcaagcctctgactatgttcttgatcgccgagaataaaatatggggtaggaagtcctggccactcaacgaaggcatcatggctgtcgggattgtatcgatcctgctatcatctctgcttaaaaacgatgtgcccctcgcaggacctctgattgccggcggtatgttgatcgcgtgttacgttataagtgggtccagcgctgacttatctctggagaaggccgcagaggtgagctgggaagaggaagccgagcattccggagcttcacacaatattctcgtcgaagtgcaggatgacggcacaatgaaaatcaaggatgaggagcgagacgataccctgactatccttctgaaagcaacattgctagccgtaagtggcgtgtatcccctgagcattccagcgaccctctttgtctggtacttctggcaaaagaagaaacagcgctctggggttctgtgggacacgccttcacccccagaagtggagcgggctgtgcttgatgacggaatatatagaatcatgcagaggggtttactgggccgtagccaggtcggggtgggagttttccaagaaaacgtatttcatactatgtggcacgtgacccgcggcgccgtcctcatgtaccagggtaagcggttggagccgagttgggcaagcgtgaaaaaggacctgatttcctacgggggaggctggagactcaggggctcttggaatacaggggaggaagttcaggtgatcgccgtcgagcctggcaaaaatcccaagaatgtgcagaccgctccaggtacattcaagactcccgaaggcgaggtaggggccattgcactggattttaaacctggaacctcgggcagcccaatcgtcaaccgagaaggtaagatagtggggctttatggaaatggcgttgtgacgacatcaggcacttacgtctccgctatcgcccaagcgaaagccagtcaggaggggcccctgcctgagattgaagacgaggtgttccggaagcgcaacttgaccatcatggatctacacccgggatctggtaaaacaagaaggtatctgccagcaattgttcgggaagctatcaagcgaaagctcagaaccttaatactggcccccactcgcgtggtcgctagcgagatggcagaagcccttaaaggcatgcctattaggtaccagaccacagccgtgaagtccgagcatacggggaaagagatcgtagacctgatgtgccacgctacttttaccatgcgtctcttgtcaccagtgcgggttcccaattataacatgatcattatggatgaagcgcatttcacagacccttctagcatcgcagccagaggatacataagtaccagggtcggcatgggtgaggctgccgcaatttttatgactgccacaccgcccgggtccgtggaggctttcccacaaagcaatgcggtgatccaggatgaggaacgcgacattcctgagcgatcttggaactcaggatatgagtggatcaccgattttcccggcaagacggtctggttcgtaccatccataaaaagtggcaatgacattgccaactgtctgagaaagaatgggaagcgggtgatccagctcagcaggaaaacttttgatacagaataccagaagaccaaaaacaacgactgggactacgttgtgaccactgatatctcggagatgggagcaaatttccgcgctgaccgtgtcattgatcctagacggtgcctgaagcccgtgatccttaaagacggtccagaaagggttattctagccggcccgatgcctgtgacagtcgcatctgccgctcaacgccgagggagaataggacggaaccacaataaggagggcgatcagtatatctacatgggtcagcccctgaacaatgacgaggatcatgcccactggaccgaagcgaagatgttgttagacaacattaatacaccagaggggatcatccccgcactgttcgaacctgagagggaaaaatccgccgctgtggatggcgagtatcgcctcagaggagaggccaggaagacttttgtagaactgatgcggcgtggcgaccttccagtgtggctgagctacaaagttgcttcagaggggttccagtatagtgatcgccgatggtgctttgacggagaaagaaacaatcaagtcctcgaggaaaacatggatgtggagatttggacgaaggagggtgaaaggaaaaagttgcggccccgctggctggacgcaagaacctactctgaccctctagccctgagggagttcaaagaatttgctgccggccggcgatccgtgagcggggatctcatacttgagatcggaaagctgccgcagcacttaacacagagagcacagaatgcgttggacaacctggtcatgctccataattcagaacaaggcggtcgcgcctataggcacgctatggaggagctgccagatactattgaaacccttatgctgctcgccttgatcgcagttctgacagggggcgtgaccttattctttctaagtggacggggcctggggaagactagcattggactcctttgtgtaatggcttcctctgtgctgttgtggatggccagcgtcgagccccattggatcgcagcctccataatcctggagttctttctcatggtgctgcttattcctgagcccgaccgtcagagaacgccacaggataaccagctcgcttacgttgtgatcggtctgttgttcatgattctgaccgtcgcggccaatgagatgggcttactagaaacaactaaaaaggacctggggatcggacacgtagcagtggagaaccaccatcacgctgccatgctcgatgttgaccttcatcctgcctcagcatggaccctgtacgctgtggccacaaccataattactcccatgatgaggcacacaatcgaaaacacgaccgcgaatatttctttgactgctatcgccaaccaagcagccatactgatgggcctcgataaaggttggccaatcagtaagatggacattggggtccctctgcttgctttaggctgctatagccaggtgaatccgctgacactcaccgcagccgtcttgatgctggtggcgcattacgctatcattggacccggcctacaggccaaagcaacccgcgaggcccaaaagcggacagctgccgggatcatgaagaacccaactgttgatggaatagtggcaattgacctggatcctgtagtgtatgacgctaaatttgaaaagcagctcggccagatcatgcttctgatcttgtgtacgagccagattctgctcatgcgaaccacatgggccctgtgcgagtccatcactttagcgaccggtccccttacaaccctgtgggaggggtctccaggaaaattctggaatactacgatagccgtctcaatggcaaacatttttagaggcagctacctcgctggtgccggcctagcattctccctgatgaagagtctagggggaggcaggcgcgggacaggagctcaaggcgaaaccctgggtgagaaatggaagcggcagctcaatcagctttctaagagcgagttcaacacttataaaagatcagggatcatggaggttgaccgttccgaagccaaggagggactgaaaaggggcgagaccacaaagcacgccgtgagtcggggtactgcgaaattgcgctggtttgtcgaacgaaatctggtgaagcctgagggcaaggtaattgatctcgggtgtggaagaggcgggtggagctactattgcgctggactaaagaaggtgaccgaagttaaaggctacacaaagggtgggcccggacacgaggaaccgatcccaatggcaacgtacggctggaacctggtgaaacttcattctggcaaggacgtcttctttatacctcccgagaaatgtgataccctgctatgcgacatcggggagtcctcaccaaatcccactattgaagagggaaggacactccgggtgctgaagatggtcgaaccttggttgcgcggtaaccagttctgtatcaagattctgaatccgtatatgcccagcgtggttgagaccctcgagcaaatgcagagaaaacacggcgggatgcttgtaaggaacccactgtcgcgaaattctactcatgaaatgtactgggtgagttgcggaacaggcaacatcgtctccgccgtgaatatgaccagccggatgttactgaaccgttttacgatggctcacagaaagcctacctatgagcgcgatgttgacttgggtacagggactaggcacgtggccgtcgaacccgaggtggcaaacctcgatattatcggacagcggatagaaaatattaaacatgagcacaagtcaacctggcattacgacgaggataacccttataaaacatgggcctaccacggctcctatgaagtaaagccatctggcagcgctagttccatggtgaatggggttgtcaagctgctaactaaaccctgggacgtgatccctatggtgacccagatcgcgatgacagataccactccattcggacaacagagagtctttaaggagaaagttgacacgcgcacacccaaggccaaaaggggtaccgcacagattatggaagtgactgctcgatggctttggggcttcctgagccggaacaagaagccgagaatatgtaccagggaggaatttacacgcaaagtacgttctaatgccgcaatcggggccgtgttcgtcgacgagaaccaatggaactcagctaaggaggccgtggaagatgagcggttttgggacctcgttcatagagaaagggagctgcacaaacagggaaagtgcgcgacgtgcgtgtacaacatgatgggcaaacgcgaaaagaagttgggtgagttcgggaaagcaaagggaagtcgagccatttggtacatgtggctgggcgctcggtttctcgagttcgaagcccttggcttcatgaatgaggatcactggttttccagagaaaacagcctgtctggggtcgagggagagggtttacataaactgggctatatcttgagggacatttcgaagatccctgggggaaatatgtacgcagatgacaccgctggctgggatactcgcataacagaagacgatctccagaacgaggccaaaatcaccgacattatggaaccagagcacgctctgctagccaaggcaatcttcaaacttacttatcagaataaggtggtaagagttcaacggcccgcgaagaacggtacagtgatggatgtcatttcaaggcgtgaccagcgagggagcggacaggtgggcacctacggcctgaatacatttactaacatggaagcccagctcatccgccaaatggagtccgaggggatattcagtccttctgaactggagaccccaaacttggctgaaagagccttagattggctggagaaatatggagtggaacggctcaagaggatggcaattagcggtgacgactgtgtcgttaaacccatcgatgaccgctttgctacggcccttaccgcactgaatgatatgggcaaggtgagaaaagacatcccgcagtgggagccttccaaggggtggaacgattggcagcaggtacccttctgctcacatcactttcaccaactaattatgaaggacggacgggagatagtggtcccatgtaggaatcaggatgaactggtgggccgagcccgtgttagtcagggtgcggggtggtctctcagagagacagcttgcttgggaaaaagctacgcccagatgtggcaactgatgtatttccatcgccgggaccttaggctggcagccaacgctatctgttccgccgtgcctgtcgattgggtgcccacttcaagaaccacatggagcattcacgcacatcaccagtggatgactaccgaagacatgctctctgtatggaatcgcgtttggatcgaggaaaacccatggatggaggataagacgcatatttccagttgggaggacgtgccctacttaggcaaacgggaagaccagtggtgcggcagcctgatcgggttgacagctagggccacctgggcgactaatatacaagtcgctatcaaccaggtgcgaagactgattggaaatgagaactacctcgattatatgacatcgatgaagcggtttaaaaatgaatccgaccctgagggtgccctttggtga

SEQ ID NO: 13994 - RNA, 9879 nt, synthetic construct
  misc_feature 1..9879: note = derived and/or modified CDS sequence (opt3) from DENV-1__EU249492__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccagatgtgcgaccaccgtctcatgagtgcagccattaaagattctaaggctgtgcacgccgacatggggtactggatcgaaagcgagaaaaatgaaacatggaagctggcacgggcgtccttcattgaggttaagacgtgtatctggccaaaatcacataccctatggagcaacggagtgctggaatctgagatgataatccccaagatttatggcggtcctatctcccaacacaattaccgaccaggctacttcactcagacagccgggccgtggcatctcggaaaactggagcttgattttgacttgtgcgaaggcaccactgtagtcgtggatgagcactgcgggaacagaggacccagtctgaggacaaccacggtgactggcaagattatccacgaatggtgttgccgcagctgtaccttacctccactccggttcaaaggtgaggacgggtgctggtatggaatggagataagacccgtcaaggaaaaggaggaaaatctggttaaatctatggtgtccgctggctcaggtgaggtagacagttttagccttggcctgttgtgtatttcgatcatgatcgaagaggtgatgaggtcccgctggtctcgaaagatgctcatgacagggaccctggccgtcttctttctactgattatgggacagctcacttggaacgatctgatccggctttgcattatggtgggcgcaaatgctagcgaccgtatggggatgggaacaacctacttggccctgatggcaacattcaaaatgagacctatgtttgccgttggcttactcttcaggcgcctgacttcacgggaggtgcttctgctaaccataggtctcagtctggtcgcttccgtggaattgccaaactctctggaggaattaggggatggactcgcgatgggcatcatgattctgaagcttctgacggactttcaaagccatcagttgtgggccacactcctgtccatgaccttcatcagaactaccttttcactacactatgcatggaaaacaatggctatggttctgagcattgtgagtcttttccccctctgtctgtctactacctcccagaagacgacatggttgccggtcctgttaggcagcctcgggtgcaagcctctgaccatgtttcttatcgccgagaataaaatatggggaaggaagtcgtggccactgaacgaaggtatcatggccgtaggcattgtgtcaatcttgctctctagtctgctaaaaaacgatgttcccctggctgggcctcttattgcaggaggcatgctcatcgcctgttacgtgatatccggtagctctgcggacctgagcttggagaaggctgccgaggtctcctgggaagaggaagcagagcattcaggggccagtcacaatattttagtggaagtacaggatgacggaactatgaaaatcaaggatgaggagcgagacgatacactgaccatcctcctgaaagctactcttctggcagtgagcggcgtctatcccttgtctattccagccacactattcgtttggtacttctggcaaaagaagaaacagcgctccggcgtgctgtgggacaccccttcacccccagaagtgcagcgggcggtcctcgatgacgggatatatagaatcatgcagaggggactgcttggtcgtagtcaagtgggcgttggggtatttcaggagaacgtgttccatacgatgtggcacgtcactcgcggagctgtgttaatgtaccagggcaagcggctggaaccgagctgggcctccgttaaaaaggacctcatttcttacggtgggggatggagattgcagggctcgtggaataccggcgaggaggtgcaagtcatcgcagtggaacctgggaaaaaccccaagaatgtacagacagccccaggaacctttaagacaagcgagggtgaagtcggcgctattgccctggatttcaaacccgggacttcaggatcccctatcgtgaacagggagggcaagatagttggtctctatgggaatggagtggtcaccacgagtggcacatacgtgtctgcaatcgctcaggccaaagcgagccaagaaggcccactgcccgagattgaggacgaagtttttcgaaagcggaaccttactatcatggatctgcaccctgggtccggaaaaacccgcagatatttgccggccattgtgagggaggcaatcaagcggaagctacgaacactgatactcgctccaaccagagtcgtggcctcagaaatggctgaggcattaaaaggtatgcccattcgctaccagactaccgccgtaaagtctgaacatacaggcaaagagatcgtggacctgatgtgccacgccacgttcactatgaggcttctgagccctgttcgtgtcccaaattataacatgatcattatggatgaggctcattttaccgaccccagttccatcgcggcacgggggtacataagcacaagagtgggaatgggcgaagccgctgccattttcatgaccgcaactcctccgggttctgtggaggcctttccccagtcaaatgctgtcatccaggatgaagagagggacattccagaacgctcctggaacagtgggtatgagtggatcacagatttccctggaaagaccgtatggtttgtgcccagcataaaatcgggcaatgacattgcgaactgtctccgaaagaatggcaagagagttatccaattgtctcggaaaacgttcgatactgagtaccagaagacaaaaaacaacgactgggactacgtggtcaccaccgatatctccgaaatgggggccaatttcagggcagaccgcgtgattgatccacgtagatgcctgaagcctgttatcctcaaagacggacccgagcgggtgattctggctggtccaatgccggtcactgtggccagcgcagcccagaggcgcggccgaatagggagaaaccacaataaggaaggagatcagtatatctacatgggccaacctcttaacaatgacgaggatcatgctcactggacagaggccaagatgctactggacaacattaatacccccgaaggtatcatcccagcgttgtttgagcccgaacgggagaaatcagcagccattgatggggaatataggttacgcggcgaggctagaaagacattcgtagagctgatgaggcggggagacctccctgtgtggctgagttacaaagttgcctctgaaggctttcagtattccgatcgtcgctggtgcttcgacggggagcgaaacaatcaggtccttgaagagaacatggatgtggaaatatggactaaggagggagagagaaaaaagctgaggccacggtggctcgacgctcgcacgtacagcgaccccttggcactgagagaatttaaagagttcgccgctggtaggcggtcagtgagtggcgatctaatcctggaaattgggaagctccctcagcaccttacccaacgagcccagaatgcactggacaacttagtcatgttgcataatagcgagcagggaggcagagcgtatcgccacgccatggaagagctgccggatacaatcgagactctcatgctgcttgctctgattgccgttctcaccggtggggtgacattgtttttcctgtccggcaggggattaggcaagacctctatcgggctactgtgtgtaatggcaagctccgtgctcctttggatggcttcagtcgaaccacattggatagccgcatctatcattctggagtttttcttgatggtgctgctcatccccgaacctgaccggcagcgtactccccaagataaccagctggcctacgttgtgattggacttctctttatgatcctgacggtcgctgcgaatgagatgggtttgctggagaccacaaaaaaggacttaggcatagggcacgtagccgtggaaaaccaccatcacgcagctatgctagatgttgacctgcatccagccagtgcctggactctctacgcagtggctaccacaattatcacccctatgatgagacacactattgagaacacaacggccaatatctcgcttaccgcgatagctaaccaggccgcaatcctgatgggattggataaaggctggcccattagcaagatggacatcggtgtcccactgctcgccctggggtgctattcccaagtgaatcctcttactttaacagctgcagtcctgatgctcgtggcccattacgcgattatcggcccgggattgcaggctaaagccaccagggaagcacagaagcgcaccgccgctggcataatgaagaaccccacagttgatgggattgtggccatcgacctggatccagtagtgtatgacgcaaaattcgagaagcagctaggacaaatcatgctgctcattctttgtacttctcagatcctgttgatgcggacgacctgggctctgtgcgaatcaataacactcgccactggccctctgaccacattatgggagggtagccccgggaaattttggaataccactattgcggtctccatggccaacatcttccgaggaagttaccttgcaggcgctggtctggccttctctctcatgaagagcctaggcgggtcaagaaggggaacgggcgcacagggggagacactgggagaaaaatggaagcgccagttgaatcaactgtccaagagtgagtttaacacctataaacggagcggcattatggaagttgacagatctgaggctaaggaaggtctcaaacgtggggagactaccaagcacgccgtgtccaggggaacagccaaacttcggtggttcgtcgagcgcaatctggtgaagccagaaggcaaggtaatcgatttgggttgtggccgagggggatggtcatactattgcgcgggcctgaaaaaggtgactgaggttaaagggtacaccaagggaggccctggtcacgaagagcccataccgatggctacatacgggtggaacctcgtgaaattacatagcggaaaggacgtctttttcatcccacctgaaaaatgtgatacgctgctttgcgacattggcgagtcgtctcccaatccaaccatcgaggaaggcagaactctgagggtgctaaagatggtcgagccctggctccgggggaaccagttttgtattaagatcctgaatccttatatgccgagtgtggttgaaacattggagcagatgcagcgcaaacacggaggtatgctggtaagaaaccccctctccaggaatagcacccatgagatgtactgggtgtcatgcggcactgggaacattgtctccgcagtgaatatgacatctcgaatgcttctgaaccggttcaccatggcccaccgtaagccaacgtatgaaagagatgttgacttaggagctggcacccgccacgtggccgtcgagcctgaagtggcaaacctggatatcataggtcaaaggattgagaatatcaaacatgaacacaagagcacatggcattacgacgaggataacccctataaaacttgggcctaccacgggagttatgaggtaaagccttccggaagcgcttcttcaatggtgaatggcgttgtcaagttgctcaccaaaccatgggacgtgatccccatggtgacacagattgcgatgactgataccacaccttttggccagcaacgggtcttcaaggaaaaagttgacaccagaactccaaaggccaaacgcgggacggcacagataatggaggtgacagctaagtggctgtggggatttctaagtaggaacaagaaaccccgaatctgtacccgggaagagttcactagaaaggtaaggtccaatgccgcaattggtgccgtgtttgtcgacgaaaaccagtggaatagcgctaaagaggccgtggaggatgaacgcttctgggaccttgttcatcgtgagcgggaactgcacaagcagggcaaatgcgcgacctgcgtgtacaacatgatggggaagagagagaagaaactcggagaatttggcaaggcaaaaggttctagggccatctggtacatgtggctgggggctcgcttcttggagttcgaggccctgggatttatgaatgaagatcactggttctcgcgagagaactcactcagcggcgtcgaaggcgaggggcttcataagctgggatatattttacgggacatctccaaaataccgggtggcaatatgtacgcagatgacacagctgggtgggatacgagaatcaccgaggacgatctgcaaaacgaagccaagattactgacatcatggagcctgaacacgctttgctcgccaaaagtatttttaagctgacatatcagaataaggtggtaagggttcagcgcccagcaaaaaacggaaccgtgatggatgtcatctctagacgggaccagaggggcagcggtcaagtggggacttacggactaaatacattcaccaacatggaggcgcagcttatacgtcagatggaatccgagggcattttttcacccagtgagctggatacacctaacctcgccggccgagtgctggactggttggaaaagcatggggtcgagcgcttaaaaagaatggctatctctggagacgattgtgttgtgaagccaatcgacgatcggttcgccactgcactgaccgctctcaatgacatgggtaaagtaaggaaggatattccccagtgggaaccgagcaagggctggaacgactggcaacaggtgcctttttgctcccaccacttccatcagcttataatgaaagatgggcgcgagatcgtcgtgccctgtagaaatcaggacgaactggttggacgggccagggtgtcacaaggcgcaggttggagcctacgagagacggcctgcctggggaagtcttatgcgcagatgtggcagctcatgtactttcaccgtagagatttgcgcctggctgccaacgcaatttgttccgccgtcccagtggactgggtacctaccagtcggacaacttggagcatccatgctcaccatcaatggatgaccacagaggatatgctttcggtttggaatagggtgtggattgaagagaacccctggatggaagacaaaactcacatctcctcttggggagacgtcccatatctgggcaagagagaggatcagtggtgcggctcactcatagggttaaccgcccgcgcaacgtgggctacaaatatccaggtggccattaaccaggttcggaggctgttgggaaatgaaaactacctggactacatgaccagcatgaaacgattcaagaatgagagtggtcccgagggcgcgctctggtga

SEQ ID NO: 13995 - RNA, 9879 nt, synthetic construct
  misc_feature 1..9879: note = derived and/or modified CDS sequence (opt3) from DENV-1__EU249493__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgagatgggtttgctggaaacaactaaaaaggacttaggcatcgggcacgtggccgttgagaaccaccatcacgcagctatgctagatgtggacctgcatccagccagtgcctggaccctctacgcagtcgctacaaccataattactcctatgatgcgtcacacaatcgaaaacacgaccgccaatatttcgcttactgcgatcgctaaccaagccgcaatactgatgggattggataaaggctggcccatcagcaagatggacattggtgtgccactgctcgccctggggtgctattcccaggtcaatcctcttacattaaccgctgcagtgctgatgctcgttgcccattacgcgatcattggcccgggattgcaggctaaggccaccagagaggcacagaagaggacagccgctggcatcatgaagaaccccactgtggatgggatagtagccattgacctggatccagtggtctatgacgcaaaatttgaaaagcagctaggacagatcatgctgctcatcctttgtacgtctcagattctgttgatgcgcaccacatgggctctgtgcgagtcaatcactctcgccaccggccctctgacaaccttatgggagggtagccccgggaaattctggaatactacgatagcggtttccatggccaacattttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtatcatggaggtggaccggagcgaagctaaggaggggctcaaaagaggagagaccacaaagcacgccgtctctcgtggcactgccaaacttaggtggtttgtggaacggaatctggtaaaaccagagggtaaggtgattgatttgggctgtgggcgcggaggctggtcctactattgcgcggggctgaaaaaggttaccgaagtgaaaggatacacaaagggcggtcctgggcacgaggaacccatcccgatggctacgtacggatggaacctcgtcaaattacattcaggcaaggacgtgttctttataccacctgagaagtgtgataccctgctttgcgacatcggcgagagctcgcccaatccaactattgaagaggggcgaacactgagagtcctaaaaatggtggaaccctggctcaggggaaaccagttctgtatcaagattctgaatccttatatgccgtctgttgtagagaccttggagcaaatgcagcggaaacacggtggcatgctggtgcgcaaccccctcagtagaaattccactcatgaaatgtactgggtcagctgcgggacaggaaacatcgtgtcagcagttaatatgacctccaggatgcttctgaaccgatttacgatggcccaccggaagccaacctatgagcgtgatgtggacttaggcgctggtacaagacacgtcgccgtggaacctgaggtagcaaacctggatattatcgggcagcgcatagaaaatattaaacatgagcacaagtctacttggcattacgacgaggataacccctataagacctgggcctaccacggaagctatgaagtgaaacctagtggctccgctagctctatggttaatggcgtcgtgaagttgctcacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctgtggggtttcctatcacgcaacaagaaacccaggatatgtactcgagaggaatttacccggaaggtgagaagtaatgccgcaatcggcgccgtcttcgtggacgagaaccaatggaactccgctaaagaggccgttgaagatgagaggttttgggaccttgtgcatcgcgaacgtgagctgcacaagcaggggaagtgcgcgacatgcgtctacaacatgatgggaaaacgggaaaagaaactcggcgagttcggtaaggcaaaagggagcagagccatttggtacatgtggctgggagctaggttcttggagtttgaagccctgggcttcatgaatgaggatcactggttttctcgcgaaaactcgctctcaggcgtggagggggagggacttcataagctgggttatatcttacgagacattagcaaaatcccgggcgggaatatgtacgcagatgacacggctggatgggatacccggataactgaagacgatctgcagaacgaggccaagatcacagacattatggaacctgagcacgctttgctcgccaagtccatcttcaaactgacctatcagaataaggtagttagagtgcaaaggccagccaagaacggcactgtcatggatgtgattagtcgcagagaccagcggggttctggacaggtgggaacatacggcctaaatacctttacaaacatggaagcgcagcttatcaggcaaatggagagcgagggcatattctccccctcagaactggagactcctaacctcgccgggcgtgtcctggattggttggaaaagcatggagttgagcgattaaaacgcatggctattagtggtgacgactgtgtggtaaagccaatcgatgacagatttgccaccgcactgacggctctcaatgatatgggcaaggtgcggaaagacatcccccagtgggaaccgtctaaggggtggaacgattggcagcaggtccctttctgcagccaccactttcatcaacttattatgaaagacggaagggagatagtggttccctgtcgcaatcaggatgagctggtgggcagagcccgggtctcccagggtgcagggtggtcactaagggacaccgcctgcctgggaaagagctatgcgcagatgtggcaactcatgtacttccaccgacgtgatttgagactggctgccaacgcaatctgttctgccgtgccagtagactgggttcctacatcccgcactacctggagtattcatgctcaccatcagtggatgacaactgaagatatgcttagcgtgtggaatcgggtctggatcgaggaaaacccctggatggaggacaaaacccacatttcgtcctggggcgacgtgccatatctgggcaagagggaagatcagtggtgcgggtctctcatcggattaacggccagagcaacatgggctaccaatatacaagttgccatcaaccaggtgcgccggctgattggtaatgagaactacttggactacatgacttcaatgaagaggtttaaaaatgagagcgatcccgaaggcgcgctgtggtga

SEQ ID NO: 13996 - RNA, 9879 nt, synthetic construct
  misc_feature 1..9879: note = derived and/or modified CDS sequence (opt3) from DENV-1__EU249494__SS-prME
  source 1..9879: mol_type = other RNA
tccgtgaccatgctgctcatgcttatgcccaccgccctggctttccacttgactacgaggggaggggaacctcatatgatcgtcaccaagcaggaaaggggaaaatccttactgtttaagacatctgcgggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggccatggtccaggcagattctggatgcgtgatcaactggaaaggccgcgaacttaagtgtggttcagggatcttcgtgactaatgaggtccacacctggacggaacaatataagtttcaggccgacagtccgaaaagattgagcgctgccattggaaaggcatgggaggagggcgtttgcggtataaggtccgctacacggctggaaaacatcatgtggaaacagatttctaacgagctcaatcatatcctgttagaaaacgacatgaagttcaccgtggtggtaggcgatgtcgtggggattctggcccagggcaaaaagatgatccgccctcaacccatggagcacaaatactcgtggaaaagctggggcaaggcgaagataatcggggccgacgttcagaatactacctttattatcgatggaccaaacacacctgaatgtcccgacgatcagagagcttggaatatttgggaggtggaggactatggcttcggtatctttactaccaacatatggcttaagttgagggattcctacacacaggtctgcgaccaccgtctcatgtcagcagccattaaagatagtaaggctgtgcatgccgacatggggtattggatcgaatctgagaaaaatgaaacgtggaagctggcacgggcgagcttcattgaggttaagacctgtatctggccaaaatcccacactctatggtcaaacggagtgctggaaagcgagatgataatccccaagatttacggcggtcctatctctcaacataattatcgaccaggctacttcacacagaccgccgggccgtggcacctcggaaaactggagcttgattttgacttgtgcgaaggcactacagtagtcgtggatgagcactgcgggaacagaggaccctccctgaggaccacgactgtgaccggcaagattatccatgaatggtgttgccgcagttgtacattacctccactccggttcaaaggtgaggacgggtgctggtacggaatggagataagacccgtcaaggaaaaggaggaaaatctggttaaaagcatggtgtctgctggctccggtgaggtagactcatttagtcttggcctgttgtgtattagcatcatgatcgaagaggtgatgaggtcgcgctggtcccgaaagatgctcatgaccgggactctggccgtcttcctactgctcattatgggacagctgacatggaacgatcttatccggttgtgcattatggtgggcgcaaatgcttctgaccgtatggggatgggaaccacatatctggccttaatggcaacttttaaaatgagacctatgttcgccgttggcctcctgtttaggcgccttaccagccgggaggtgctgctactcacgataggtctgtcattggtcgctagtgtggaactgccaaactccttagaggaactcggggatggactggcgatgggcatcatgattcttaagctgttgacagacttccaatctcaccagctctgggccaccctgctaagcctgacttttatcaaaaccacactttccctccattacgcatggaagactatggctatggttctgtcaattgtgagcttgttccccctgtgtttaagtaccacgtctcagaagacaacctggctcccggtcctgcttggctccctggggtgcaaacctttgactatgtttctcatcgccgagaataagatatggggaagaaaaagctggccactgaacgaaggtatcatggccgtaggcgtggtttcgattctactgtcatctcttctcaagaacgatgtgcccctggctgggcctttgatcgcaggaggcatgttaattgcctgttatgtcatcagtggttccagcgcggacctgtctctcgagaaagctgccgaggtgagctgggaagaggaagcagagcactccggggcctcacataatatactggtagaagtgcaggatgacggaacaatgaagattaaagatgaggagagggacgatacccttactatcctgttgaaggctacactactggcagtcagtggcgtttaccccctcagcatcccagccaccctgttcgtgtggtatttttggcaaaagaaaaagcagcgatctggcgtgctttgggacacgccttcacccccagaagtcgagcgcgcggtgttagatgacgggatttaccggataatgcagagaggactgctcggtaggagccaggttggcgtaggggtgttccaagaaaacgtcttccacactatgtggcacgtgacccgtggagctgttttgatgtatcagggcaaacgcctggagccgagttgggccagcgtgaagaaagacctcatctcctacggtgggggatggcggctgcagggctcttggaatacaggcgaggaagtccaggtgattgcagtagagcctgggaagaaccccaagaatgtccaaaccgccccaggaacatttaaaactcccgaaggtgaggtgggcgctatcgcccttgatttcaagcctgggacctcgggaagcccaattgttaacagagaaggcaaaatcgtgggtctgtacgggaatggagtcgtgacgacatcaggcacttatgtttccgcaatagctcaggccaaggcgagtcaggagggccccttgcctgagatcgaagacgaggtgtttaggaaacgaaacctaaccattatggatctgcatccggggtctggaaagacacggcgctacctcccagccatcgtcagagaagcaattaagaggaaattacggaccctgatccttgctcccactcgagtggtagccagcgagatggctgaagcactgaagggtatgcctataagatatcaaaccacagccgtgaaatccgagcacacgggcaaggagattgttgacctcatgtgccatgccactttcaccatgcgcttgctgtcaccagtcagggtgcccaattacaacatgatcatcatggatgaagctcactttacagacccttctagcattgcggcacgtgggtatatcagtacccgggtgggaatgggcgaggccgctgccatattcatgactgcaacaccgcccggttccgtcgaagcctttccacagagcaatgctgtaattcaggatgaggaaagagacatccctgagaggtcttggaactcagggtacgagtggattaccgatttccccggaaaaacggtgtggtttgttccatccatcaagagtggcaatgacatagcgaactgtctccgcaagaatggcaaacgagtgattcagctgagcagaaagactttcgatacagaatatcagaaaaccaagaacaacgactgggactacgtcgtgaccactgatatctcggagatgggggccaattttcgggcagacagggttatcgatcctcgccgttgccttaaacccgtgattctaaaggacggaccagaaagagtcatcctggctggtccgatgcctgtgacagtagcctctgcagcccagcggaggggccgcattgggcgaaaccataataaggagggagatcagtacatatatatgggccagcccttgaacaatgacgaggatcacgctcactggaccgaagccaaaatgttactggacaacatcaatacaccagagggtattatccccgcactcttcgaacctgagagagaaaagtccgcagccatcgatggggagtaccggctgaggggcgaggctcgcaaaactttcgtggaacttatgagaaggggagacctgccagtttggctcagctataaggtcgcctcagagggctttcaatacagtgatcggcgttggtgcttcgacggggaacgcaacaatcaggtgttggaggaaaacatggatgtggagatttggacgaaagagggagaacgaaagaaactgagacccaggtggctagacgctcggacctattctgaccctctggcactccgcgagtttaaggagttcgccgctggtagaaggtccgtcagcggcgatcttatactggagatcgggaagttaccgcagcatttgacacagcgggcccaaaatgcactggacaacctcgttatgctgcacaattcagaacagggaggccgagcgtacagacatgccatggaggagcttccagatactattgaaaccctgatgctcttggctctgatcgccgtgttaacaggtggggtaaccctatttttcctgagtggccgcggactcggcaaaactagcattgggcttctgtgtgtgatggcatcctctgtcttgctgtggatggctagcgtggagccccactggatcgccgcatccataatcctcgaatttttcctgatggttcttctcattcctgagcccgacaggcagcggacgccacaggataaccaactggcctatgtggtcatcggattgctgtttatgattttaaccgtagctgcgaatgagatgggtctactggaaacaactaagaaagacctcggcatcgggcacgtggccgttgagaaccatcaccatgcaaccatgcttgatgtggacctgcaccctgcttcagcctggacattgtacgccgtcgcaaccactataattacacccatgatgcgtcatacgatcgaaaacaccactgctaatatttctctgacagccatcgcgaaccaggctgccatactcatgggactggataagggctggccaatcagtaaaatggacattggtgtgcctcttttagcactggggtgctactcgcaggtcaatccgctcaccttgaccgccgctgtgctgatgctagttgcacactatgccatcattggccccggactgcaagcgaaggctacaagagaggcccagaagaggactgcagccggcatcatgaaaaacccaacggtggatgggatagtagctattgacctcgatcctgtggtctacgacgccaagttcgaaaaacagcttggacagatcatgctgttgatcctgtgtaccagccaaattctcctgatgcgcacaacttgggcattatgcgagtccatcacccttgctacaggccccctgaccactctctgggagggttctccagggaagttttggaatacgacaatagccgtttcaatggcgaacattttccggggaagctatctagccggcgcaggtctggctttttccttgatgaaaagtctgggcgggggacgaagaggcaccggggcccagggagaaactctcggcgagaagtggaagaggcagcttaatcagctgtctaaaagcgagttcaacatctacaagcgctcaggtattatggaggtggaccggtccgaagcaaaagaggggttgaagagaggagagaccacacgtcacgctgtcagtaggggcactgccaaactgcggtggttcgtggaacgcaatctcgtaaagcctgagggtaaggtgatcgatttaggctgtgggcgaggaggctggagctattactgcgccgggctgaaaaaggttaccgaagtgaaaggatatacaaagggcggtcccgggcatgaggaaccgataccaatggcgacgtacggatggaaccttgtcaaactgcactctggcaaggacgtgtttttcacccctcccgagaaatgtgatactctactctgcgacatcggcgagtcctcaccaaatcccacaattgaagaggggagaaccctgagggtcttgaagatggtggaaccttggctgcggggaaaccaattttgtatcaagattctcaatccgtacatgcccagcgttgtagagactcttgagcagatgcagcgcaaacatggtggcatgctggtgagaaacccattatcgagaaattctacacacgaaatgtattgggtcagttgcgggaccggaaacatcgtgtccgctgttaatatgacgagccgaatgctgttgaaccggttcaccatggcacaccgtaagcctacatacgagagagatgtggacctcggcgccggtactcgccatgtcgctgtggaacccgaggtagccaacctggatattatcgggcagaggatagaaaatattaaacacgagcataagtcaacctggcactatgacgaggataacccttacaaaacatgggcatatcatggatcctacgaagtgaagccatctggcagcgccagttccatggttaatggcgtcgtgaagctacttactaaaccctgggacgtgatccctatggtcacccaaatcgctatgacagataccactccatttgggcagcagcgggttttcaaggagaaagtggacacgagaacacccaaggcgaaacgcggaaccgcccaaattatggaagtaactgcaaggtggctgtggggttttctcagccgaaacaagaagccgcggatatgtaccagagaggagttcacaaggaaagtgcgctctaatgctgccatcggcgcagtctttgtggacgagaaccagtggaactcagccaaggaggctgttgaagatgagcgtttctgggacctggtgcagaaagaacgggagttgcacaagcaggggaaatgcgccacgtgcgtctataacatgatgggaaagagagaaaagaaactgggcgagtttggtaaggcgaaagggagtagggcaatttggtacatgtggctcggagcccgcttccttgagtttgaagctctgggcttcatgaatgaggatcactggttctcccgagaaaacagcttatctggcgtggagggggagggactgcataagttgggttacatcctccgggacatttcgaaaatccctggcgggaatatgtatgccgatgacaccgcaggatgggatactagaataacagaagacgatctgcaaaacgaggctaagatcaccgacattatggaaccagagcacgccctacttgctacttcaatctttaaactgacataccagaataaggtagttagggtgcagcgccccgccaagaacggcaccgtcatggatgtgattagcagacgggaccagaggggttccgggcaagtgggaacatatggcctcaatactttcaccaacatggaagcacagctgatccgtcagatggagagtgagggcatattttctcctagcgaattggagattccaaacttagcggaacgagtcctggattggctcgagaaatacggggttgaacgccttaagagaatggccatctccggagacgactgtgtggtaaaacccatcgatgaccggttcgctacggccctgaccgcactaaatgatatgggtaaggtgaggaaagacgtcccgcagtgggagccttcaaagggctggaacgattggcaacaggtgcccttttgcagtcatcacttccaccagctgattatgaaggacgggcgcgagatagttgtgccatgtagaaatcaggatgaactcgtcggacgggctagggtgtctcaaggcgccggttggagcttgcgagagacagcatgcctggggaaatcctatgcccagatgtggcagcttatgtactttcatcgtagagacctgcgcctcgcggctaacgccatctgttcagcagtacctgttgattgggtgcccactagccggaccacatggtctattcacgcccatcaccaatggatgactaccgaagacatgttatccgtctggaatagggtgtggatcgaggaaaacccatggatggaggataagacgcatgttagtagctggggagacgtgccctatctgggcaaaagagaggaccagtggtgcggctcgttgattgggctgacagctcgcgccacctgggcatccaatatccaggtcgctataaaccaggtgcggaggctcatcggaaatgaaaactaccttgattgtatgacttctatgaagcgattcaaaaatgagggtgaccctgaaggcgccctgtggtga

SEQ ID NO: 13997 - RNA, 9879 nt, synthetic construct
  misc_feature 1..9879: note = derived and/or modified CDS sequence (opt3) from DENV-1__EU249495__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacaactgcaggtgttaacatgtgcaccctaattgccatggacctcggcgagctgtgtgaagatacaatgacctacaaatgcccacggataactgaggcggaaccggacgatgtggactgttggtgcaatgctacagatacctgggtaacgtatgggacttgttctcaaaccggagagcaccgccgagacaagcgttcagtggcccttgcaccccatgtcggcctgggtttggagacaagaactgaaacctggatgagtagcgagggggcctggaaacagatccagagggtggaaacatgggctctccggcaccctggattcaccgttattgcactgtttctggcccatgctatcggcacgtccattactcagaagggcatcatattcatcctcttaatgctggtgacaccatctatggccatgcgctgcgtcgggattggatcgagagattttgtggagggtctttcaggcgcgacctgggtagacgttgtgttggagcacgggagctgtgtcactacaatggcaaaggataaacccaccctggacatcgaactactcaagacggaggtgaccaaccctgccgtgctgaggaaactttgcattgaagctaagatcagtaatacaactaccgattcccggtgtccaacacaaggagaggccactctgatggaagagcaggacgcaaacttcgtctgccgccgaacctttgttgatagaggctggggtaatgggtgtggattgttcggcaaaggctctctcataacatgcgctaagtttaagtgcgtgaccaaactggaggggaagattgtacagtacgaaaacttaaaatatagcgtgatcgtcactgtgcacacgggagaccagcatcaagttggtaatgagtccacagaacacggcaccactgccaccattacaccccaggcgcctacctcagagatccagctgactgactacggggccctcacacttgattgtagtccaaggacgggactggacttcaacgaaatggtgttgctaaccatgaaggagaaaagctggctggtccataagcagtggtttctcgatctgccgcttccctggacttctggcgcatccacatcacaagagacctggaatcggcaggacctgttggtgacattcaaaactgctcacgccaagaagcaggaagtagttgtgctcggtagccaagagggggctatgcacaccgccctgacgggcgcaaccgaaatccagacaagtggaactaccacaatttttgccggccatttaaaatgccgtctgaagatggataaactaactctcaaggggatgtcttatgtcatgtgtaccggatccttcaaactggagaaggaagtggctgagacgcagcacggtacagtccttgtgcagataaagtacgagggcaccgacgcgccttgcaaaatcccattcagcactcaagatgaaaagggggttattcagaacggacgcttgatcacagcaaatcccatagtgaccgacaaagagaagcctgtaaacattgaagccgagccaccctttggcgagtcgtatatcgtcatcggtgtgggggaaaaagctctgaagctctcttggttcaagaaaggctcctcaattggaaagatgtttgaggccactgcaagaggcgccaggcggatggctatcctgggggataccgcctgggacttcggaagtattggtggcgtttttacaagcgtggggaaacttgtccatcagatattcggaacggcatacggcgtgctgttttccggtgtatcttggaccatgaagatcgggattggcgtgttgctcacttggctgggattaaatagccgatcaacaagtctgtccatgacctgtatcgcggttggcctagtcacactctacctgggggtgatggtgcaggctgatagcggatgcgtcatcaactggaaaggccgcgaacttaagtgtggttctgggattttcgttactaatgaggtgcacacctggacggaacaatataagtttcaggccgactcaccgaaaagattgagtgcagccataggaaaggcttgggaggagggcgtgtgcggtatcaggagcgccacacggctggaaaacattatgtggaaacagatctccaacgagctcaatcatattctgttagaaaacgacatgaagttcaccgtagtcgtgggcgatgttgtggggatcctggcacagggaaaaaagatgatacgccctcaacccatggagcacaaatactcttggaagtcgtggggcaaggctaaaatcattggggccgacgtccagaatactacctttatcattgatggaccaaacacacctgaatgtcccgacgatcagagagcgtggaatatctgggaggtggaggactatggcttcggtatatttactaccaacatttggcttaagttgagggatagctacacacaggcctgcgaccaccgtctcatgtccgctgcaatcaaagattcaaaggccgttcatgctgacatggggtattggattgaaagtgagaaaaatgaaacgtggaagctggcccgggcatctttcatcgaggtgaagacctgtatatggccaaaaagccacactctatggtccaacggagtactggaatcagagatggtcatccccaagatttacggcggtcctatcagccaacataattatcgaccaggctacttcacacagaccgcggggccgtggcacctcggaaaactggagcttgattttgacttgtgcgaaggcactacagtggtggtcgatgagcactgcgggaacagaggaccctctctgaggaccacgactgttaccggcaagattatccatgaatggtgttgccgctcctgtacattacctccactccggttcaaaggtgaggacgggtgctggtacggaatggagataagacccgtgaaggaaaaggaggaaaatctggtaaaaagtatggtgagcgccggctctggtgaggtcgactccttttcacttggcctgttgtgtattagtatcatgatcgaagaggtgatgaggagccgctggtcgcgaaagatgctcatgaccgggactctggctgttttcctactgctcattatgggacagctgacatggaacgatcttatccggttgtgcattatggtgggcgccaatgcatccgaccgtatggggatgggaaccacatatctggctttaatggccacttttaaaatgagacctatgttcgcagtcggcctcctgtttaggcgccttacctctcgggaggtgctgctactcacgataggtctgagcttggttgcctcagtggaactgccaaacagtttagaggaactcggggatggactggctatgggcatcatgattcttaagctgttgacagacttccaatcccaccagctctgggcgaccctgctatctctgacttttatcaaaaccacacttagcctccattacgcctggaagactatggcaatggtcctgtccattgtatcattgttccccctgtgtttaagcaccacgagtcagaagacaacctggctcccggtgctgcttggctctctggggtgcaaacctttgactatgtttctcatcgctgagaataagatatggggaagaaaatcctggccactgaacgaaggtatcatggccgttggcgtggtcagcattctactgtcgtcacttctcaagaacgatgtgcccctggccgggcctttgatcgctggaggcatgttaattgcatgttatgtaatctctggtagttccgccgacctgagcctcgagaaagcggctgaggtgtcttgggaagaggaagccgagcacagcggggcatcccataatatactggtcgaagttcaggatgacggaacaatgaagattaaagatgaggagagggacgatacccttactatcctgttgaaggccacactactggctgtgtcaggcgtgtaccccctcagtatcccagcaaccctgttcgtctggtatttttggcaaaagaaaaagcagcgaagcggcgtgctttgggacacgccttctcccccagaagttgagcgcgccgtattagatgacgggatttaccggataatgcagagaggactgctcggtaggtcccaggtgggcgtcggggtgttccaagaaaacgttttccacactatgtggcacgtgacccgtggagcggtcttgatgtatcagggcaaacgcctggagccgtcatgggctagtgtgaagaaagacctcatcagctacggtgggggatggcggctgcagggctcctggaatacaggcgaggaagtacaggtcattgccgtggagcctgggaagaaccccaagaatgttcaaaccgcaccaggaacatttaaaactcccgaaggtgaggtgggcgccatcgctcttgatttcaagcctgggacctctggatcgccaattgtcaacagagaaggcaaaatcgtgggtctgtacgggaatggagttgtgacgacaagcggcacttatgtctcagccatagcacaggctaaggcctcccaggagggccccttgcctgagatcgaagacgaggtgtttaggaaacgaaacctaaccattatggatctgcatccggggagtggaaagacacggcgctacctcccagcgatcgtaagagaagccattaagaggaaattacggaccctgatccttgcacccactcgagtggttgcttctgagatggccgaagctctgaagggtatgcctataagatatcaaaccacagcagtcaaaagcgagcacacgggcaaggagattgtggacctcatgtgccatgccactttcaccatgcgcttgctgtccccagtgagggtccccaattacaacatgatcatcatggatgaagcccactttacagacccttcatctattgctgcgcgtgggtatatcagcacccgggtaggaatgggcgaggcagccgctatattcatgactgccacaccgcccggtagtgtggaagcatttccacagtccaatgccgttattcaggatgaggaaagagacatccctgagaggagctggaactctgggtacgagtggattaccgatttccccggaaaaacggtgtggtttgtcccatcaatcaagtccggcaatgacatagctaactgtctccgcaagaatggcaaacgagtgattcagctgagtagaaagactttcgatacagaatatcaaaaaaccaagaacaacgactgggactacgttgtgaccactgatatcagcgagatgggggcgaattttcgggccgacagggtcatcgatcctcgccgttgccttaaacccgtgattctaaaggacggaccagaaagagtaatcctggcaggtccgatgcctgtgacagttgcttcggccgcacagcggaggggccgcattgggcgaaaccataataaggagggagatcagtacatatatatgggccagcccttgaacaatgacgaggatcacgcccactggaccgaagctaaaatgttactggacaacatcaatacaccagagggtattatccccgccctcttcgaacctgagagagaaaagtctgcggcaatcgatggggagtaccggctgaggggcgaggcccgcaaaactttcgtcgaacttatgagaaggggagacctgccagtgtggctctcctataaggtggctagcgagggctttcaatactcagatcggcgttggtgcttcgacggggaacgcaacaatcaggtcttggaggaaaacatggatgttgagatttggacgaaagagggagaacgaaagaaactgagacccaggtggctagacgcccggacctatagtgaccctctggctctccgcgagtttaaggaattcgcagccggtagaaggtctgtgtccggcgatcttatactggagatcgggaagttaccgcagcatttgacacagcgggctcaaaatgccctggacaacctcgtaatgctgcacaatagcgaacagggaggccgagcatacagacatgcgatggaggagcttccagatactattgaaaccctgatgctcttggccctgatcgctgtgttaacaggtggggtcaccctatttttcctgtcaggccgcggactcggcaaaactagtattgggcttctgtgtgtgatggccagctccgttttgctgtggatggcatctgtggagccccactggatcgctgccagcataatcctcgaatttttcctgatggtccttctcattcctgagcccgacaggcagcggacgccacaggataaccaactggcatatgtagtgatcggattgctgtttatgattttaaccgttgccgctaatgagatgggtctactggaaacaactaagaaagacctcggcatcgggcacgtggcggtcgagaaccatcaccatgccaccatgcttgatgtggacctgcaccctgcatccgcttggacattgtacgccgtcgccaccactataattacacccatgatgcgtcatacgatcgaaaacaccactgcaaatatttcactgacagctatcgccaaccaggcggctatactcatgggactggataagggctggccaatctctaaaatggacattggtgtgcctcttttagccctggggtgctacagtcaggttaatccgctcaccttgaccgcagccgtgctgatgctagtagctcactatgcaatcattggccccggactgcaagccaaggcgacaagagaggctcagaagaggactgccgcaggcatcatgaaaaacccaacggtggatgggatagtcgccattgacctcgatcctgttgtgtacgacgctaagttcgaaaaacagcttggacagatcatgctgttgatcctgtgtacctcgcaaattctcctgatgcgcacaacttgggccttatgcgagagcatcacccttgcaacaggccccctgaccactctctgggagggttccccagggaagttttggaatacgacaatagctgtctctatggccaacattttccggggatcatatctagcgggcgccggtctggcatttagcttgatgaaatccctgggcgggggacgaagaggcaccggggctcagggagaaactctcggcgagaagtggaagaggcagcttaatcagctgagtaaatctgaattcaacatctacaagcgcagcggtattatggaggtggaccggtcagaagccaaagaggggttgaagagaggagagaccacacgtcacgcagtatccaggggcactgctaaactgcggtggttcgtggaacgcaatctcgttaagcctgagggtaaggtgatcgatttaggctgtgggcgaggaggctggagttattactgcgccgggctgaaaaaggtcaccgaagtgaaaggatatacaaagggcggtcccgggcatgaggaaccgataccaatggccacgtacggatggaaccttgtcaaactgcacagcggcaaggacgtgtttttcacccctcccgagaaatgtgatactctactctgcgacatcggcgagtcttccccaaatcccacaattgaagaggggagaaccctgagggttttgaagatggtagaaccttggctgcggggaaaccaattttgtatcaagattctcaatccgtacatgccctcagtggtcgagactcttgagcagatgcagcgcaaacatggtggcatgctggtgagaaacccattaagcaggaattcgacacacgaaatgtattgggtttcttgcgggaccggaaacatcgtgagtgcggtcaatatgacgtcccgaatgctgttgaaccggttcaccatggctcaccgtaagcctacatacgagagagatgtggacctcggcgcaggtactcgccatgtagccgtggaacccgaggttgctaacctggatattatcgggcagaggatagaaaatattaaacacgagcataagagcacctggcactatgacgaggataacccttacaaaacatgggcctatcatggatcatacgaagtcaagccatccggctctgcaagcagtatggtgaatggcgtggtcaagctacttactaaaccctgggacgttatccctatggtgacccaaatcgccatgacagataccactccatttgggcagcagcgggtattcaaggagaaagtggacacgagaacacccaaggctaaacgcggaaccgcgcaaattatggaagtcactgccaggtggctgtggggttttctctcccgaaacaagaagccgcggatatgtaccagagaggaattcacaaggaaagtgcgcagcaatgcagctatcggcgccgtttttgtggacgagaaccagtggaattctgcaaaggaggccgtcgaagatgagcgtttctgggacctggtgcagaaagaacgggagttgcacaagcaggggaaatgcgctacgtgcgtatataacatgatgggaaagagagaaaagaaactgggcgagtttggtaaggccaaagggtcaagggcgatttggtacatgtggctcggagcacgcttccttgagtttgaagccctgggcttcatgaatgaggatcactggttcagtcgagaaaactccttaagcggcgttgagggggagggactgcataagttgggttacatcctccgggacatttctaaaatccctggcgggaatatgtatgctgatgacaccgccggatgggatactagaataacagaagacgatctgcaaaacgaggcaaagatcaccgacattatggaaccagagcacgctctacttgccacttcgatctttaaactgacataccagaataaggtggtcagggtgcagcgccccgctaagaacggcaccgtgatggatgtcatttcaagacgggaccagaggggtagcgggcaagttggaacatatggcctcaatactttcaccaacatggaagcccagctgatccgtcagatggagtccgagggcatatttttgcctagtgaattagagacgccaaacctggcagaacgagtgctcgattggcttgagaaacatggggtagaacgcctgaagagaatggcgatttctggagacgactgtgtggtcaaacccatcgatgaccggttcgccaccgctctaacagccctgaatgatatgggtaaggtgaggaaagacatcccgcagtgggagcctagcaagggctggaacgattggcaacaggttcccttttgctcccaccacttccatcagctcattatgaaggacgggcgcgagatagtggtcccatgtagaaatcaggatgaattggtgggacgggcaagggtatcacaaggcgctggttggagtctgcgagagactgcctgccttgggaaatcttacgcacagatgtggcagctgatgtattttcaccgtagagacctccgcttagccgcgaacgctatctgtagcgccgttcctgtggattgggtccccacctcccggacaacttggtcaattcatgcacaccatcaatggatgaccacggaagacatgctgagcgtgtggaatagggtttggatcgaggaaaacccatggatggaggataagacacacgtgtcttcctggggagacgtcccctacttgggcaaaagagaggaccagtggtgcggcagtctgattgggctcaccgcccgcgctacttgggccagcaatatccaggtggcaataaaccaggtacggaggcttatcggaaatgaaaactatctggattacatgacatcgatgaagcgattcaaaaatgagggtgaccctgaaggcgctctatggtga

SEQ ID NO: 13998 - RNA, 9879 nt, synthetic construct
  misc_feature 1..9879: note = derived and/or modified CDS sequence (opt3) from DENV-1__EU482794__SS-prME
  source 1..9879: mol_type = other RNA
agcgtgaccatgctgctcatgcttatgcccaccgcactggctttccacttgactacgagaggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgctagcttgttccccctgtgtttaagtaccacgtctcagaagacaacctggctcccggtactgcttggctccctggggtgcaaacctttgactatgtttctcattacagagaccaagatctggggaagaaaaagctggccactgaatgaaggtataatggccgtgggcgttgtgtcgatcctactgtcatctcttctcaagaacgatgtccccctggccgggcctttgattgctggaggcatgttaatcgcatgttatgtgattagtggttccagcgccgacctgtctctcgagaaagcggctgaggtaagctgggaagaggaagccgagcactccggggcatcacataacatcctggtggtcgttcaggatgacggaactatgaagataaaagatgaagagagggacgatacacttaccattctgttgaaggccacgctactggctgtgagtggcgtgtaccccctcagcatcccagcaactctgttcgtctggtatttttggcaaaagaaaaagcagcgatctggcgtgctttgggacaccccttcacccccagaggttgaacgcgccgtattagatgacgggatctaccggattatgcagagaggactgctcggtaggagccaggtgggcgtcggggtgttccaagagaatgttttccacacaatgtggcacgtgacccgtggagcggtcttgatgtatcagggcaaacgcctggaaccgagttgggctagcgtgaagaaagacctcatatcctacggtgggggatggcggctgcagggctcttggaacacaggcgaggaggtacaggtcatcgccgtggaacctgggaagaatcccaagaacgttcaaactgcaccaggaacctttaaaacgcccgagggtgaagtgggcgccattgctcttgatttcaagcctgggacatcgggaagcccaatcgtcaatagagagggcaaaattgtgggtctgtacgggaacggagttgtgactacctcaggcacatatgtctccgccatcgcacaggctaaggccagtcaggaaggccccttgcctgagatagaggacgaagtgtttaggaaacgaaatctaaccatcatggatctgcatccggggtctggaaagactcggcgctacctcccagcgattgtaagagaggccatcaagaggaaattacggaccctgattcttgcacccacacgagtggttgctagcgaaatggccgaggctctgaagggtatgcctatcagatatcaaacgactgcagtcaaatccgaacacaccggcaaggagatagtggacctcatgtgccatgccacattcaccatgcgcttgctgtcaccagtgagggtccccaactacaatatgattatcatggatgaggcccactttactgacccttctagcatcgctgcgcgtgggtatattagtacacgggtaggaatgggcgaagcagccgctatcttcatgaccgccacgccgcccggttccgtggaggcatttccacagagcaacgccgttatacaggatgaagagagagacattcctgaaaggtcttggaactcagggtacgagtggatcactgatttccccggaaaaacagtgtggtttgtcccatccattaagagtggcaacgacatcgctaattgtctccgcaagaacggcaaacgagtgatacagctgagcagaaagaccttcgataccgagtatcagaaaactaagaataacgactgggactacgttgtgacaaccgatatttcggaaatgggggcgaactttcgggccgacagggtcatcgatcctcgccgttgccttaaacccgtgatcctaaaggacggaccagagagagtaattctggcaggtccgatgcctgtgacagttgcttctgccgcacagcggaggggccgcatcgggcgaaattacaacaaggaaggagatcagtatatttacatgggccagcccttgaataacgacgaggatcatgcccactggactgaggctaaaatgttactggacaatataaacacgccagaaggtatcattcccgccctcttcgagcctgaaagagagaagtccgcggcaatcgatggggaatatcggctgaggggcgaggcccgcaaaaccttcgtcgagcttatgagaaggggagacctgccagtgtggctcagctacaaggtggcttcagaaggctttcaatatagtgatcggcgttggtgcttcgacggggagcgcaataaccaggtcttggaagagaatatggatgttgaaatctggacaaaagagggagagcgaaagaaactgagacccaggtggctagacgcccggacttactctgaccctctggctctccgcgaatttaaggagttcgcagccggtagaaggtccgtgagcggcgatcttattctggaaatagggaagttaccgcagcacttgacccagcgggctcaaaacgccctggacaatctcgtaatgctgcataactcagagcagggaggccgagcatatagacacgcgatggaggaacttccagatacaatcgagaccctgatgctcttggccctgattgctgtgttaactggtggggtcacgctatttttcctgagtggccgcggactcggcaaaaccagcatcgggcttctgtgtgtgatggcctcctctgttttgctgtggatggcaagcgtggaaccccattggattgctgcctccatcatactcgagtttttcctgatggtccttctcatccctgaacccgacaggcagcggacaccacaggataatcaactggcatacgtagtgattggattgctgtttatgatcttaactgttgccgctaacgagatgggtctactggagaccacaaagaaagacctcggcattgggcacgtggcggtcgaaaatcaccatcacgccaccatgcttgatgtggacctgcatcctgcatcagcttggactttgtacgccgtcgccacaacgatcataacccccatgatgcgtcacactattgagaacacaaccgcaaacatctctctgaccgctattgccaatcaggcggctatcctcatgggactggataagggctggccaataagtaaaatggacatcggtgtgcctcttttagccctggggtgctattcgcaggttaacccgctcacattgactgcagccgtgctgatgctagtagctcattacgcaattatcggccccggactgcaagccaaggcgacgagagaagctcagaagaggaccgccgcaggcattatgaaaaatccaacagtggatgggatcgtcgccatagacctcgatcctgttgtgtatgacgctaagttcgagaaacagcttggacagattatgctgttgatcctgtgtactagccaaatcctcctgatgcgcaccacatgggccttatgcgaatccattacccttgcaactggccccctgacgacactctgggagggttctccagggaagttttggaacaccactatcgctgtctcaatggccaatatattccggggaagctacctagcgggcgccggtctggcattttccttgatgaaaagtctgggcgggggacgaagaggcaccggggctcagggagagacactcggcgaaaagtggaagaggcagcttaaccagctgtctaaaagcgagttcaatatttataagcgctcaggtatcatggaagtggaccggtccgaggccaaagaagggttgaagagaggagagactacccgtcacgcagtaagtaggggcacagctaaactgcggtggttcgtggagcgcaacctcgttaagcctgaaggtaaggtgattgatttaggctgtgggcgaggaggctggagctactattgcgccgggctgaaaaaggtcacggaggtgaaaggatacaccaagggcggtcccgggcacgaggagccgatcccaatggccacttacggatggaatcttgtcaaactgcattctggcaaggacgtgtttttcacacctcccgaaaaatgtgataccctactctgcgacataggcgagtcctcaccaaaccccactatcgaggaagggagaacactgagggttttgaagatggtagagccttggctgcggggaaatcaattttgtattaagatcctcaacccgtatatgcccagcgtggtcgaaacccttgagcagatgcagcgcaaacacggtggcatgctggtgagaaatccattatcgaggaactctacgcatgagatgtactgggttagttgcgggaccggaaatattgtgtccgcggtcaacatgacaagccgaatgctgttgaatcggttcactatggctcaccgtaagcctacctatgaaagagatgtggacctcggcgcaggtacacgccacgtagccgtggagcccgaagttgctaacctggatatcattgggcagaggatcgagaacataaaacatgaacacaagtcaacttggcattacgacgaggataatccttataaaacctgggcctaccacggatcctatgaggtcaagccatctggcagcgcaagttccatggtgaacggcgtggtcaagctacttacaaaaccctgggacgttattcctatggtgacccaaatcgccatgactgatacgacaccatttgggcagcagcgggtattcaaggaaaaagtggacaccagaactcccaaggctaaacgcggaaccgcgcaaatcatggaggtcacagccaggtggctgtggggttttctcagccgaaataagaagccgcggatttgtacgagagaagagttcaccaggaaagtgcgctctaacgcagctataggcgccgtttttgtggacgaaaatcagtggaactcagcaaaggaggccgtcgaggatgaacgtttctgggacctggtgcagaaagagcgggaattgcataagcaggggaaatgcgctacttgcgtatacaatatgatgggaaagagagagaagaaactgggcgaatttggtaaggccaaagggagtagggcgatctggtacatgtggctcggagcacgcttccttgagtttgaggccctgggcttcatgaacgaagatcactggttctcccgagagaatagcttatctggcgttgaaggggagggactgcacaagttgggttatattctccgggacatctcgaaaattcctggcgggaacatgtacgctgatgacacagccggatgggataccagaatcactgaggacgatctgcaaaatgaagcaaagataacagacatcatggagccagaacatgctctacttgccacctcaatttttaaactgacatatcagaacaaggtggtcagggtgcagcgccccgctaagaatggcactgtgatggatgtcatcagcagacgggaccagaggggttccgggcaagttggaacctacggcctcaacacgttcaccaatatggaggcccagctgattcgtcagatggaaagtgagggcatctttttgccttctgagttagaaacaccaaacctggcagagcgagtgctcgattggcttgaaaaatatggggtagagcgcctgaagagaatggcgataagcggagacgactgtgtggtcaaacccattgatgaccggttcgccactgctctaaccgccctgaacgatatgggtaaggtgaggaaagacatcccgcagtgggaaccttccaagggctggaatgattggcaacaggttcccttttgctcacaccatttccaccagctcatcatgaaggacgggcgcgagattgtggtcccatgtagaaaccaggatgagttggtgggacgggcaagggtaagtcaaggcgctggttggtctctgcgagaaacagcctgccttgggaaaagctacgcacagatgtggcagctgatgtattttcaccgtagagacctccgcttagccgcgaatgctatatgttccgccgttcctgtggattgggtccccacttcacggaccacgtggagcatccatgcacaccatcaatggatgacaaccgaggacatgctgtctgtgtggaacagggtttggattgaagagaatccatggatggaagataagactcacgtgtccagttggggagacgtcccctacttgggcaaaagagaggaccagtggtgcggcagcctgatcgggctcacagcccgcgctacctgggcctcgaacattcaggtggcaatcaatcaggtacggaggcttataggaaacgagaattacctggattatatgacttccatgaagcgattcaaaaacgaaggtgaccctgagggcgctctatggtga

SEQ ID NO: 13999 - RNA, 9879 nt, synthetic construct
  misc_feature 1..9879: note = derived and/or modified CDS sequence (opt3) from DENV-1__EU482795__SS-prME
  source 1..9879: mol_type = other RNA
agcgtgaccatgctgctcatgcttatgcccactgcactggctttccacttgactacgagaggcggggaacctcatatgatcgtctccaagcaggaaagggggaaatctttactgtttaagacctcagccggtgttaacatgtgcaccctgattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcagcggccatctgaagtgccgtttaaaaatggataagctgacactaaaagggatgtcgtatgtgatgtgtactggatctttcaagctcgagaaggaagtcgccgagacccagcacggtacggtgctggttcagattaaatacgagggcacagacgctccttgcaagataccattttccacccaggatgaaaaaggggtgactcaaaacggacgccttatcacagcgaatcccattgtaaccgacaaggagaaacctgtcaacatcgaagcagagccacccttcggcgagtcatatatagtgattggtgccggggaaaaggctttgaagctgagttggtttaaaaagggcagctccatcggaaaaatgttcgaggccactgcaagaggcgccaggcggatggctatcctcggggataccgcctgggactttggatctattggtggcgttttcacaagcgtggggaagctggtccatcagatctttggaacggcatacggcgtgcttttctcaggtgtaagttggaccatgaaaattgggataggcgtgctgttgacttggctcggactaaattcccgaagcacatctttatcaatgacctgtatcgcggttggcctggtcacactatacctcggggtgatggtgcaggctgatagtggatgcgtcattaactggaagggccgcgaactgaagtgtggtagcgggatctttgttactaatgaggtgcacacctggacggaacagtataaattccaagccgactccccgaagagactttctgcagccatcggaaaggcttgggaggagggcgtgtgcggtattaggtcggccacacggttggaaaacataatgtggaagcagatcagcaacgagctgaatcatattctcctggaaaacgacatgaaatttaccgtagtcgtgggcgatgttgcagggatcttagctcagggaaagaaaatgattcgccctcagcccatggagtacaagtattcctggaagtcatggggcaaagccaagatcataggggcggacgtgcaaaatactaccttcatcattgatggaccaaacacacctgaatgtcccgacgatcagagagcctggaatatctgggaggtcgaggactacggctttggtattttcactaccaacatctggctgaaacttagggatagttatacacaggtgtgcgaccaccgtttgatgtctgctgcaataaaggatagcaaagccgttcacgctgacatggggtactggattgaatccgagaagaatgaaacgtggaagctcgcccgggcatcattcatcgaggtgaaaacctgtatttggccaaagagccatactctgtggtctaacggagtactagaatccgagatgatcatacccaaaatctatggcggtcctattagtcagcacaattaccgaccaggctactttacacaaaccgcggggccgtggcatctgggaaagctcgagctggatttcgacctttgcgaaggcactacagtcgtggtggatgagcactgcgggaacagaggacccagcttgaggaccacgactgtcaccggcaaaatcattcacgaatggtgttgccgctcttgtacactgcctccattacggtttaagggtgaggacgggtgctggtatggaatggagatcagacccgttaaggaaaaagaggaaaatctcgtgaagtccatggtatcagccggcagtggtgaggtggacagcttctcgctgggccttctgtgtatatccattatgatcgaagaggtcatgaggtctcgctggagccgaaaaatgttgatgaccgggactctcgctgtgtttttcctgctaatcatgggacagctgacatggaacgatctcattcggctgtgcatcatggttggcgccaatgcatcagaccgtatggggatgggaaccacataccttgctttgatggccacttttaagatgagacctatgttcgcagtgggcctgttatttaggcgcctcaccagtcgggaggtcctgcttctgacgattggtctatccctcgtggcctctgttgaactgccaaacagcttggaggaactgggggatggattagctatgggcataatgatcctcaaactgcttacagacttccagtcccatcaactgtgggcgaccttgctctcactgacttttattaagaccacattcagcctacactatgcctggaagactatggcaatggtgctgagtatcgtctctcttctccccctgtgtttgtccaccacgagccagaaaacaacctggctgccggtattactcggctcgctggggtgcaagcctcttactatgtttctgattgctgagaataaaatctggggaagaaagtcatggccattgaacgaaggtataatggccgtgggcatcgtttctattctcctgagttccctactgaaaaacgatgtgccccttgccgggcctctcatcgctggaggcatgctgattgcatgttacgtcatcagcggttctagcgccgacttgtccttagagaaggcggctgaggtgtcatgggaagaggaagccgagcatagtggggcaagccacaatatactggtagaagtgcaggatgacggaacaatgaaaattaaggatgaggagagggacgataccctcactatcctgcttaaggccacactgttggctgtctctggcgtttatcccctatccatcccagcaaccctgttcgtgtggtacttctggcagaaaaagaaacaacgatcaggcgtgctctgggacacgcctagtcccccagaagtcgagcgcgccgtgctggatgacgggatttatcggataatgcagagaggacttttaggtaggagccaggttggcgtaggggtgtttcaggaaaacgtcttccatactatgtggcacgtgacccgtggagcggttctgatgtaccaaggcaagcgcctcgagccgtcctgggcttctgtgaaaaaggacttgatctcgtacggtgggggatggcggctgcagggcagctggaatacaggcgaggaagtccaggtgattgccgtagagcctgggaagaaccccaaaaatgtccagaccgcaccaggaacatttaagacttcagaaggtgaggtgggcgccatcgctctcgatttcaaacccgggacctccggaagtcctattgttaacagagaaggcaagatcgtgggtctgtatgggaatggagtcgtgacgacatctggcacttacgttagcgccatagcacaagctaaagcctcccaggagggcccacttcccgagatcgaagacgaggtgtttaggaagcgaaacctgaccattatggatttgcaccctgggtcaggaaagacacggcgctatctaccggcgatcgtcagagaagccattaaaaggaagctgcggaccctcatcttagcaccaactcgagtggtagcttctgagatggccgaagctctgaaaggtatgcccataagataccagaccacagcagtgaaaagcgagcatacgggcaaagagattgttgaccttatgtgccacgccactttcaccatgcgcctgctcagtcctgtcagggtgccaaattataacatgatcatcatggatgaagcccattttacagacccctccagcattgctgcgcgtgggtacatctctacccgggtgggaatgggcgaggcagccgctatattcatgactgccacacctccgggttcagtcgaagcatttccccaatccaatgccgtaattcaggatgaggaaagagacatcccagagaggagttggaacagcgggtatgagtggattaccgatttccctggaaagacggtgtggtttgttccctcgatcaagtctggcaatgacatagctaactgtttgcgcaaaaatggcaagcgagtgattcagctgtccagacggactttcgatacagaataccagaaaaccaagaacaacgactgggactacgtcgtgaccactgatatcagcgagatgggggcgaatttcagggccgaccgcgttatcgatccacgtagatgcctcaaacctgtgattctgaaggacggacccgaacgggtcatccttgcaggtccaatgccggtgacagtagcttcagccgcacaaaggcgcggccgaattgggagaaaccacaataaggagggagatcagtatatatacatgggccagcctctaaacaatgacgaggatcatgcccactggaccgaagctaaaatgctgttggacaacatcaatacacccgagggtattatcccagccttatttgaacccgagcgggaaaagagtgcggcaatcgatggggagtataggctgcgcggcgaggccagaaaaactttcgtggaactcatgaggcggggagacctgcctgtttggctttcttacaaggtcgcttccgagggctttcagtatagcgatcgtcgctggtgcttcgacggggaacgaaacaatcaagtgctggaggaaaacatggatgtggagatttggacgaaagagggagaaagaaagaaactcaggccacggtggttggacgcccgcacctactcagaccccctggctctaagagagtttaaggagttcgcagccggtaggcggagtgtcagcggcgatctgatactcgagatcgggaaacttcctcagcacctgacacagcgagctcagaatgccttagacaacttggttatgctgcataattccgaacaaggaggcagagcatatcgccacgcgatggaggagctcccggatactattgaaaccctgatgcttctggccctcatcgctgtgttgacaggtggggtaaccctgtttttcttatctggcaggggactaggcaaaactagcattgggctgctctgtgtgatggcctcctcagcacttctgtggatggcttctgtcgagccacattggatcgccgcaagtataatcttggaatttttcctgatggtgctcctgattcccgagcctgaccggcagcgtacgccccaggataaccagcttgcctacgttgtgatcggactcctgtttatgattttgaccgtcgctgcgaatgagatgggtctgttagaaacaactaagaaagacctaggcatcgggcacgtagccgtggagaaccaccatcacgcagctatgctggatgttgacctccatccagcctcggcctggaccctttacgcagtggctacaaccataattactcctatgatgagacacacaatcgaaaacacgaccgccaatattagcctgactgcgatcgctaaccaagccgcaatattgatgggactggataagggctggcccatctccaaaatggacattggtgtcccactcctggcccttgggtgctattctcaggtgaatcctttaacactgaccgctgcagtcctcatgttggtggcccattacgcgatcattggcccgggactgcaggctaaggccaccagggaggcacaaaagcgcacagccgctggcatcatgaaaaaccccactgttgatgggatagtggccattgacctagatccagtagtgtatgacgcaaagttcgaaaaacagctgggacagatcatgctccttatcctgtgtacgtcacagattttgctgatgcggaccacatgggctctctgcgagagcatcactctggccaccggccctttaacaaccctttgggagggttcccccgggaagttttggaatactacgatagcggtcagtatggccaacattttccgaggatcttacctggcaggcgctggtctcgccttcagcctaatgaaatcactgggcgggggaagaaggggcacaggggcacaaggagaaaccttgggcgagaagtggaagcgccagctgaatcagctctccaaaagtgaatttaacacttataagcggagcggtatcatggaggttgacagatctgaagctaaagaggggcttaagcgtggagagaccacaaaacacgccgtgtccaggggcactgccaagctgcggtggttcgtcgaacgcaatttggtgaagccagagggtaaagtaattgatctgggctgtgggcgaggaggctggtcatactattgcgcggggctcaagaaagtgaccgaagttaagggatacacaaaaggcggtcctgggcacgaggaacccatcccgatggctacgtacggatggaacttagtgaagctgcatagcggcaaagacgtctttttcataccacctgagaagtgtgatacccttctgtgcgacatcggcgagtcgtctcccaatccaactattgaagaggggagaacactaagggtgctcaagatggtcgaaccctggctgcggggaaaccagttttgtatcaaaattttgaatccttatatgccgagtgtggttgagaccctggagcaaatgcagcgcaagcacggtggcatgctcgtaagaaaccccctttccaggaatagcactcatgaaatgtactgggtgtcatgcgggacaggaaacatcgtctccgcagtgaatatgacctctcgaatgctgttaaaccggttcacgatggcccaccgtaaaccaacctatgagagagatgttgacctgggcgctggtacacgccacgtggccgtcgaacctgaggtggcaaacttggatattatcgggcagaggatagaaaatattaagcatgagcacaaaagcacttggcattacgacgaggataacccctataagacctgggcctaccacggaagttatgaagtaaagccttccggcagcgcttcttcaatggtgaatggcgttgtcaaactcctgacaaagccatgggacgtgatccccatggtgactcagatcgcgatgaccgatacaaccccttttgggcaacagcgggtcttcaaagagaaggttgacactagaacgccaaaagccaagcgcggaacagcacagattatggaagtgaccgctaagtggctatggggttttcttagtaggaacaaaaagccccgaatatgtactcgggaggagttcaccagaaaagtaaggtccaatgccgcaatcggcgccgtgtttgtcgacgagaaccaatggaatagcgctaaggaggccgtggaagatgagcgcttctgggacctggttcatcgtgaacgggagctccacaaacaggggaagtgcgcgacatgcgtgtacaacatgatgggaaagagagagaagaagctgggcgagtttggtaaagcaaaggggtctagggccatttggtacatgtggttgggagctcgcttcctggagttcgaagccctcggctttatgaatgaggatcactggttctcgcgagaaaactcacttagcggcgtcgagggggagggactgcataaattaggttatatcctgcgggacatttccaagatcccgggcgggaatatgtacgcagatgacacggctggatgggataccagaataactgaagacgatttgcagaacgaggccaaaatcacagacattatggaacctgagcacgctctcctggccaagagtatctttaagctaacctatcagaataaagtggtaagggttcaacgcccagcaaagaacggcactgtgatggatgtcatttctagacgggaccagaggggtagcggacaggtgggaacatacggccttaataccttcacaaacatggaagcgcagctgatccgtcaaatggagtccgagggcatattttcacccagtgaactcgagactcctaacctggccgggcgagtgttggattggttagaaaaacatggagtcgagcgcctgaagagaatggctatttctggtgacgactgtgttgtgaaaccaatcgatgaccggttcgccaccgcactcacggctcttaatgatatgggcaaggtaaggaaggacatcccccagtgggaaccgagcaaagggtggaacgattggcaacaggtgcctttttgctcccaccacttccatcaactgattatgaaggacggacgcgagatagtcgtgccctgtagaaatcaggatgagctagttggccgggccagggtgtcacagggtgcagggtggagcctgcgagaaaccgcctgcctcggaaaatcttatgcgcagatgtggcaattgatgtactttcaccgtagagacctgcgccttgctgccaacgcaatctgttccgccgtcccagtggattgggtacctacaagtcggactacctggagcattcatgctcaccatcagtggatgacaactgaggacatgctgtcggtttggaatagggtgtggatcgaagagaacccctggatggaagataagacccacatttcctcttggggcgacgtcccatatctcggcaaaagagaggaccagtggtgcgggtcattaatcggactgacggcccgcgcaacatgggctaccaatatacaagtggccatcaaccaggttcggaggttgattggtaatgagaactacctggattacatgactagcatgaagcgattcaagaatgaaagtgaccccgagggcgcgctctggtga

SEQ ID NO: 14000 - RNA, 9879 nt, synthetic construct
  misc_feature 1..9879: note = derived and/or modified CDS sequence (opt3) from DENV-1__EU482796__SS-prME
  source 1..9879: mol_type = other RNA
agcgtgaccatgctgctcatgcttatgcccaccgccctggctttccacttgactacgagaggaggggagcctcatatgatcgtcaccaagcaggaaaggggaaaatccttactgtttaagacatctgccggtgttaatatgtgcactttaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccattgggaaacttgttcatcagatattcggaacggcgtacggcgtgctgttttctggtgtcagctggaccatgaagatcgggattggcgtgttgctcacttggctgggattaaattcacgaagtacatccctgagcatgacctgtatcgctgtaggcctagtgacactctacctgggggttatggtccaggccgattctggatgcgtgatcaactggaaaggccgcgaacttaagtgtggttcagggattttcgtgactaatgaggtccacacctggacggaacaatataagtttcaggcagacagtccgaaaagattgagcgccgctataggaaaggcctgggaggagggcgtttgcggtatcaggtccgcaacacggctggaaaacattatgtggaaacagatctctaacgagctcaatcatattctgttagaaaacgacatgaagttcaccgtggtggtaggcgatgtcgtggggatcctggctcagggcaagaagatgatacgccctcaacccatggagcacaaatactcgtggaaaagctggggcaaggccaaaatcattggggcggacgttcagaatactacctttatcattgatggaccaaacacacctgaatgtcccgacgatcagagagcctggaatatctgggaggtggaggactatggcttcggtatatttactaccaacatttggcttaagatgagggattcctacacacaggtctgcgaccaccgtttgatgtcagctgcaatcaaagatagtaaggccgtgcatgctgacatggggtattggattgaatctgagaaaaatgaaacgtggaagctcgcccgggcatccttcatcgaggttaagacctgtatatggccaaaatcccacactctgtggtcaaacggagtgctagaaagcgagatgatcattcccaagatctacggcggtcctatttctcaacataattatcgaccaggctacttcacacagaccgcggggccgtggcacctgggaaaactcgagctggattttgacctttgcgaaggcactacagtagtcgtggatgagcactgcgggaacagaggaccctccttgaggaccacgactgtgaccggcaagatcatacatgaatggtgttgccgcagttgtacactgcctccattacggttcaaaggtgaggacgggtgctggtacggaatggagattagacccgtcaaggaaaaggaggaaaatctcgttaaaagcatggtgtctgccggctccggtgaggtagactcatttagtctgggccttctgtgtatcagcatcatgattgaagaggtgatgaggtcgcgctggtcccgaaagatgttgatgaccgggactctcgctgtcttcctgctactgatcatgggacagctcacatggaacgatctgattcggctttgcataatggtgggcgccaatgcatctgaccgtatggggatgggaaccacatatttggctctgatggccacttttaaaatgagacctatgttcgcagttggcttactctttaggcgcctgaccagccgggaggtgcttctgctaacgatcggtctctcactggtcgccagtgtggaattgccaaactccctggaggaattaggggatggactcgctatgggcattatgatcctgaaacttctgacagacttccaatctcaccagttgtgggcgaccctcctgagcctaacttttattaaaaccacactgtcccttcattacgcctggaagactatggcaatggttctctcaatcgtgagcctgatacccttgtgtctgagtaccacgtctcagaagacaacctggttaccggtcctcctgggctcccttgggtgcaaacctctgactatgttcttgatcgctgagaataagatttggggaagaaaaagctggccactcaacgaaggtatcatggccgtaggcgtggtttcgattctgctatcatctctgcttaagaacgatgtgcccctcgccgggcctctgatcgctggaggcatgttgatagcatgttatgtcattagtggttccagcgccgacttatctctggagaaagcggctgaggtgagctgggaagaggaagccgagcactccggggcatcacataatatcctcgtagaagtgcaggatgacggaacaatgaagatcaaagatgaggagagggacgataccctgactattcttctgaaggccacattgctagctgtcagtggcgtttaccccctgagcataccagcaaccctctttgtgtggtatttctggcaaaagaaaaagcagcgatctggcgtgctgtgggacacgccttcacccccagaagtcgagcgcgccgtgcttgatgacgggatctaccggattatgcagagaggattactgggtaggagccaggttggcgtaggggtgtttcaagaaaacgtcttccacactatgtggcacgtgacccgtggagcggttctcatgtatcagggcaaacgcttggagccgagttgggctagcgtgaagaaagacctgatctcctacggtgggggatggcggctccagggctcttggaatacaggcgaggaagtccaggtgattgccgtagagcctgggaagaaccccaagaatgtccaaaccgcaccaggaacattcaaaactcccgaaggtgaggtgggcgccatcgctctggattttaagcctgggacctcgggaagcccaatagttaacagagaaggcaaaatcgtgggtctttacgggaatggagtcgtgacgacatcaggcacttatgtttccgccattgcacaggctaaggccagtcaggagggccccctgcctgagatcgaagacgaggtgttcaggaaacgaaacttgaccattatggatctacatccggggtctggaaagacacggcgctacctgccagcgatcgtcagagaagccataaagaggaaactccggaccttaattctggcacccactcgagtggtagctagcgagatggccgaagctcttaagggtatgcctatcagatatcaaaccacagcagtgaaatccgagcacacgggcaaggagatcgttgacctgatgtgccatgccacttttaccatgcgcctcttgtcaccagtcagggtgcccaattacaacatgattatcatggatgaagcccacttcacagacccttctagcatagctgcgcgtgggtatattagtacccgggtgggaatgggcgaggcagccgctatctttatgactgccacaccgcccggttccgtcgaagcattcccacagagcaatgccgtaattcaggatgaggaaagagacatccctgagaggtcttggaactcagggtacgagtggataaccgattttcccggaaaaacggtgtggttcgttccatccattaagagtggcaatgacatcgctaactgtctgcgcaagaatggcaaacgagtgatccagctcagcagaaagacttttgatacagaatatcagaagaccaagaacaacgactgggactacgtcgtgaccactgatatttcggagatgggggcgaatttccgggccgacagggttatcgatcctcgccgttgcctgaaacccgtgattcttaaggacggaccagaaagagtcatactagcaggtccgatgcctgtgacagtagcttctgccgcacagcggaggggccgcatcgggcgaaaccataataaggagggagatcagtacatttatatgggccagcccctgaacaatgacgaggatcacgcccactggaccgaagctaaaatgttgttagacaacatcaatacaccagagggtatcattcccgccctgtttgaacctgagagagaaaagtccgcggcaatagatggggagtaccggctcaggggcgaggcccgcaaaactttcgtggaactgatgagaaggggagaccttccagtttggctgagctataaggtcgcttcagagggcttccaatacagtgatcggcgttggtgctttgacggggaacgcaacaatcaggtgctcgaggaaaacatggatgtggagatctggacgaaagagggagaacgaaagaaattgagacccaggtggctggacgcccggacctattctgaccctctagctctgcgcgagttcaaggaatttgcagccggtagaaggtccgtcagcggcgatctcattcttgagatcgggaagctgccgcagcatttaacacagcgggctcaaaatgccttggacaacctggttatgctccacaattcagaacagggaggccgagcatacagacatgcgatggaggagctgccagatactattgaaacccttatgctgctcgccttgatcgctgtgctgacaggtggggtaaccttattctttctaagtggccgcggactgggcaaaactagcatagggctcctttgtgtgatggcctcctctgtcctgttgtggatggcaagcgtggagccccactggatcgctgcctccattatcctggagttctttctcatggttctgcttattcctgagcccgacaggcagcggacgccacaggataaccaactcgcatatgtggtcatcggactgttgttcatgatactgaccgtagccgctaatgagatgggtttactagaaacaactaagaaagacctgggcattgggcacgtggcggttgagaaccatcaccatgccaccatgctcgatgtggaccttcaccctgcatcagcttggacactgtacgccgtcgccaccactatcattacacccatgatgcgtcatacgatcgaaaacaccactgcaaatatatctttgacagctatcgccaaccaggcggctattctgatgggactcgataagggctggccaatcagtaaaatggacattggtgtgcctctgcttgccttagggtgctactcgcaggtcaatccgctgaccctcaccgcagccgtgttgatgctggttgctcactatgcaatcataggccccggactacaagccaaggcgacaagagaggctcagaagaggactgccgcaggcattatgaaaaacccaacggtggatgggatcgtagccatcgacctggatcctgtggtctacgacgctaagtttgaaaaacagctcggacagattatgcttctgatcttgtgtaccagccaaatactgctcatgcgcacaacttgggccctgtgcgagtccattaccttagcaacaggcccccttaccactctgtgggagggttctccagggaagttctggaatacgacaatcgctgtttcaatggccaacatttttcggggaagctatctcgcgggcgccggtctagcattctccctgatgaaaagtttgggcgggggacgaagaggcaccggggctcagggagaaactctgggcgagaagtggaagaggcagctcaatcagctttctaaaagcgaatttaacatctacaagcgctcaggtataatggaggtggaccggtccgaagccaaagaggggctgaagagaggagagaccacacgtcacgcagtcagtaggggcactgctaaattgcggtggttcgtggaacgcaatctggtaaagcctgagggtaaggtgatcgatctcggctgtgggcgaggaggctggagctattactgcgccgggctaaagaaggttaccgaagtgaaaggatatacaaagggcggtcccgggcatgaggaaccgattccaatggccacgtacggatggaacctggtcaaacttcactctggcaaggacgtgttctttacccctcccgagaaatgtgatactctgctatgcgacatcggcgagtcctcaccaaatcccacaattgaagaggggagaaccctcagggtcctgaagatggtggaaccttggttgcggggaaaccaattctgtatcaagattctgaatccgtacatgcccagcgttgtagagactctcgagcagatgcagcgcaaacatggtggcatgcttgtgagaaacccactgtcgagaaattctacacacgaaatgtattgggtcagttgcgggaccggaaacatcgtgtccgcggttaatatgacgagccgaatgttactgaaccggtttaccatggctcaccgtaagcctacatacgagaaagatgtggacttgggcgcaggtactagacatgtcgccgtggaacccgaggtagctaacctcgatataattgggcagcgcatcgaaaatatcaagcacgagcataaatcaacctggcactatgacgaggataacccttacaagacatgggcctatcatggatcctacgaagtgaagccatctggcagcgcaagttccatggttaatggcgtcgtgaaactgctaactaagccctgggacgtgattcctatggtcacccaaatagccatgacagataccactccattcgggcagcagagggtttttaaagagaaggtggacacgcggacacccaaagctaagagaggaaccgtacaaatcatggaagtgactgcgcgctggctttggggtttcctgagcaggaacaagaaaccgcgaatttgtacccgggaggaatttacaagaaaggtcaggtctaatgccgcaatcggcgctgtgttcgttgacgagaaccagtggaactcagccaaagaggcagtggaagatgagcgcttttgggacctcgtcaagaaagaacgtgagctgcacaagcaggggaagtgcgccacgtgcgtgtataacatgatgggaaaacgggaaaagaaattgggcgagttcggtaaggctaaagggagtagagccatttggtacatgtggctgggagcgaggtttctcgagttcgaagcacttggctttatgaatgaggatcactggttctcccgcgaaaacagcctgtctggcgtagagggggagggattacataagctgggttacatcttgcgagacatatcgaaaatccctggcgggaatatgtatgccgatgacaccgctggatgggatactcggattacagaagacgatctccagaacgaggccaagatcaccgacattatggaaccagagcacgcactgctagctacttcaatcttcaaacttacataccaaaataaagttgtgagagtccagaggcccgccaagaacggcaccgtgatggatgtgataagccgcagagaccagcggggttccgggcaggtcggaacatatggcctgaatacttttaccaacatggaagctcaactcattaggcagatggagagtgagggcatcttcctgccttctgaattggagacgccaaacttagccgaacgtgttctggattggctcgagaaatacggggtggaacgacttaagcgcatggcaatcagcggagacgactgtgtagtgaaacccattgatgacagatttgcgaccgccctgacagctctaaatgatatgggtaaggtccggaaggacataccgcagtgggagccttccaaaggctggaacgattggcagcaagtgcccttctgctcacatcactttcaccagctgatcatgaaggacgggagggagattgttgtgccatgtcgcaatcaggatgaactcgtcggaagggcacgggtgagtcagggcgcaggttggtctttgagggagactgcttgcctggggaaaagctatgcccaaatgtggcagcttatgtacttccatcgacgtgacctgagactcgcagccaacgcgatctgttccgctgtacctgttgattgggtgcccacctcacgcacaacttggagcattcacgcccatcaccagtggatgaccacggaagacatgttatctgtctggaatcgggtgtggatcgaggaaaacccatggatggaggataagacacatgtttccagttggggagacgtgccctatctgggcaaaagggaggaccaatggtgcggcagcttgatagggctgaccgcaagagccacttgggcttcgaatatccaggtcgccattaaccaggtgcgccggctcatcggaaatgaaaactaccttgattacatgacatccatgaagaggtttaagaatgagggtgaccctgaaggcgcactgtggtga

SEQ ID NO: 14001 - RNA, 9879 nt, synthetic construct
  misc_feature 1..9879: note = derived and/or modified CDS sequence (opt3) from DENV-1__EU482797__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgagatgggtttgctggaaacaactaaaaaggacttaggcatcgggcacgtggccgttgagaaccaccatcacgcagctatgctagatgtggacctgcatccagccagtgcctggaccctctacgcagtcgctacaaccataattactcctatgatgcgtcacacaatcgaaaacacgaccgccaatatttcgcttactgcgatcgctaaccaagccgcaatactgatgggattggataaaggctggcccatcagcaagatggacattggtgtgccactgctcgccctggggtgctattcccaggtcaatcctcttacattaaccgctgcagtgctgatgctcgttgcccattacgcgatcattggcccgggattgcaggctaaggccaccagagaggcacagaagaggacagccgctggcatcatgaagaaccccactgtggatgggatagtagccattgacctggatccagtggtctatgacgcaaaatttgaaaagcagctaggacagatcatgctgctcatcctttgtacgtctcagattctgttgatgcgcaccacatgggctctgtgcgagtcaatcactctcgccaccggccctctgacaaccttatgggagggtagccccgggaaattctggaatactacgatagcggtttccatggccaacattttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtatcatggaggtggaccggagcgaagctaaggaggggctcaaaagaggagagaccacaaagcacgccgtctctcgtggcactgccaaacttaggtggtttgtggaacggaatctggtaaaaccagagggtaaggtgattgatttgggctgtgggcgcggaggctggtcctactattgcgcggggctgaaaaaggttaccgaagtgaaaggatacacaaagggcggtcctgggcacgaggaacccatcccgatggctacgtacggatggaacctcgtcaaattacattcaggcaaggacgtgttctttataccacctgagaagtgtgataccctgctttgcgacatcggcgagagctcgcccaatccaactattgaagaggggcgaacactgagagtcctaaaaatggtggaaccctggctcaggggaaaccagttctgtatcaagattctgaatccttatatgccgtctgttgtagagaccttggagcaaatgcagcggaaacacggtggcatgctggtgcgcaaccccctcagtagaaattccactcatgaaatgtactgggtcagctgcgggacaggaaacatcgtgtcagcagttaatatgacctccaggatgcttctgaaccgatttacgatggcccaccggaagccaacctatgagcgtgatgtggacttaggcgctggtacaagacacgtcgccgtggaacctgaggtagcaaacctggatattatcgggcagcgcatagaaaatattaaacatgagcacaagtctacttggcattacgacgaggataacccctataagacctgggcctaccacggaagctatgaagtgaaacctagtggctccgctagctctatggttaatggcgtcgtgaagttgctcacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctgtggggtttcctatcacgcaacaagaaacccaggatatgtactcgagaggaatttacccggaaggtgagaagtaatgccgcaatcggcgccgtcttcgtggacgagaaccaatggaactccgctaaagaggccgttgaagatgagaggttttgggaccttgtgcatcgcgaacgtgagctgcacaagcaggggaagtgcgcgacatgcgtctacaacatgatgggaaaacgggaaaagaaactcggcgagttcggtaaggcaaaagggagcagagccatttggtacatgtggctgggagctaggttcttggagtttgaagccctgggcttcatgaatgaggatcactggttttctcgcgaaaactcgctctcaggcgtggagggggagggacttcataagctgggttatatcttacgagacattagcaaaatcccgggcgggaatatgtacgcagatgacacggctggatgggatacccggataactgaagacgatctgcagaacgaggccaagatcacagacattatggaacctgagcacgctttgctcgccaagtccatcttcaaactgacctatcagaataaggtagttagagtgcaaaggccagccaagaacggcactgtcatggatgtgattagtcgcagagaccagcggggttctggacaggtgggaacatacggcctaaatacctttacaaacatggaagcgcagcttatcaggcaaatggagagcgagggcatattctccccctcagaactggagactcctaacctcgccgggcgtgtcctggattggttggaaaagcatggagttgagcgattaaaacgcatggctattagtggtgacgactgtgtggtaaagccaatcgatgacagatttgccaccgcactgacggctctcaatgatatgggcaaggtgcggaaagacgtcccccagtgggaaccgtctaaggggtggaacgattggcaacaggtgcctttctgcagccaccactttcatcaacttatcatgaaagacggaagggagattgttgtgccctgtcgcaatcaggatgagctggtcggcagagcccgggtgtcccagggtgcagggtggtcactaagggaaaccgcctgcctgggaaagagctatgcgcagatgtggcaactcatgtacttccaccgacgtgacttgagactggctgccaacgcaatatgttctgccgtaccagttgattgggtgcctacatcccgcactacctggagtatccatgctcaccatcagtggatgacaactgaggacatgcttagcgtctggaatcgggtgtggattgaagagaacccctggatggaagataaaacccacatctcgtcctggggcgacgttccatatctgggcaagagggaggaccagtggtgcgggtctctcattggattaacggccagagcaacatgggctaccaatatccaagtggccataaaccaggtccgccggctgatcggtaatgagaactacttggattacatgacttcaatgaagaggtttaaaaatgaaagcgaccccgagggcgcgctgtggtga

SEQ ID NO: 14002 - RNA, 9879 nt, synthetic construct
  misc_feature 1..9879: note = derived and/or modified CDS sequence (opt3) from DENV-1__EU482799__SS-prME
  source 1..9879: mol_type = other RNA
tccgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagaaaccgaaccggacgatgtggactgttggtgcaatgcgactgatacatgggtaacctatgggacgtgtagtcaaactggagaacaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcccatgtgatcggcacctcgattacgcagaagggcatcatattcatcctcttaatgctggtcactccatcaatggccatgcgctgcgtggggattggaagcagagattttgtagagggtcttagtggcgctacatgggttgacgtggtcttggagcacgggtcctgtgtgaccactatggccaaggataaacccacactggacatcgaactactcaagaccgaggtgacgaaccctgcggtcctgaggaaactttgcattgaagcaaagatctctaataccacaactgatagccggtgtccaacccaaggagaggccacactggttgaagaacaagacgctaacttcgtgtgccgccgaacttttgtagatagaggctggggtaatgggtgtggattgttcggcaaaggctccctcataacctgcgccaagtttaagtgcgtgacaaaactggaggggaagattgtccagtacgaaaacttaaaatattcagtgatcgttaccgtgcacactggagaccagcatcaagtcggtaatgagagtacggaacacggcacaaccgcaactattacaccccaagctcctaccaccgagatccagctgactgactacggggccctcacacttgattgtagcccaaggacgggactggacttcaacgaaatggtgttgctaaccatgaaggagaaatcttggctggtacataagcagtggtttctcgatctgccgcttccctggacttccggcgcgtcaacaagccaagagacctggaatcggcaggacctgttggttacattcaaaactgcccacgcaaagaagcaggaagtggtcgtgctcggtagtcaagagggggctatgcacaccgccctgacgggcgctaccgaaatccagacatctggaactaccacaatttttgccggccatttaaaatgccgtctgaagatggataaactaactctcaaggggatgtcctatgtcatgtgtaccgggtcgttcaaactggagaaggaagtggcagagacgcagcacggtacagttcttgtgcagataaagtacgagggcaccgacgccccttgcaaaatcccattctcgactcaagatgaaaagggggtaacacagaacggacgcttgattaccgctaatcccatcgtcactgacaaagagaagcctgtgaacatagaagcggagccaccctttggcgagtcttatattatcatcggtgcaggggagaaaaccctgaagctctcctggttcaagaaaggctcaagtattggaaagatgtttgaggccacagctagaggcgccaggcggatggcaatcctgggggatacggcctgggacttcggaagcattggtggcgtttttacctccgtggggaaacttgtccatcagatattcggaactgcttacggcgtgctgttttctggtgtaagctggacaatgaagatcgggattggcgtgttgctcacctggctgggattaaattcacgaagtacatccctgagcatgacttgtatcgccgttggcctagtcaccctctacctgggggtgatggtgcaggcagattctggatgcgtcatcaactggaaaggccgcgaacttaagtgtggttcagggattttcgttacgaatgagatacacacatggaccgaacaatataagtttcaggcggacagtccgaaaagattgagcgctgccatcggaaaggcatgggaggagggcgtgtgcggtattaggtccgccactcggctggaaaacatcatgtggaaacagatttctaacgagctcaatcatatcctgttagaaaacgacatgaagttcaccgtggtagtcggcgatgtggctgggatactggcccagggcaaaaagatgatccgccctcaacccatggagtacaaatattcgtggaaaagctggggcaaggcaaagattatcggggctgacgttcagaatacaacttttattatcgatggaccaaacacccctgaatgtcccgacgatcagagagcctggaatatatgggaggtggaggactacggcttcggtatttttacaacgaacatctggcttaagttgagggattcctatacccaggtctgcgaccaccgtctcatgtcagcggccattaaagatagtaaggctgtgcacgcagacatggggtactggatcgaatctgagaaaaatgaaacttggaagctggcccgggctagcttcatagaggttaagacatgtatctggccaaaatcccataccctatggtcaaacggagtgctggaaagcgagatgattatccccaagatttatggcggtcctatctctcaacacaattaccgaccaggctacttcactcagacagccgggccgtggcatctcggaaaactggagcttgattttgacttgtgcgaaggcaccacggtagtcgtggatgagcactgcgggaacagaggaccctccctgaggactaccacagtgaccggcaagataattcacgaatggtgttgccgcagttgtactttacctccactccggttcagaggtgaggacgggtgctggtatggaatggagatcaggcccgtcaaagaaaaggaggaaaatctggttaagagcatggtgtctgcaggctccggtgaggtagactcatttagtcttggcctgttgtgtatcagcattatgatcgaagaggtgatgcgctcgcgatggtcccggaaaatgctcatgacagggaccctggcggtcttctttctactgattatgggacagctcacatggaacgatctgatacgtctttgcatcatggtgggcgccaatgcttctgacagaatggggatgggaactacctacttggccctgatggcaacgttcaagatgaggcctatgtttgctgttggcttactcttccgccggctgacaagcagagaggtgcttctgctaaccattggtctctcactggtcgccagtgtggaattgccaaactccctggaggaattaggggatggactcgcaatgggcatcatgattctgaaacttctgactgactttcaatctcatcagttgtgggccaccctcctgagcctaacattcatcaagactaccttttccctgcactatgcttggaaaacgatggcgatggttctttcaatagtgagcctcttccccctgtgtttgagtacaacctctcagaagactacatggctgccggtcttactcggctccctggggtgcaagcctcttaccatgtttctgatcgccgagaataaaatttggggaaggcgaagctggccattgaacgaaggtatcatggcagtaggcattgtgtcgatcctcctgtcatctctactgaagaacgatgttccccttgctgggcctctcatagccggaggcatgctgattgcctgttacgtgatcagtggttccagcgctgacttgtctttagagaaagcagccgaggtcagctgggaagaggaagcggagcattccggggcttcacacaatatcctggtggaagtacaggatgacggaactatgaagattaaagatgaggagcgcgacgatacactcaccatactgcttaaggccacgctgttggcagtgagtggcgtctatcccctaagcatcccagccactctgttcgtttggtacttctggcagaaaaagaagcagcggtctggcgtgctctgggacaccccttcacccccagaagtggagagagctgtcctggatgacgggatttataggatcatgcagcgtggacttttaggtcgcagccaggtgggcgttggggtatttcaagaaaacgtgttccatacaatgtggcacgtcacccggggagcagtgctgatgtaccagggcaaaagactcgagccgagttgggccagcgttaagaaagacttgatttcctacggtgggggatggaggctgcagggctcttggaatacaggcgaggaagtgcaggtcatcgcggtggagcctgggaagaaccccaaaaatgtacaaactgctccaggaacctttaagacgcccgaaggtgaggtcggcgccatagcactcgatttcaagcctgggacatcgggaagcccaatcgtgaaccgagaaggcaaaattgttggtctgtatgggaatggagtggtcactacctcaggcacatacgtgtccgccatcgctcaggccaaggcaagtcaggagggcccccttcctgagattgaagacgaggtttttcggaaacgcaacctgaccatcatggatttgcacccggggtctggaaagactagaaggtatctaccagctatagtgcgggaagccattaaacgaaagctgagaaccctcatcttagcgcccacacgcgtcgtggccagcgagatggcagaagctctgaagggtatgcctatcaggtaccaaacgactgccgtaaaatccgagcataccggcaaggagattgtggaccttatgtgccacgctacattcaccatgcgtctgctctcaccagttcgggtccccaattataacatgatcataatggatgaagcacattttactgacccttctagcattgccgccagagggtacatcagtacaagggtgggaatgggcgaggctgcggcaattttcatgaccgccacgccgcccggttccgtggaggcttttccacagagcaatgccgtcatccaggatgaggaacgcgacatacctgagcgatcttggaactcagggtatgagtggattactgatttccccggaaaaacagtatggtttgtgccatccatcaagagtggcaatgacatcgcaaactgtttgaggaaaaatggcaagcgggttattcagctgagcaggaagaccttcgataccgaataccagaaaactaagaacaacgactgggactacgtggtcacaaccgatatctcggagatgggggccaatttccgcgctgaccgtgtgattgatcctagacggtgcctcaaacccgttatactgaaggacggaccagaaagggtgatccttgcgggtccgatgcctgtcacagtggcctctgcagctcagcgccgaggcagaattgggcggaaccacaataaagagggagatcagtatatctacatgggccagcccctaaacaatgacgaggatcatgcccactggactgaagcaaagatgctgttggacaacatcaatacgccagagggtattatacccgccttatttgaacctgagagggaaaagtccgctgccatcgatggggagtatcgcctgagaggcgaggcgaggaaaaccttcgtagaactcatgcggcgtggagacctgccagtgtggcttagctacaaggttgcatcagagggctttcaatatagtgatcgccgatggtgcttcgacggggaaagaaacaatcaggtcctggaggaaaacatggatgtggagatttggacaaaagagggagaaaggaagaaactccggccccgctggttggacgccagaacttactctgaccctctggctctaagggagtttaaggagttcgccgctggtcggcgatccgtgagcggcgatctgatcctcgagattgggaaacttccgcagcacctgacccagagagcacaaaatgccttagacaacttggtcatgctgcataattcagaacagggaggccgcgcttataggcacgccatggaggagctcccagatacaatcgaaaccctgatgcttctggcactcatagcggttttgactggtggggtgacgctgtttttcttaagtggccggggactaggcaagaccagcatcgggctgctctgtgtaatggcctcctctgtgcttctgtggatggctagcgtcgagccccattggattgccgcatccatcattttggaatttttcctgatggtgctcctgatccctgagcccgaccgtcagagaacaccacaggataaccaacttgcttacgttgtgataggactcctgtttatgattttgactgtcgccgcaaatgagatgggtctgttagaaaccacaaagaaagacctaggcatcgggcacgtagccgtggagaaccaccatcacgctgcgatgctggatgttgacctccatcctgcctcagcatggaccctttacgctgtggccactacaattatcacgcccatgatgaggcacaccatagaaaacactacagccaatatctctctgaccgcaattgctaaccaggccgcgatcttgatgggactggataagggctggccaattagtaaaatggacatcggtgtccctctcctggctcttgggtgctatagccaggtgaatccgttaaccctgacagccgcagtcctcatgttggtggcccattacgctataattggccccggactgcaagcaaaggccactcgcgaggcgcagaaacggacggctgccggcatcatgaagaacccaaccgttgatgggatcgtggcaattgacctagatcctgtagtgtatgacgccaagttcgaaaaacagctgggacagatcatgctccttatactgtgtacaagccaaattttgctgatgcgaactacctgggctctctgcgagtccatcacactggccaccggccccttaactacgctttgggagggttctccagggaagttttggaatacaaccattgcagtctcaatggctaacatcttcagaggaagctacctggccggcgcgggtctcgccttctccctaatgaaaagtctgggcgggggaaggcgcggcactggggcacagggagaaaccttgggcgagaagtggaaacggcagctgaatcagctctctaagagcgaatttaacacatataagagatcaggtataatggaggttgaccgttccgaagctaaagaggggcttaagaggggagagactaccaaacacgccgtgagtcggggcacagcaaagctgcgctggttcgtcgaacgaaatttggtgaaacctgagggtaaggtaatcgatctgggctgtgggagaggaggctggagctactattgcgctgggctcaagaaagtgacggaagttaagggatacaccaaaggcggtcccgggcacgaggaaccgattccaatggccacttacggatggaacttagtgaagctgcattctggcaaagacgtctttttcatccctcccgagaagtgtgatacacttctgtgcgacattggcgagtcctcaccaaatcccaccatcgaagaggggaggactctacgggtgctcaaaatggtcgaaccttggctgcgcggaaaccaattttgtattaagatcttgaatccgtatatgcccagcgtggttgagacactggagcagatgcagagaaagcacggtggcatgctcgtaaggaacccactttcgcgaaattctacccatgaaatgtactgggtgagttgcgggacgggaaacatagtctccgccgtgaatatgaccagccggatgctgttaaaccgtttcacaatggcgcacagaaaacctacttatgagcgcgatgttgacctgggcgctggtaccaggcacgtggcagtcgaacccgaggtggccaacttggatattatcgggcagcggatcgaaaatattaagcatgagcacaaatcaacatggcattacgacgaggataacccttataagacttgggcttaccacggatcctatgaagtaaaaccatctggcagcgccagttccatggtgaatggcgttgtcaagctcctgaccaagccctgggacgtgatacctatggtgacacaaatcgcaatgaccgatactacgccatttgggcagcagagagtcttcaaagagaaggttgacacacgcacccccaaagccaagaggggaactgctcaaattatggaagtgaccgcgaaatggctatggggttttcttagccgaaacaagaagccgcggatctgtacaagagaggagttcacgaggaaagtacgctctaatgccgcaattggcgctgtgtttgtcgacgagaaccagtggaactcagccaaggaggcagtggaagatgagcgtttctgggacctggttcatcgggaaagagagctccacaaacaggggaagtgcgcaacctgcgtgtacaacatgatgggaaaaagggaaaagaagctgggcgagtttggtaaagctaaggggagtcgcgccatctggtacatgtggttgggagcgcgattcctggagttcgaagcactcggctttatgaatgaggatcactggttctcccgggaaaacagcctttctggcgtcgagggggagggactgcataaattaggttatatactgagagacatctcgaagattcctggcgggaatatgtacgccgatgacactgctggatgggatacaaggatcaccgaagacgatttgcagaacgaggcccgcattactgacatcatggaaccagagcacgcactcctggctaaatcaatatttaagctaacatatcaaaataaagtggtaagagttcagcggcccgccaagaacggcaccgtgatggatgtcattagcaggcgtgaccagcgaggttccggacaggtgggaacatacggccttaatactttcaccaacatggaagctcaactgatccgccagatggagagtgagggcatcttttctcctagcgaactcgagacgccaaacctggccgaaagagtgttggattggttagagaagtatggggtcgaacggctgaaaaggatggcaatttccggagacgactgtgttgtgaagcccatagatgaccgcttcgcgaccgccctcacagctcttaatgatatgggtaaagtaagaaaggacatcccgcagtgggagccttcaaaaggctggaacgattggcagcaagtgcccttttgcagtcatcacttccaccagctgattatgaaggacgggcgggagatcgtcgtgccatgtaggaatcaggatgagctagttggacgagcccgtgtgtctcagggcgcaggttggagcctgagagagactgcttgcctcgggaagtcctacgcccaaatgtggcagttgatgtattttcatcgccgggacctgaggcttgcagccaacgcgatttgttcagctgtccctgtggattggatccccaccagcagaacaacttggtctatacacgcccatcaccagtggatgaccacggaagacatgctgtccgtatggaatcgcgtttggatcgaggaaaacccatggatggaggataaaacacatattagtagctggggagacgtgccctacctcggcaagcgggaggaccaatggtgcggctcgttaatcgggctgaccgcaagggccacttgggctacaaatattcaggtcgccatcaaccaggtgcgaagattgattggaaatgaaaactacctggattatatgacctccatgaaacggttcaagaatgagtctgaccctgaaggtgcactctggtga

SEQ ID NO: 14003 - RNA, 9879 nt, synthetic construct
  misc_feature 1..9879: note = derived and/or modified CDS sequence (opt3) from DENV-1__EU482800__SS-prME
  source 1..9879: mol_type = other RNA
agcgtgacaatgctgctaatgcttatgcccacagcactggctttccacttgactacgcgaggcggggagcctcatatgatcgtctccaagcaggaaaggggaaaatctttactgtttaagacatcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggacaacaccgccgagacaagcgtagcgtggccctggcaccccatgtcggccttggtctggagactagaaccgagacatggatgtcctctgaaggggcctggaaacagatccagagggtggagacttgggctttgcggcaccctggatttaccgttattgcactcttcctggcccatgctatcggcacatcgattacccaaaagggcatcatatttatcctgctcatgttagtgacgccatcaatggccatgcgctgcgtcgggattggaagcagagatttcgtggaaggtctgagtggcgcgacttgggttgacgttgtgcttgagcacgggtcctgtgtcacaaccatggcaaaggataaacccactttggacatcgagctgctaaagacagaagtgaccaaccctgccgtgctcaggaaactgtgcattgaggctaagatctctaatacgaccatagatagccggtgtccaacacagggagaagccactcttgtcgaggaacaggacgcaaactttgtttgccgccgaaccttcgtggatagaggctggggtaatgggtgtggactgtttggcaaaggctccttgattacatgcgctaagttcaagtgcgtaactaaactcgaggggaagaccgtgcagtacgagaacctgaaatattcagtcatcgtgacagttcacaccggagaccaacatcaggtgggtaatgaaagtactgagcacggcacgacagccaccattactccccaggcgcctagcaccgaaatccagttaacagactacggggccctgaccctcgattgttctccaaggactggacttgactttaacgagatggtcctgttgacaatgaaggaaaaatcctggctagtgcataagcaatggttcctggatctcccgctgccctggacgtcaggcgcaagcaccagtcaggagacttggaatcggaaagaccttctggtaacatttaagaccgctcacgccaagaaacaggaggttgtggtcttgggttctcaagaaggggctatgcacacagccctcactggcgcaaccgagatccagacgtccggaaccacaactattttcgccggccatctgaagtgccgtttaaaaatggataagctgaccctaaaagggatgagctatgtgatgtgtacaggatcgttcaagctcgaaaaggaggtcgctgaaactcagcacggtaccgtgctggttcagataaaatacgagggcacggacgcgccttgcaagatcccattttctacacaagatgagaaaggggtgacccagaacggacgccttattactgcaaatcccatcgtaacagacaaggaaaaacctgtcaacatagaggccgaaccacccttcggcgagtcctatattgtgatcggtgctggggagaaggccttgaagctgtcatggtttaaaaagggcagtagcatcggaaaaatgttcgaagcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgagctgaagtgtggtagtgggatctttgttacaaatgaagtgcacacttggaccgagcaatataaattccaggcagacagcccgaagagactttccgccgctattggaaaagcctgggaagagggcgtgtgcggtataaggtctgtaacgcggttggagaacatcatgtggaagcagatttcgaacgaactgaatcatatcctcctggagaacgacatgaaatttacagtcgtggttggcgatgtggcagggattttagctcagggaaagaaaatgatccgccctcaacccatggaatacaagtatagctggaagtcctggggcaaagccaagataatcggggcggacgtccagaataccactttcattatcgatggaccaaacacccctgagtgtcccgacgatcagagagcctggaatatttgggaagtggaggactacggctttggtatcttcacaactaacatatggctgaaacttagggattcatatacccaggtttgcgaccaccgtttgatgagtgctgcaattaaggattctaaagccgtgcacgctgacatggggtactggatcgagagcgaaaagaatgagacatggaagctcgcccgggcatccttcattgaagtaaaaacgtgtatctggccaaagtcacataccctgtggagcaacggagtcctagagtctgaaatgataatccccaaaatttatggcggtcctatctcccaacacaattaccgaccaggctactttactcagacagcggggccgtggcatctgggaaagctcgagctggatttcgacctttgcgagggcaccactgtggtggtcgatgaacactgcgggaacagaggacccagtttgaggacaaccacggttactggcaaaattatccacgagtggtgttgccgcagctgtaccctgcctccattacggtttaagggtgaagacgggtgctggtatggaatggagataagacccgtgaaggagaaagaagagaatctcgtaaagtctatggtgtccgccggctcaggtgaagtcgacagtttcagcctgggccttctgtgtatttcgatcatgatcgaggaagtgatgaggtcccgctggtctcgaaaaatgttgatgacagggaccctcgctgtatttttcctgctaattatgggacagctgacttggaacgatctcatccggctgtgcattatggtgggcgccaatgcaagcgaccgtatggggatgggaacaacctaccttgctttgatggccacatttaagatgagacctatgttcgcagtcggcctgttatttaggcgcctcacttcacgggaggtgctgcttctgaccataggtctaagtctcgttgcctccgtggagctgccaaactctttggaagaactgggggatggattagctatgggcatcatgattctcaaactgcttacggacttccaaagccatcagctgtgggcgacattgctctccctgacctttatcaagactaccttctcactacactatgcctggaagacaatggcaatggtcctgagcattgtaagtctttttcccctctgtctgtctactacctcccagaaaacgacatggttgccggtgctgttaggcagcctcgggtgcaagcctctgaccatgttccttatcgctgaaaataaaatatggggaagaaagtcgtggccactgaacgagggtatcatggccgttggcattgtgtcaatcttgctctctagtctgctcaagaatgatgtccccctggccgggcctcttattgctggaggcatgctcatcgcatgttacgtgatatccggtagctctgccgacctgagcttggaaaaggcggctgaggtatcctgggaggaagaggccgaacattcaggggcaagtcacaatattttagtggaggtccaggatgacggaactatgaaaatcaaggatgaagagagggacgatacactgaccatcctcctgaaggccactcttctggctgttagcggcgtgtatcccttgtctattccagcaacactattcgtgtggtacttttggcagaagaagaaacagcgatccggcgtcctgtgggacaccccttcacccccagaggtggaacgcgccgttctcgatgacgggatatatcggatcatgcagagaggactgcttggtaggagtcaggtaggcgtgggggtcttccaagagaacgtgtttcatacgatgtggcacgttactcgtggagcggtgttaatgtaccagggcaagcgcctggaaccgagctgggcttccgtcaaaaaggacctcatttcttacggtgggggatggcggttgcagggctcgtggaataccggcgaggaggtgcaggtaatcgccgtcgaacctgggaagaaccccaaaaatgtgcaaacagcaccaggaaccttcaagacaagcgagggtgaagttggcgccattgctctggattttaaacccgggacttcaggatcccctatcgtgaacagagagggcaagatagtcggtctctatgggaatggagtggttaccacgagtggcacatacgtgtctgccatcgcacaggctaaagccagccaggaaggcccactgcccgagattgaggacgaagtcttcaggaagcgaaaccttactatcatggatctgcaccctgggtccggaaagacccggcgctatttgccggcgattgtgagagaggccatcaaaaggaagctacggacactgatactcgcaccaacccgagtagtggcttcagaaatggccgaggctttaaaaggtatgcccattagataccaaactaccgcagttaagtctgaacatacaggcaaagagatcgtcgacctgatgtgccacgccacgtttactatgcgccttctgagccctgtgagggtgccaaattataacatgatcattatggatgaggcccatttcaccgaccccagttccatcgctgcgcgtgggtacataagcacacgggtcggaatgggcgaagcagccgctatttttatgaccgccactcctccgggttctgtagaggcattcccccagtcaaatgccgtgatccaggatgaagagagagacattccagaaaggtcctggaacagtgggtatgagtggatcacagattttcctggaaagaccgtttggttcgtgcccagcataaagtcgggcaatgacattgctaactgtctccgcaaaaatggcaagcgagtcatccagttgtctagaaaaacgttcgatactgagtaccaaaagaccaaaaacaacgactgggactacgtggttaccaccgatatctccgaaatgggggcgaattttcgggccgacagggtgattgatccacgccgttgcctgaagcctgtcatcctcaaggacggacccgagagagtgattctggcaggtccaatgccggtaactgtggctagcgccgcacagcggaggggccgcatagggcgaaaccacaataaagaaggagatcagtatatctacatgggccagcctcttaacaatgacgaggatcatgcccactggacagaggctaagatgctactggacaacattaatacccccgaaggtatcatcccagccttgttcgagcccgaaagagagaaatcagcggcaattgatggggaatatcggttaaggggcgaggcccgcaagacatttgttgagctgatgagaaggggagacctccctgtctggctgagttacaaagtggcttctgaaggcttccaatattccgatcggcgttggtgctttgacggggagcgcaacaatcaggtgcttgaagagaacatggatgtcgaaatatggactaaggagggagagaggaaaaagctgagaccaagatggctcgacgcccggacgtacagcgaccccttggctctgcgcgagttcaaggagtttgcagccggtagaaggtcagttagtggcgatctaatcctggaaattgggaaactccctcagcaccttacccagcgggctcaaaatgccctggacaacttagtgatgttgcataatagcgagcagggaggccgagcatatagacacgcgatggaagaactgccggatacaatcgagactctcatgctgcttgccctgattgctgtactcaccggtggggtgacattgttctttctgtccggccgcggattaggcaagacctctatcgggctactgtgtgtcatggccagctccgtgctcctttggatggcatcagttgaaccacattggatagctgcctctatcattctggagttctttttgatggtgctgctcatccccgaacctgacaggcagcggactccccaggataaccaactggcatacgtcgtaattggacttctcttcatgatcctgacggtggccgctaatgagatgggtttgctggagaccaccaaaaaggacttaggcatagggcacgttgcggtggaaaaccaccatcacgccgcaatgctagatgtcgacctgcatccagctagtgcctggactctctacgccgtggcaaccacaattatcacccctatgatgcgtcacactattgagaacacaacggctaatatctcgcttaccgccatagcgaaccaggctgccatcctgatgggattggataaaggctggcccattagcaagatggacatcggtgtcccactgctcgcactggggtgctattcccaggtgaatcctcttactttaacagccgctgttctgatgctcgtggcacattacgccattatcggcccgggattgcaagcgaaggctaccagagaagcccagaaaaggaccgcagccggcataatgaagaaccccacagtagatgggattgtggctatcgacctggatccagtcgtttatgacgccaaatttgagaagcagctaggacagatcatgctgctcattctttgtacttctcaaatcctgttgatgcgcacgacctgggcactgtgcgaatcaataacactcgctactggccctctgaccacattatgggagggtagccccgggaaattctggaataccactattgccgtgtccatggcgaacatcttccggggaagttaccttgccggcgcaggtctggctttttctctcatgaaaagcctaggcgggggacgaagaggcacgggggcccagggagagacactgggcgaaaagtggaaaaggcagttgaatcagctgtcaaagtccgagttcaacacctataaacgcagtggtattatggaagtcgaccggagcgaggcaaaggaagggctcaaaagaggagagactaccaagcacgctgtgtctcgtggcacagccaaacttaggtggtttgtagagcggaatctggtgaaaccagaaggtaaggttatcgatttgggctgtgggcgcggaggctggtcctactattgcgccgggctgaaaaaggtgactgaggtcaaaggatacaccaagggcggtcctgggcacgaggaacccataccgatggcgacatacggatggaacctcgtgaaattacattcaggcaaggacgtcttctttatcccacctgaaaagtgtgatacgctgctttgcgacattggcgagagctcgcccaatccaaccatcgaggaagggcgaactctgagagtgctaaaaatggttgagccctggctcaggggaaaccaattctgtattaagatcctgaatccttatatgccgtctgtagtggaaacattggagcagatgcagcggaaacacggtggcatgctggtccgcaaccccctcagtagaaattccacccatgagatgtactgggtgagctgcgggactggaaacattgtttcagctgtgaatatgacatccaggatgcttctgaaccgatttaccatggtccaccggaagccaacgtatgaacgtgatgtggacttaggcgcaggtaccagacacgtagccgtggagcctgaagttgctaacctggatatcatagggcagcgcattgagaatatcaaacatgaacacaagtctacatggcattacgacgaggataacccctataagacttgggcctaccacggaagctatgaggtcaaacctagtggctccgcaagctctatggtgaatggcgtggtcaagttgctcaccaaaccatgggacgttatccccatggtgacacaaattgccatgactgataccacacctttcgggcagcagagggtatttaaggaaaaagtggacacccggactccaaaggctaagagaggaacggcgcaaataatggaggtcacagccaaatggctgtggggtttcctatcacgcaacaagaaacccaggatctgtacccgagaagagtttactcggaaggtgagaagtaatgcagctattggcgccgttttcgtggacgaaaaccagtggaactccgcaaaagaggccgtcgaggatgaaaggttttgggaccttgtgcatcgcgagcgtgaactgcacaagcaggggaagtgcgctacctgcgtatacaacatgatgggaaaacgggagaagaaactcggcgagttcggtaaggccaaagggagcagagcgatctggtacatgtggctgggagcaaggttcttggagtttgaggccctgggcttcatgaatgaagatcactggttttctcgcgagaactcgctctcaggcgttgaaggggagggacttcataagctgggttatattttacgagacatcagcaaaataccgggcgggaatatgtacgctgatgacacagccggatgggatacgcggatcaccgaggacgatctgcagaacgaagcaaagattactgacatcatggagcctgaacacgctttgctcgccaagtccattttcaaactgacatatcaaaataaggtggtcagagtgcagaggccagctaaaaacggcaccgtgatggatgtcatcagtcgcagagaccagcggggttctgggcaggttggaacttacggcctaaatacatttaccaacatggaggcccaacttataaggcagatggaaagcgagggcattttctccccctcagagctggaaacacctaacctcgcagggcgtgtgtttgattggctggagaagcatggagtagaacgattgaaacgcatggcgatcagtggtgacgactgtgtggtcaagccaatcgatgacagattcgccactgctttaaccgccctgaatgatatgggcaaggtgcggaaagacattccccagtgggagccgtctaaggggtggaacgattggcagcaagttcctttttgcagccaccacttccatcagctcataatgaaagacggaagggaaatcgtggtcccctgtcgcaatcaggatgagcttgtgggcagagcacgggtatcccagggtgctgggtggtcactgagggagacggcctgcctaggaaagagctatgcacaaatgtggcagctgatgtactttcaccgacgtgacctcagattggccgcgaacgctatttgttctgccgttccagtggattgggtccctacctcccgcacaacttggagtatccatgcacaccatcagtggatgaccacagaagacatgctgagcgtgtggaatcgggtttggattgaggaaaacccctggatggaggataaaactcacatctcgtcctggggcgacgtgccatatcttggcaagagggaagaccaatggtgcgggtctctgataggactcaccgccagagctacgtgggccacaaatatccaggtcgcaattaaccaggtgcgccggttaatcggtaatgagaactacctggattacatgacctcaatgaagaggttcaaaaatgagagcgaccccgaaggcgctttgtggtga

SEQ ID NO: 14004 - RNA, 9879 nt, synthetic construct
  misc_feature 1..9879: note = derived and/or modified CDS sequence (opt3) from DENV-1__EU482801__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgggagagccgtgctggatgacggaatatataggatcatgcagcgtggtcttttaggccgcagccaggttggggtaggagtgtttcaagagaacgtcttccataccatgtggcacgtgacacggggcgcggttctgatgtaccagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtatggaaatggcgtcgtgacaacttcaggcacctacgtttccgccatcgcacaggctaaggccagtcaggaagggccccttcctgagattgaggacgaagtgtttcggaaacgcaacctgacaatcatggatttgcacccgggatctggtaagaccagaaggtatctaccagcgattgtccgggaggccatcaaacgaaagctgagaactctcatattagcacccacccgcgtggtagctagcgaaatggccgaggctctgaagggcatgcctattaggtaccaaacaacggcagtgaaatccgaacatactgggaaggagatcgttgaccttatgtgccacgccaccttcacaatgcgtctgctctcaccagtccgggtgcccaattataacatgatcattatggatgaggcccattttaccgacccttctagcatcgctgcgagaggatacataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatatgagtggatcacggatttccccggcaaaactgtgtggtttgttccatccataaagagtggcaatgacattgctaactgtttgaggaaaaatgggaagcgggtgatccagctgagcaggaagacattcgataccgagtaccagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtatatctacatgggtcagcccctaaacaatgacgaggatcatgcccactggacagaggctaagatgctgttggacaacattaatactccagaagggatcatccccgccttatttgagcctgaaagggagaagtccgcggcaattgatggcgaatatcgcctgagaggagaggccaggaaaacgttcgtggagctcatgcggcgtggcgacctgccagtttggcttagctacaaggtcgcttcagaagggtttcaatatagtgatcgccgatggtgcttcgacggagagagaaacaatcaggtgctggaagagaacatggatgtggaaatatggaccaaagagggtgagaggaagaaactccggccccgctggttggacgccagaacatactctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatataggcacgcgatggaggaactcccagataccatcgagacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggaaccccattggatagctgcctccatcattttggagtttttcctgatggttctcctgatccctgaacccgaccgtcagagaaccccacaggataaccaacttgcatacgtggtcattggtctcctgtttatgatcttgacagtagccgctaatgagatgggcctgttagagactaccaagaaagacctagggataggacacgtggcggttgaaaaccaccatcacgccgcaatgctggatgtggacctccatcctgcttcagcctggacactttacgccgtcgcaaccactattatcacacccatgatgaggcacacgattgagaacaccactgctaatatctctctgacagccatagcgaaccaggctgccatcttgatgggcctggataagggttggccaattagtaaaatggacatcggggtgcctctcctggcacttggctgctattcgcaggtcaatccgttaaccctgaccgccgctgtgctcatgttggttgcacattacgccattatcggacccggcctgcaagcgaaggctacacgcgaagcccagaaacggactgcagccgggataatgaagaacccaacggtggatggaattgtagctatcgacctagatcctgtggtctatgacgccaagttcgagaaacagctgggccagatcatgctccttattctgtgtaccagccaaatcttgctgatgcgaacaacttgggcactctgcgaatccataaccctggctacaggtcccttaaccactctttgggaggggtctccaggaaagttttggaatacgacaattgccgtttcaatggcgaacatcttcagaggcagctacctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctataagagatcagggattatggaagtggaccgttccgaggcaaaagaaggacttaagaggggcgagacaactaaacacgctgtcagtcggggtaccgccaagctgcgctggttcgtggagcgaaatttggtaaaacctgaaggcaaggtgatcgatctggggtgtggaagaggcgggtggagctactattgcgccggactcaagaaagttacagaggtgaagggctacacgaaaggtgggcccggacacgaggagccgataccaatggcgacctacggctggaacttagtcaagctgcattctggcaaagacgtgtttttcatccctcccgaaaagtgtgatactcttctgtgcgacattggggagtcctcaccaaatcccacaatcgaggaaggaaggaccctacgggtcctcaaaatggtggagccttggctgcgcggtaaccaattttgtattaagatcttgaatccgtatatgcccagcgttgtagaaactctggagcagatgcagagaaagcacggcgggatgctcgtgaggaacccactttcgcgaaattctacacatgagatgtactgggtcagttgcggaaccggcaacattgtgtccgctgttaatatgacgagccggatgctgttaaaccgtttcaccatggcacacagaaaacctacatatgaacgcgatgtggacctgggtgccgggactaggcacgtcgctgtggagcccgaagtagccaacttggatatcataggacagcggattgagaatatcaagcatgaacacaaatcaacctggcattacgacgaggataacccttataagacatgggcataccacggctcctatgaggtgaaaccatctggcagcgccagttccatggttaatggggtcgtgaagctcctgactaagccctgggacgtgatccctatggtcacccaaattgctatgacagataccactccatttggacagcagagagttttcaaagaaaaggtggacacgcgcacacccaaagcgaagaggggtaccgcccaaataatggaggtaactgcaaaatggctatggggctttcttagccgaaacaagaagccgcggatctgtaccagagaagagttcacaaggaaagtgcgctctaatgctgccattggggcagtctttgtggacgaaaaccagtggaactcagccaaggaggctgttgaggatgaacgtttctgggacctggtgcatcgggagagagaactccacaaacagggaaagtgcgccacgtgcgtctacaacatgatgggcaaaagggagaagaagctgggtgaatttgggaaagcgaagggaagtcgcgcaatctggtacatgtggttgggcgcccgattcctggagttcgaggctctcggctttatgaatgaagatcactggttctcccgggagaacagcctttctggggtggaaggagagggtctgcataaattaggctatattctgagagacatctcgaatatacctgggggaaacatgtacgccgatgacaccgcaggctgggatactaggatcacagaggacgatttgcagaatgaagctcgcattaccgacatcatggagccagaacacgccctcctggctaagtcaatttttaaactaacttatcaaaacaaggtagttagagtgcagcggcccgccaaaaatggtacagtcatggatgtgatcagcaggcgtgaccagcgagggtccggacaggtgggcacctacggccttaacacattcactaacatggaggcacaactgatacgccagatggaaagtgaggggatattttctcctagcgagctcgaaaccccaaatctggcggagagagtcttggattggttagaaaagtatggagttgagcggctgaagaggatggccatctccggtgacgactgtgtggtaaaacccatcgatgaccgcttcgctacggccctcaccgcacttaacgatatgggcaaggtgagaaaagacattccgcagtgggaaccttcaaaggggtggaatgattggcagcaagtccccttttgcagtcatcacttccaccagctgataatgaaagacggacgggagatcgtggttccatgtaggaaccaggatgagctagtgggccgagctcgtgtctctcagggtgccgggtggagcctgagagaaacagcatgcctcggaaagtcctacgcccaaatgtggcagttgatgtattttcatcgccgggacctgaggcttgcggctaatgccatttgttcagcagtgcctgtagattggatccccactagcagaaccacatggtctattcacgcccatcaccagtggatgactaccgaggacatgctgtccgtttggaaccgcgtgtggatcgaagagaatccatggatggaagataagacgcatataagtagctggggcgacgtcccctacctcggcaaacgggaggaccaatggtgcgggtcgttaatcggactgacagctagggccacctgggcaactaacattcaggtggctatcaatcaggttcgaagattgattggtaacgagaattacctggattatatgacatccatgaagcggttcaaaaacgaatctgaccctgagggcgccctctggtga

SEQ ID NO: 14005 - RNA, 9879 nt, synthetic construct
  misc_feature 1..9879: note = derived and/or modified CDS sequence (opt3) from DENV-1__EU482802__SS-prME
  source 1..9879: mol_type = other RNA
agcgtgaccatgctgctcatgcttatgcccaccgccctggctttccacttgactacgaggggcggggaacctcatatgatcgtctccaagcaggaaagggggaaatctttactgtttaagacctcagctggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtcttctccccctgtgtttgtctaccacgtcccagaaaacaacctggctgccggtattactcggcagcctggggtgcaagcctcttactatgtttctgattgccgagaataaaatctggggaagaaagtcgtggccattgaacgaaggtataatggccgtgggcatcgtttcaattctcctgtctagtctactgaaaaacgatgtgccccttgctgggcctctcatcgcaggaggcatgctgattgcctgttacgtcatctccggtagctctgcggacttgagcttagagaaggctgccgaggtgtcctgggaagaggaagcagagcattcaggggccagtcacaatatactggtagaagtgcaggatgacggaacaatgaaaattaaggatgaggagagggacgataccctcactatcctgcttaaggctacactgttggcagtcagcggcgtttatcccctatctatcccagccaccctgttcgtgtggtacttctggcagaaaaagaaacaacgatccggcgtgctctgggacacgccttcacccccagaagtcgagcgcgcggtgctggatgacgggatttatcggataatgcagagaggacttttaggtaggagtcaggttggcgtaggggtgtttcaggaaaacgtcttccatactatgtggcacgtgacccgtggagctgttctgatgtaccaaggcaagcgcctcgagccgagctgggcctccgtgaaaaaggacttgatctcttacggtgggggatggcggctgcagggctcgtggaatacaggcgaggaagtccaggtgattgcagtagagcctgggaagaaccccaaaaatgtccagaccgccccaggaacatttaagactagcgaaggtgaggtgggcgctatcgccctcgatttcaaacccgggacctcaggatcccctattgttaacagagaaggcaagatcgtgggtctgtatgggaatggagtcgtgacgacaagtggcacttacgtttctgcaatagctcaagccaaagcgagccaggagggcccacttcccgagatcgaagacgaggtgtttaggaagcgaaacctgaccattatggatttgcaccctgggtccggaaagacacggcgctatctaccggccatcgtcagagaagcaattaaaaggaagctgcggaccctcatcttagctccaactcgagtggtagcctcagagatggctgaagcactgaaaggtatgcccataagataccagaccacagccgtgaagtctgagcatacgggcaaagagattgttgaccttatgtgccacgccactttcaccatgcgcctgctcagccctgtcagggtgccaaattataacatgatcatcatggatgaagctcattttacagaccccagttccattgcggcacgtgggtacatcagcacccgggtgggaatgggcgaggccgctgccatattcatgactgcaacacctccgggttctgtcgaagcctttccccaatcaaatgctgtaattcaggatgaggaaagagacatcccagagaggtcctggaacagtgggtatgagtggattaccgatttccctggaaagacggtgtggtttgttcccagcatcaagtcgggcaatgacatagcgaactgtttgcgcaaaaatggcaagcgagtgattcagctgtctagacggactttcgatacagaataccagaaaaccaagaacaacgactgggactacgtcgtgaccactgatatctccgagatgggggccaatttcagggcagaccgcgttatcgatccacgtagatgcctcaaacctgtgattctgaaggacggacccgaacgggtcatccttgctggtccaatgccggtgacagtagccagcgcagcccaaaggcgcggccgaattgggagaaaccacaataaggagggagatcagtatatatacatgggccagcctctaaacaatgacgaggatcatgctcactggaccgaagccaaaatgctgttggacaacatcaatacacccgagggtattatcccagcgttatttgaacccgagcgggaaaagtcagcagccatcgatggggagtataggctgcgcggcgaggctagaaaaactttcgtggaactcatgaggcggggagacctgcctgtttggcttagttacaaggtcgcctctgagggctttcagtattccgatcgtcgctggtgcttcgacggggaacgaaacaatcaagtgctggaggaaaacatggatgtggagatttggacgaaagagggagaaagaaagaaactcaggccacggtggttggacgctcgcacctacagcgaccccctggcactaagagagtttaaggagttcgccgctggtaggcggtcagtcagtggcgatctgatactcgagatcgggaaacttcctcagcacctgacacagcgagcccagaatgcattagacaacttggttatgctgcataatagcgaacaaggaggcagagcgtatcgccacgccatggaggagctcccggatactattgaaaccctgatgcttctggctctcatcgccgtgttgacaggtggggtaaccctgtttttcttatccggcaggggactaggcaaaacttctattgggctgctctgtgtgatggcaagctccgcacttctgtggatggcctcagtcgagccacattggatcgcagcctctataatcttggaatttttcctgatggtgctcctgattcccgagcctgaccggcagcgtacgccccaggataaccagcttgcttacgttgtgatcggactcctgtttatgattttgaccgtcgcggccaatgagatgggtctgttagaaacaactaagaaagacctaggcatcgggcacgtagcagtggagaaccaccatcacgctgccatgctggatgttgacctccatccagccagtgcatggaccctttacgctgtggccacaaccataattactcctatgatgagacacacaatcgaaaacacgaccgcgaatatttcgctgactgctatcgccaaccaagcagccatattgatgggactggataagggctggcccatcagcaaaatggacattggtgtcccactcctggctcttgggtgctattcccaggtgaatcctttaacactgaccgcagccgtcctcatgttggtggcgcattacgctatcattggcccgggactgcaggccaaggcaaccagggaggcccaaaagcgcacagctgccggcatcatgaaaaaccccactgttgatgggatagtggcaattgacctagatccagtagtgtatgacgctaagttcgaaaaacagctgggacagatcatgctccttatcctgtgtacgtctcagattttgctgatgcggaccacatgggccctctgcgagtcaatcactctggcgaccggccctttaacaaccctttgggagggtagccccgggaagttttggaatactacgatagccgtctccatggcaaacattttccgaggaagttacctggctggcgccggtctcgcattctctctaatgaaaagcctgggcgggggaagaaggggcacaggggctcaaggagaaaccttgggcgagaagtggaagcgccagctgaatcagctctcaaaatccgaatttaacacttataagcggagtggtatcatggaggttgacagaagcgaagccaaagaggggcttaagcgtggagagaccacaaaacacgccgtgtctaggggcactgcgaagctgcggtggttcgtcgaacgcaatttggtgaagccagagggtaaagtaattgatctgggctgtgggcgaggaggctggtcctactattgcgctgggctcaagaaagtgaccgaagttaagggatacacaaaaggcggtcctgggcacgaggaacccatcccgatggcaacgtacggatggaacttagtgaagctgcattcaggcaaagacgtctttttcataccacctgagaagtgtgatacccttctgtgcgacatcggcgagagctcgcccaatccaactattgaagaggggagaacactaagggtgctcaagatggtcgaaccctggctgcggggaaaccagttttgtatcaaaattttgaatccttatatgccgtctgtggttgagaccctggagcaaatgcagcgcaagcacggtggcatgctcgtaagaaacccccttagtagaaattccactcatgaaatgtactgggtgagctgcgggacaggaaacatcgtctcagccgtgaatatgacctcccgaatgctgttaaaccggttcacgatggctcaccgtaaaccaacctatgagagagatgttgacctgggcgccggtacacgccacgtggcagtcgaacctgaggtggccaacttggatattatcgggcagaggatagaaaatattaagcatgagcacaaatctacttggcattacgacgaggataacccctataagacctgggcttaccacggaagctatgaagtaaagcctagtggctccgcgagctctatggtgaatggcgttgtcaaactcctgacaaagccatgggacgtgatccccatggtgactcagatcgccatgaccgatacaaccccttttgggcaacagcgggtcttcaaagagaaggttgacactagaacgccaaaatcaaagcgcggaacagcacagattatggaagtgaccgctaagtggctatggggttttcttagtaggaacaaaaagccccgaatatgtactcgggaggagttcaccagaaaagtaaggtccaatgccgcaatcggcgccgtgtttgtcgacgagaaccaatggaatagcgctaaggaggccgtggaagatgagcgcttctgggacctggttcatcgtgaacgggagctccacaaacaggggaagtgcgcgacatgcgtgtacaacatgatgggaaagagagagaagaagctgggcgagtttggtaaagcaaaggggtctagggccatttggtacatgtggttgggagctcgcttcctggagttcgaagccctcggctttatgaatgaggatcactggttctcgcgagaaaactcacttagcggcgtcgagggggagggactgcataaattaggttatatcctgcgggacatttccaagatcccgggcgggaatatgtacgcagatgacacggctggatgggataccagaataactgaagacgatttgcagaacgaggccaaaatcacagacattatggaacctgagcacgctctcctggccaagagtatctttaagctaacctatcagaataaagtggtaagggttcaacgcccagcaaagaacggcactgtgatggatgtcatttctagacgggaccagaggggtagcggacaggtgggaacatacggccttaataccttcacaaacatggaagcgcagctgatccgtcaaatggagtccgagggcatattttcacccagtgaactcgagactcctaacctggccgggcgagtgttggattggttagaaaaacatggagtcgagcgcctgaagagaatggctatttctggtgacgactgtgttgtgaaaccaatcgatgaccggttcgccaccgcactcacggctcttaatgatatgggcaaggtaaggaaggacatcccccagtgggaaccgagcaaagggtggaacgattggcaacaggtgcctttttgctcccaccacttccatcaactgattatgaaggacggacgcgagatagtcgtgccctgtagaaatcaggatgagctagttggccgggccagggtgtcacagggtgcagggtggagcctgcgagaaaccgcctgcctcggaaaatcttatgcgcagatgtggcaattgatgtactttcaccgtagagacctgcgccttgctgccaacgcaatctgttccgccgtcccagtggattgggtacctacaagtcggactacctggagcattcatgctcaccatcagtggatgacaactgaggacatgctgtcggtttggaatagggtgtggatcgaagagaacccctggatggaagataagacccacatttcctcttggggcgacgtcccatatctcggcaaaagagaggaccagtggtgcgggtcattaatcggactgacggcccgcgcaacatgggctaccaatatacaagtggccatcaaccaggttcggaggttgattggtaatgagaactacctggattacatgactagcatgaagcgattcaagaatgaaagtgaccccgagggcgcgctctggtga

SEQ ID NO: 14006 - RNA, 9879 nt, synthetic construct
  misc_feature 1..9879: note = derived and/or modified CDS sequence (opt3) from DENV-1__EU482804__SS-prME
  source 1..9879: mol_type = other RNA
agcgtgaccatgctgctaatgcttatgcccactgcactggctttccacttgactacgcgaggcggggaacctcatatgatcgtctccaagcaggaaagggggaaatctttactgtttaagacctcagccggtgttaacatgtgcaccctaattgcaatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaaggtggtccagtacgaaaacctgaaatattcagtgattgttacagtgcacaccggagaccagcatcaagtcggtaatgagagtactgaacacggcacgacagccaccatcactccccaggcgcctagcaccgagattcagttaacagactacggggccctgaccctcgattgttctccaaggactggacttgactttaacgaaatggtgctgttgacaatgaaggagaaatcctggctagtacataagcagtggttcctggatctcccgctgccctggacgtcaggcgcaagcaccagtcaagagacttggaatcggaaagaccttctggttacatttaagaccgctcacgccaagaaacaggaagtggtcgtgttgggttctcaggagggggctatgcacacagccctcactggcgcaaccgaaatccaaacgtccggaaccacaactatcttcgccggccatctgaagtgccgtttaaaaatggataagctgaccctaaaagggatgagctatgtcatgtgtacaggatcgttcaagctcgagaaggaagtggctgagactcagcacggtaccgttctggtgcagattaaatacgagggcacggacgcgccttgcaagataccattttctacacaggatgaaaaaggggtaacccaaaacggacgccttatcactgcaaatcccattgtcacagacaaggagaaacctgtgaacatcgaagccgagccacccttcggcgagtcctatatagttattggtgctggggaaaaggccttgaagctgtcatggtttaaaaagggcagtagcatcggaaaaatgttcgaggcaaccgccagaggcgctaggcggatggccatcctcggggatactgcatgggactttggatccattggtggcgtgttcacctctgtcgggaagctggtgcatcagatctttggaacagcgtacggcgtacttttcagcggtgtgtcatggacgatgaaaattgggataggcgttctgttgacctggctcggactgaatagtcgatccactagcttatctatgacatgtatcgctgtcggcctggtgaccctatacctcggggtgatggtccaggccgattcaggatgcgttattaactggaagggccgcgaactgaagtgtggtagtgggatctttgtgacaaatgaggtgcacacttggaccgaacagtataaattccaagcagacagcccgaagagactttccgccgctatcggaaaagcctgggaggagggcgtatgcggtattaggtctacgacacggttggaaaacataatgtggaagcagatctcgaacgagctgaatcatattctcctggaaaacgacatgaaatttaccgtcgtggttggcgatgtggcagggatcttagctcagggaaagaaaatgattcgccctcagcccatggagtacaagtatagctggaagtcctggggcaaagccaagatcataggggcggacgtccaaaatactaccttcatcattgatggaccaaacacacctgaatgtcccgacgatcagagagcctggaatatctgggaggtggaggactacggctttggtattttcactaccaacatctggctgaaacttagggattcatatacacaggtttgcgaccaccgtttgatgagtgctgcaataaaggattctaaagccgtgcacgctgacatggggtactggattgaaagcgagaagaatgaaacgtggaagctcgcccgggcatccttcatcgaggtaaaaacctgtatttggccaaagtcacatactctgtggagcaacggagtcctagaatctgagatgatcatacccaaaatctatggcggtcctatttcccagcacaattaccgaccaggctactttacacaaaccgcggggccgtggcatctgggaaagctcgagctggatttcgacctttgcgaaggcactacagtggtggtcgatgagcactgcgggaacagaggacccagtttgaggaccacgactgttaccggcaaaatcattcacgaatggtgttgccgcagctgtacactgcctccattacggtttaagggtgaggacgggtgctggtatggaatggagatcagacccgtgaaggaaaaagaggaaaatctcgtaaagtctatggtgtccgccggctcaggtgaggtcgacagtttcagcctgggccttctgtgtatatcgattatgatcgaagaggtgatgaggtcccgctggtctcgaaaaatgttgatgaccgggactctcgctgtatttttcctgctaatcacaggacagctgacctggaacgatctcattcggctgtgcatcatggtgggcgccaatgcaagcgaccgtatggggatgggaacaacttaccttgctttgatggccacctttaagatgagacctatgttcgcagtcggcctgttatttaggcgcctcacgtcacgggaggtgctgcttctgacaattggtctaagtctcgttgcctccgtggaactgccaaactctttggaggaactgggggatggattagctatgggcataatgatcctcaaactgcttaccgacttccagagccatcaactgtgggcgactttgctctccctgacctttattaagacaactttctcactacactatgcctggaagaccatggcaatggtcctgagcatcgtaagtctttttcccctctgtctgtctacgacatcccagaaaaccacttggttgccggtgctgttaggcagcctcgggtgcaagcctctgacaatgttccttattgctgagaataaaatctggggaagaaagtcgtggccactgaacgaaggtataatggccgttggcatcgtgtcaattttgctctctagtctgctcaagaatgatgtccccctggccgggcctcttatcgctggaggcatgctcattgcatgttacgtgatctccggtagctctgccgacctgagcttggagaaggcggctgaggtatcctgggaagaggaagccgagcattcaggggcaagtcacaatatattagtggaagtccaggatgacggaaccatgaaaattaaggatgaggagagggacgatactctgacaatcctcctgaaggccacccttctggctgttagcggcgtgtatcccttgtctatcccagcaacgctattcgtgtggtacttttggcagaaaaagaaacaacgatccggcgtcctgtgggacactccttcacccccagaagtggagcgcgccgttctcgatgacgggatttatcggataatgcagagaggactgcttggtaggagtcaggtaggcgtgggggtcttccaggaaaacgtgtttcataccatgtggcacgttacacgtggagcggtgttaatgtaccaaggcaagcgcctggagccgagctgggcttccgtcaaaaaggacctcatctcttacggtgggggatggcggttgcagggctcgtggaataccggcgaggaagtgcaggtaattgccgtcgagcctgggaagaaccccaaaaatgtgcagacagcaccaggaactttcaagaccagcgaaggtgaggttggcgccatcgctctggattttaaacccgggacgtcaggatcccctattgtgaacagagaaggcaagatcgtcggtctctatgggaatggagtggttacaacaagtggcacctacgtgtctgccatagcacaagctaaagccagccaggagggcccactgcccgagatcgaagacgaggtcttcaggaagcgaaaccttacaattatggatctgcaccctgggtccggaaagacccggcgctatttgccggcgatcgtgagagaagccattaaaaggaagctacggactctgatcctcgcaccaacccgagtagtggcttcagagatggccgaggctttaaaaggtatgcccataagataccagacaacggcagttaagtctgagcatactggcaaagagattgtcgacctgatgtgccacgccacctttacaatgcgccttctgagccctgtgagggtgccaaattataacatgatcatcatggatgaagcccatttcaccgaccccagttccattgctgcgcgtgggtacatcagcactcgggtcggaatgggcgaggcagccgctatatttatgacagccacccctccgggttctgtagaagcattcccccaatcaaatgccgtgattcaggatgaggaaagagacatcccagagaggtcctggaacagtgggtatgagtggattacggattttcctggaaagactgtttggttcgtgcccagcatcaagtcgggcaatgacatagctaactgtctccgcaaaaatggcaagcgagtcattcagttgtctagaaaaacattcgataccgaataccagaagaccaaaaacaacgactgggactacgtggttactacagatatctccgagatgggggcgaattttcgggccgacagggtgatcgatccacgccgttgcctgaagcctgtcattctcaaggacggacccgaaagagtgatcctggcaggtccaatgccggtaaccgtggctagcgccgcacaacggaggggccgcattgggcgaaaccacaataaagagggagatcagtatatatacatgggccagcctcttaacaatgacgaggatcatgcccactggacagaagctaagatgctactggacaacatcaatactcccgagggtattatcccagccttgttcgaacccgagagagaaaaatcagcggcaatcgatggggagtatcggttaaggggcgaggcccgcaagacgtttgttgaactgatgagaaggggagacctccctgtctggctgagttacaaagtggcttctgagggcttccagtattccgatcggcgttggtgctttgacggggaacgcaacaatcaagtgcttgaggaaaacatggatgtcgagatttggaccaaggagggagaaagaaagaagctgagaccaaggtggctcgacgcccggacatacagcgaccccttggctctgcgcgagttcaaggaatttgcagccggtagaaggtcagttagtggcgatctaatactggagatcgggaaactccctcagcaccttactcagcgggctcagaatgccctggacaacttagtgatgttgcataatagcgaacaaggaggccgagcatatagacacgcgatggaggagctgccggataccattgaaacactcatgctgcttgccctgatcgctgtactcaccggtggggtgactttgttctttctgtccggccgcggattaggcaagacgtctattgggctactgtgtgtcatggccagctccgtgctcctttggatggcatcagttgagccacattggatcgctgcctctataatcctggagttctttttgatggtgctgctcattcccgagcctgacaggcagcggacaccccaggataaccagctggcatacgtcgtaatcggacttctcttcatgattctgacagtggccgctaatgagatgggtttgctggaaactaccaaaaaggacttaggcatcgggcacgttgcggccgagaaccaccatcacgcagctatgctagatgtggacctgcatccagccagtgcctggacactctacgcagtcgctaccactataattacacctatgatgcgtcacacgatcgaaaacaccactgccaatatttcgcttacagcgatcgctaaccaagccgcaatactgatgggattggataaaggctggcccatcagcaagatggacattggtgtgccactgctcgccctggggtgctattcccaggtcaatcctcttaccttaaccgctgcagtgctgatgctcgttgcccattacgcgatcattggcccgggattgcaggctaaggccacaagagaggcacagaaaaggactgccgctggcatcatgaagaaccccacggtggatgggatagtagccattgacctggatccagtggtctatgacgcaaaatttgaaaagcagctaggacagatcatgctgctcatcctttgtacctctcagattctgttgatgcgcacaacttgggctctgtgcgagtcaatcaccctcgccacaggccctctgaccactttatgggagggtagccccgggaaattctggaatacgacaatagcggtttccatggccaacattttccggggaagttaccttgcaggcgctggtctggccttttctctcatgaaaagcctaggcgggggacgaagaggcaccggggcacaaggagaaactctgggcgagaagtggaaaaggcagttgaatcagctgtcaaagtccgagttcaacacctataaacgcagtggtatcatggaggtggaccggagcgaagctaaggaggggctcaaaagaggagagacaactaagcacgccgtctctcgtggcaccgccaaacttaggtggtttgtggaacggaatctggtaaaaccagagggtaaggtgattgatttgggctgtgggcgcggaggctggtcctactattgcgcggggctgaaaaaggttacagaagtgaaaggatacacgaagggcggtcctgggcacgaggaacccatcccgatggctacctacggatggaacctcgtcaaattacattcaggcaaggacgtgttctttataccacctgagaagtgtgatactctgctttgcgacatcggcgagagctcgcccaatccaacaattgaagaggggcgaaccctgagagtcctaaaaatggtggaaccctggctcaggggaaaccagttctgtatcaagattctgaatccttatatgccgtctgttgtagagactttggagcaaatgcagcggaaacacggtggcatgctggtgcgcaaccccctcagtagaaattccacacatgaaatgtactgggtcagctgcgggaccggaaacatcgtgtcagcagttaatatgacgtccaggatgcttctgaaccgatttaccatggcccaccggaagccaacatatgagcgtgatgtggacttaggcgctggtactagacacgtcgccgtggaacctgaggtagcaaacctggatattatcgggcagcgcatagaaaatattaaacatgagcacaagtctacctggcattacgacgaggataacccctataagacatgggcctaccacggaagctatgaagtgaaacctagtggctccgctagctctatggttaatggcgtcgtgaagttgctcactaaaccatgggacgtgatccccatggtcacccagatcgcgatgacagataccactcctttcgggcaacagagggtttttaaggagaaagtggacacgcggacaccaaaggccaagagaggaaccgcacagattatggaagtaactgctaaatggctgtggggtttcctatcacgcaacaagaaacccaggatatgtacccgagaggaatttacacggaaggtgagaagtaatgccgcaatcggcgccgtcttcgtggacgagaaccaatggaactccgctaaagaggccgttgaagatgagaggttttgggaccttgtgcatcgcgaacgtgagctgcacaagcaggggaagtgcgcgacgtgcgtctacaacatgatgggaaaacgggaaaagaaactcggcgagttcggtaaggcaaaagggagcagagccatttggtacatgtggctgggagctaggttcttggagtttgaagccctgggcttcatgaatgaggatcactggttttctcgcgaaaactcgctctcaggcgtggagggggagggacttcataagctgggttatatcttacgagacattagcaaaatcccgggcgggaatatgtacgcagatgacaccgctggatgggatactcggataacagaagacgatctgcagaacgaggccaagatcaccgacattatggaacctgagcacgctttgctcgccaagtccatcttcaaactgacttatcagaataaggtagttagagtgcaaaggccagccaaaaacggcacagtcatggatgtgattagtcgcagagaccagcggggttctggacaggtgggaacctacggcctaaatacatttactaacatggaagcgcagcttatcaggcaaatggagagcgagggcatattctccccctcagaactggagacccctaacctcgccgggcgtgtcctggattggttggaaaagcatggagttgagcgattaaaacgcatggctattagtggtgacgactgtgtggtaaagccaatcgatgacagatttgccacggcactgaccgctctcaatgatatgggcaaggtgcggaaagacatcccccagtgggaaccgtctaaggggtggaacgattggcagcaggtccctttctgcagccaccactttcatcaacttattatgaaagacggaagggagatagtggttccctgtcgcaatcaggatgagctggtgggcagagcccgggtctcccagggtgcagggtggtcactaagggaaacagcctgcctgggaaagagctatgcgcagatgtggcaactcatgtacttccaccgacgtgacttgagactggctgccaacgcaatctgttctgccgtgccagtagattgggttcctacttcccgcaccacatggagtattcatgctcaccatcagtggatgactaccgaggacatgcttagcgtgtggaatcgggtctggatcgaagagaacccctggatggaagataaaacgcacatttcgtcctggggcgacgtgccatatctgggcaagagggaggaccagtggtgcgggtctctcatcggattaacagccagagcaacctgggctactaatatacaagttgccatcaaccaggtgcgccggctgattggtaatgagaactacttggattacatgacatcaatgaagaggtttaaaaatgaaagcgaccccgagggcgcgctgtggtga

SEQ ID NO: 14007 - RNA, 9879 nt, synthetic construct
  misc_feature 1..9879: note = derived and/or modified CDS sequence (opt3) from DENV-1__EU482806__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaaaaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctactgctcattatgggacagctgacatggaacgatcttatccggttgtgcattatggttggcgccaatgcatctgaccgtatggggatgggaaccacatatctggctttaatggccacttttaaaatgagacctatgttcgcagtgggcctcctgtttaggcgccttaccagccgggaggtcctgctactcacgataggtctgtcattggtggccagtgttgaactgccaaactccttagaggaactcggggatggactggctatgggcatcatgattcttaagctgttgacagacttccaatctcaccagctctgggcgaccctgctaagcctgacttttatcaaaaccacactttccctccattacgcctggaagactatggcaatggtgctgtcaattgtcagcttgttccccctgtgtttaagtaccacgtctcagaagacaacctggctcccggtactgcttggctccctggggtgcaaacctttgactatgtttctcatcgctgagaataagatatggggaagaaaaagctggccactgaacgaaggtatcatggccgtgggcgttgtgtcgattctactgtcatctcttctcaagaacgatgtccccctggccgggcctttgatcgctggaggcatgttaattgcatgttatgtgatcagtggttccagcgccgacctgtctctcgagaaagcggctgaggtaagctgggaagaggaagccgagcactccggggcatcacataatatactggtggaagtccaggatgacggaacaatgaagattaaagatgaggagagggacgatacccttactatcctgttgaaggccacactactggctgttagtggcgtgtaccccctcagcatcccagcaaccctgttcgtgtggtatttttggcaaaagaaaaagcagcgatctggcgtcctttgggacacgccttcacccccagaagtggagcgcgccgttttagatgacgggatttaccggataatgcagagaggactgctcggtaggagccaggtaggcgtgggggtcttccaagaaaacgtgttccacactatgtggcacgttacccgtggagcggtgttgatgtatcagggcaaacgcctggagccgagttgggctagcgtcaagaaagacctcatctcctacggtgggggatggcggctgcagggctcttggaatacaggcgaggaagtgcaggtaattgccgtcgagcctgggaagaaccccaagaatgtgcaaaccgcaccaggaacatttaaaactcccgaaggtgaggttggcgccatcgctcttgatttcaagcctgggacctcgggaagcccaattgtgaacagagaaggcaaaatcgtcggtctgtacgggaatggagtggttacgacatcaggcacttatgtgtccgccatagcacaggctaaggccagtcaggagggccccttgcctgagatcgaagacgaggtctttaggaaacgaaacctaaccattatggatctgcatccggggtctggaaagacacggcgctacctcccagcgatcgtgagagaagccattaagaggaaattacggaccctgatccttgcacccactcgagtagtggctagcgagatggccgaagctctgaagggtatgcctataagatatcaaaccacagcagttaaatccgagcacacgggcaaggagattgtcgacctcatgtgccatgccactttcaccatgcgcttgctgtcaccagtgagggtgcccaattacaacatgatcatcatggatgaagcccactttacagacccttctagcattgctgcgcgtgggtatatcagtacccgggtcggaatgggcgaggcagccgctatattcatgactgccacaccgcccggttccgtagaagcatttccacagagcaatgccgtgattcaggatgaggaaagagacatccctgagaggtcttggaactcagggtacgagtggattaccgatttccccggaaaaacggtttggtttgtgccatccatcaagagtggcaatgacatagctaactgtctccgcaagaatggcaaacgagtcattcagctgagcagaaagactttcgatacagaatatcagaaaaccaagaacaacgactgggactacgtggttaccactgatatctcggagatgggggcgaattttcgggccgacagggtgatcgatcctcgccgttgccttaaacccgtcattctaaaggacggaccagaaagagtgatcctggcaggtccgatgcctgtaacagtggcttctgccgcacagcggaggggccgcattgggcgaaaccataataaggagggagatcagtacatatatatgggccagcccttgaacaatgacgaggatcacgcccactggaccgaagctaaaatgttactggacaacatcaatacaccagagggtattatccccgccctcttcgaacctgagagagaaaagtccgcggcaatcgatggggagtaccggctgaggggcgaggcccgcaaaactttcgttgaacttatgagaaggggagacctgccagtctggctcagctataaggtggcttcagagggctttcaatacagtgatcggcgttggtgcttcgacggggaacgcaacaatcaggtgttggaggaaaacatggatgtcgagatttggacgaaagagggagaacgaaagaaactgagacccaggtggctagacgcccggacctattctgaccctctggctctccgcgagtttaaggagttcgcagccggtagaaggtccgttagcggcgatcttatactggagatcgggaagttaccgcagcatttgacacagcgggctcaaaatgccctggacaacctcgtgatgctgcacaattcagaacagggaggccgagcatacagacatgcgatggaggagcttccagatactattgaaaccctgatgctcttggccctgatcgctgtattaacaggtggggtgaccctatttttcctgagtggccgcggactcggcaaaactagcattgggcttctgtgtgtcatggcctcctctgtgttgctgtggatggcaagcgttgagccccactggatcgctgcctccataatcctcgaatttttcctgatggtgcttctcattcctgagcccgacaggcagcggacgccacaggataaccaactggcatatgtcgtaatcggattgctgtttatgattttaaccgtggccgctaatgagatgggtctactggaaacaactaagaaagacctcggcatcgggcacgttgcggtggagaaccatcaccatgccaccatgcttgatgtcgacctgcaccctgcatcagcttggacattgtacgccgtggccaccactataattacacccatgatgcgtcatacgatcgaaaacaccactgcaaatatttctctgacagctatcgccaaccaggcggctatactcatgggactggataagggctggccaatcagtaaaatggacattggtgtccctcttttagccctggggtgctacagccaggtgaatccgctcaccttgaccgcagccgttctgatgctagtggctcactatgcaatcattggccccggactgcaagccaaggcgacaagagaggctcagaagaggactgccgcaggcatcatgaaaaacccaacggtagatgggatagtggccattgacctcgatcctgtcgtttacgacgctaagttcgaaaaacagcttggacagatcatgctgttgatcctgtgtaccagccaaattctcctgatgcgcacaacttgggccttatgcgagtccatcacccttgcaacaggccccctgaccactctctgggagggttctccagggaagttttggaatacgacaatagctgtgtcaatggccaacattttccggggaagctatctagcgggcgccggtctggcattttccttgatgaaaagtctgggcgggggacgaagaggcaccggggctcagggagaaactctcggcgagaagtggaagaggcagcttaatcagctgtctaaaagcgagttcaacatctacaagcgctcaggtattatggaggtcgaccggtccgaagccaaagaggggttgaagagaggagagaccacacgtcacgcagtgagtaggggcactgctaaactgcggtggttcgtagaacgcaatctcgtgaagcctgagggtaaggttatcgatttaggctgtgggcgaggaggctggagctattactgcgccgggctgaaaaaggtgaccgaagtcaaaggatatacaaagggcggtcccgggcatgaggaaccgataccaatggccacgtacggatggaaccttgtgaaactgcactctggcaaggacgtctttttcacccctcccgagaaatgtgatactctactctgcgacatcggcgagtcctcaccaaatcccacaattgaagaggggagaaccctgagggtgttgaagatggttgaaccttggctgcggggaaaccaattttgtatcaagattctcaatccgtacatgcccagcgtagtggagactcttgagcagatgcagcgcaaacatggtggcatgctggtcagaaacccattatcgagaaattctacacacgaaatgtattgggtgagttgcgggaccggaaacatcgtttccgcggtgaatatgacgagccgaatgctgttgaaccggttcaccatggctcaccgtaagcctacatacgagagagatgtcgacctcggcgcaggtactcgccatgtggccgtagaacccgaggtggctaacctggatattatcgggcagaggatagaaaatattaaacacgagcataagtcaacctggcactatgacgaggataacccttacaaaacatgggcctatcatggatcctacgaagttaagccatctggcagcgcaagttccatggtcaatggcgtggtgaagctacttactaaaccctgggacgtcatccctatggttacccaaatcgccatgacagataccactccatttgggcagcagcgggtgttcaaggagaaagtagacacgagaacacccaaggctaaacgcggaaccgcgcaaattatggaagtgactgccaggtggctgtggggttttctcagccgaaacaagaagccgcggatatgtaccagagaggagttcacaaggaaagtccgctctaatgcagctatcggcgccgtgtttgttgacgagaaccagtggaactcagcaaaggaggccgtggaagatgagcgtttctgggacctggtccagaaagaacgggagttgcacaagcaggggaaatgcgctacgtgcgtgtataacatgatgggaaagagagaaaagaaactgggcgagtttggtaaggccaaagggagtagggcgatttggtacatgtggctcggagcacgcttccttgagtttgaagccctgggcttcatgaatgaggatcactggttctcccgagaaaacagcttatctggcgtagagggggagggactgcataagttgggttacatcctccgggacatttcgaaaatccctggcgggaatatgtatgctgatgacaccgccggatgggatactagaataacagaagacgatctgcaaaacgaggcaaagatcaccgacattatggaaccagagcacgctctacttgccacttcaatctttaaactgacataccagaataaggttgtgagggtccagcgccccgctaagaacggcaccgtgatggatgtgattagcagacgggaccagaggggttccgggcaagtcggaacatatggcctcaatactttcaccaacatggaagcccagctgatccgtcagatggagagtgagggcatattttctccttgtgaattggagattccaaacttagcagaacgagttctggattggctcgagaaatacggggtggaacgccttaagagaatggcgatcagcggagacgactgcgtagtgaaacccatcgatgaccggttcgccacggctctgaccgccctaaatgatatgggtaaggtcaggaaagacgtgccgcagtgggagccttccaagggctggaacgattggcaacaggttcccttttgttcacatcacttccaccagctgattatgaaggacgggcgcgagatagtggtcccatgcagaaatcaggatgaactcgtgggacgggcaagggtaagtcaaggcgctggttggtctttgcgagagacagcctgtctggggaaaagctatgcacagatgtggcagcttatgtactttcatcgtagagacctgcgcctcgccgcgaacgctatctgctccgccgttcctgtggattgggtccccacttcacggaccacatggagcattcacgcacatcaccaatggatgactaccgaagacatgttatctgtgtggaatagggtttggatcgaggaaaacccatggatggaggataagacgcatgtgtccagttggggagacgtcccctatctgggcaaaagagaggaccagtggtgtggcagcttgattgggctgacagcccgcgctacctgggcctcgaatatccaggtggcaataaaccaggtacggaggctcatcggaaatgaaaactaccttgattacatgacttccatgaagcgattcaaaaatgagggtgaccctgaaggcgctctgtggtga

SEQ ID NO: 14008 - RNA, 9879 nt, synthetic construct
  misc_feature 1..9879: note = derived and/or modified CDS sequence (opt3) from DENV-1__EU482807__SS-prME
  source 1..9879: mol_type = other RNA
agcgtgaccatgctgctcatgcttatgcccacagcactggctttccacttgactacgagaggcggggaacctcatatgatcgtctccaagcaggaaaggggaaaatctttactgtttaagacctcagccggtgttaatatgtgcaccctagtggccatggacctcggcgagttctgtgaagatactatgacctacaaatgcccacggattacagaagcggaaccggacgatgtagactgttggtgcaatgctaccgatacttgggtgacatatgggacctgtagtcagacgggagagcaccgccgagacaagcgtagcgtcgccctggcaccccatgtgggccttggtctggagactagaaccgaaacatggatgtcctctgagggggcctggaaacagatacagagggttgaaacttgggctttgcggcaccctggatttaccgtgatcgcactcttcctggcccatgctattggcacatcgatcacccagaagggcattatctttatactgctcatgttagtcacgccatcaatggccatgcgctgcgtggggatcggaagcagagatttcgttgagggtctgagtggcgcgacttgggttgacgtggtccttgagcacgggtcctgtgtgacaaccatggcaaaggataaacccactttggacattgaactgctaaagacagaggtgaccaaccctgccgtcctcaggaaactgtgcatcgaagctaagatttctaatacgaccacagatagccggtgtccaactcaaggagaggccacccttgttgaagaacaggacgcaaactttgtgtgccgccgaacattcgtagatagaggctggggtaatgggtgtggactgtttggcaaaggctccttgatcacttgcgctaagttcaagtgcgtgaccaaactcgaggggaagacagtccagtacgaaaacctgaaatattcagtgatagttaccgtgcacactggagaccagcatcaagtcggtaatgagagtacggaacacggcacaaccgccactattacaccccaggcgcctagcacagagatccagttaaccgactacggggccctgactctcgattgttctccaaggacaggacttgactttaacgaaatggtgctgttgacgatgaaggagaaatcctggctagtacataagcagtggttcctggatctcccgctgccctggacctcaggcgcaagcacaagtcaagagacatggaatcggaaagaccttctggttacctttaagacagctcacgccaagaaacaggaagtggtcgtgttgggttctcaggagggggctatgcacactgccctcaccggcgcaacggaaattcaaacctccggaacaactaccatcttcgccggccatctgaagtgccgtttaaaaatggataagctgacactaaaagggatgagctatgtcatgtgtactggatcgttcaagctcgagaaggaagtggctgagacccagcacggtacggttctggtgcagatcaaatacgagggcacagacgcgccttgcaagattccattttctacccaggatgaaaaaggggtaactcaaaacggacgccttataacagcaaatcccatcgtcaccgacaaggagaaacctgtgaacattgaagccgagccacccttcggcgagtcctatatcgttataggtgctggggaaaaggccttgaagctgtcatggtttaaaaagggcagtagcattggaaaaatgttcgaggcaactgccagaggcgctaggcggatggccatcctcggggataccgcatgggactttggatccatcggtggcgtgttcacatctgtcgggaagctggtgcatcagatttttggaacggcgtacggcgtacttttcagcggtgtgtcatggaccatgaaaatcgggattggcgttctgttgacttggctcggactgaatagtcgatccactagcttatctatgacctgtatagctgtcggcctggtgacactatacctcggggtgatggtccaggccgattcaggatgcgttatcaactggaagggccgcgaactgaagtgtggtagtgggatttttgtgactaatgaggtgcacacctggacggaacagtataaattccaagcagacagcccgaagagactttccgccgctatcggaaaagcctgggaggagggcgtatgcggtatcaggtctgcaacacggttggaaaacattatgtggaagcagatatcgaacgagctgaatcatatcctcctggaaaacgacatgaaatttaccgtcgtggttggcgatgtggctgggattttagcccagggaaagaaaatgatccgccctcagcccatggagtacaagtatagctggaagtcctggggcaaagcgaagattatcggggccgacgtccaaaatactaccttcataatcgatggaccaaacacacctgaatgtcccgacgatcagagagcttggaatatttgggaggtggaggactacggctttggtatcttcactaccaacatttggctgaaacttagggattcatatacacaggtttgcgaccaccgtttgatgagtgcagccatcaaggattctaaagctgtgcacgccgacatggggtactggatagaaagcgagaagaatgaaacgtggaagctcgcacgggcgtccttcattgaggtaaaaacctgtatctggccaaagtcacatactctgtggagcaacggagtcctagaatctgagatgattatccccaaaatatatggcggtcctatctcccagcacaattaccgaccaggctactttacacaaaccgccgggccgtggcatctgggaaagctcgagctggatttcgacctttgcgaaggcactacagtggtggtcgatgagcactgcgggaacagaggacccagtttgaggaccacgactgttaccggcaaaattatccacgaatggtgttgccgcagctgtacactgcctccattacggtttaagggtgaggacgggtgctggtatggaatggagattagacccgtgaaggaaaaagaggaaaatctcgtaaagtctatggtgtccgctggctcaggtgaggtcgacagtttcagcctgggccttctgtgtatctcgataatgattgaagaggtgatgaggtcccgctggtctcgaaaaatgttgatgaccgggactctcgccgtatttttcctgctaatcatcggacagctgacatggaacgatctcattcggctgtgcatcatggtgggcgcaaatgctagcgaccgtatggggatgggaaccacataccttgccttgatggcaacttttaagatgagacctatgttcgccgtcggcctgttatttaggcgcctcacctcacgggaggtgctgcttctgacgattggtctaagtctcgttgcttccgtggaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtcctgagcatcgtaagtctttttcccctctgtctgtctaccacgtcccagaaaacaacctggttgccggtgctgttaggcagcctcgggtgcaagcctctgactatgttccttattgccgagaataaaatctggggaagaaggtcgtggccactgaacgaaggtataatggccgttggcatcgtgtcaattttgctctctagtctgctaaagaacgatgtccccctggctgggcctcttatcgcaggaggcatgctcattgcctgttacgtgatctccggtagctctgcggacctgagcttggagaaagctgccgaggtatcctgggaagaggaagcagagcattcaggggccagtcacaatatattagtggaagtccaggatgacggaacaatgaagattaaagatgaggagcgagacgataccctgactatcctcctgaaggctacacttctggcagttagcggcgtgtatcccttgtctatcccagccaccctattcgtgtggtacttttggcagaagaaaaagcaacgctccggcgtcctgtgggacacgccttcacccccagaagtggagcgggcggttctcgatgacgggatttatagaataatgcagaggggactgcttggtcgtagtcaggtaggcgtgggggtcttccaggaaaacgtgtttcatactatgtggcacgttacccgcggagctgtgttaatgtaccaaggcaaacggctggagccgagctgggcctccgtcaagaaagacctcatctcttacggtgggggatggagattgcagggctcgtggaatacaggcgaggaagtgcaggtaattgcagtcgagcctgggaagaaccccaagaatgtgcagaccgccccaggaacattcaaaactagcgaaggtgaggttggcgctatcgccctggattttaagcccgggacctcaggatcccctattgtgaacagggaaggcaaaatcgtcggtctctatgggaatggagtggttacgacaagtggcacttacgtgtctgcaatagctcaagccaaggcgagccaggagggcccactgcccgagatcgaagacgaggtcttccgaaaacggaaccttaccattatggatctgcaccctgggtccggaaagacacgcagatatttgccggccatcgtgagggaagcaattaagcggaaactacgaaccctgatcctcgctccaactagagtagtggcctcagagatggctgaagcattaaagggtatgcccatacgctaccagaccacagccgttaaatctgagcatacgggcaaggagattgtcgacctgatgtgccacgccacttttaccatgaggcttctgagccctgtgcgtgtgccaaattataacatgatcatcatggatgaagctcatttcacagaccccagttccattgcggcacgggggtacatcagcaccagagtcggaatgggcgaggccgctgccatatttatgactgcaacacctccgggttctgtagaagccttcccccaatcaaatgctgtgattcaggatgaggaaagggacatcccagagcgctcctggaacagtgggtatgagtggattaccgattttcctggaaaaacggtttggttcgtgcccagcatcaagtcgggcaatgacatagcgaactgtctccgaaagaatggcaaaagagtcattcagttgtctcggaagactttcgatacagaataccagaaaaccaagaacaacgactgggactacgtggttaccactgatatctccgagatgggggccaattttagggcagaccgcgtgatcgatccacgtagatgcctgaaacctgtcattctcaaggacggacccgaacgggtgatcctggctggtccaatgccggtaacagtggccagcgcagcccaaaggcgcggccgaattgggagaaaccacaataaggagggagatcagtatatatacatgggccagcctcttaacaatgacgaggatcatgctcactggaccgaagccaaaatgctactggacaacatcaatacacccgagggtattatcccagcgttgttcgaacccgagcgggaaaagtcagcagccatcgatggggagtataggttacgcggcgaggctagaaaaacttttgttgaactgatgaggcggggagacctccctgtctggctgagttacaaggtggcctctgagggcttccagtattccgatcgtcgctggtgctttgacggggaacgaaacaatcaagtgcttgaggaaaacatggatgtcgagatttggacgaaagagggagaaagaaagaaactgaggccacggtggctcgacgctcgcacctacagcgaccccttggcactgagagagttcaaggaatttgccgctggtaggcggtcagttagtggcgatctaatactggagatcgggaagctccctcagcaccttacacagcgagcccagaatgcactggacaacttagtgatgttgcataatagcgaacaaggaggcagagcgtatcgccacgccatggaggagctgccggatactattgaaaccctcatgctgcttgctctgatcgccgtactcacaggtggggtgaccttgttctttctgtccggcaggggattaggcaaaacttctattgggctactgtgtgtcatggcaagctccgtgctcctttggatggcttcagttgagccacattggatcgccgcatctataatcctggagttctttttgatggtgctgctcattcccgagcctgaccggcagcgtacgccccaggataaccagctggcctacgtcgtaatcggacttctcttcatgattctgaccgtggctgcgaatgagatgggtttgctggaaacaactaagaaagacttaggcatcgggcacgttgccgtggagaaccaccatcacgcagctatgctagatgtcgacctgcatccagccagtgcctggaccctctacgcagtggctacaaccataattactcctatgatgagacacacaatcgaaaacacgaccgccaatatttcgcttactgcgatcgctaaccaagccgcaatactgatgggattggataagggctggcccatcagcaaaatggacattggtgtcccactgctcgccctggggtgctattcccaggtgaatcctcttacattaaccgctgcagttctgatgctcgtggcccattacgcgatcattggcccgggattgcaggctaaggccaccagggaggcacaaaagcgcacagccgctggcatcatgaaaaaccccactgtagatgggatagtggccattgacctggatccagtcgtttatgacgcaaagtttgaaaaacagctaggacagatcatgctgctcatcctttgtacgtctcagattctgttgatgcggaccacatgggctctgtgcgagtcaatcactctcgccaccggccctctgacaaccttatgggagggtagccccgggaagttctggaatactacgatagcggtgtccatggccaacattttccgaggaagttaccttgcaggcgctggtctggccttttctctcatgaaaagcctaggcgggggaagaaggggcacaggggcacaaggagaaaccctgggcgagaagtggaagcgccagttgaatcagctgtcaaaatccgagttcaacacttataagcggagtggtatcatggaggtcgacagaagcgaagctaaagaggggctcaagcgtggagagaccacaaaacacgccgtgtctaggggcactgccaaacttcggtggtttgtagaacgcaatctggtgaagccagagggtaaagttattgatttgggctgtgggcgaggaggctggtcctactattgcgcggggctgaagaaagtgaccgaagtcaagggatacacaaaaggcggtcctgggcacgaggaacccatcccgatggctacgtacggatggaacctcgtgaagttacattcaggcaaagacgtcttctttataccacctgagaagtgtgataccctgctttgcgacatcggcgagagctcgcccaatccaactattgaagaggggagaacactgagggtgctaaagatggttgaaccctggctccggggaaaccagttctgtatcaaaattctgaatccttatatgccgtctgtagtggagaccttggagcgcatgcaaagaaagcacggtggcatgctggtcaggaaccccctcagtcgaaattccactcatgaaatgtactgggtgagctgcgggacaggaaacatcgtttcagcagtgaatatgacctcccggatgcttctgaaccgttttacgatggcccacagaaaaccaacctatgagcgcgatgtcgacttaggcgctggtacaaggcacgtggccgtagaacctgaggtggcaaacctggatattatcgggcagcggatagaaaatattaagcatgagcacaaatctacttggcattacgacgaggataacccctataagacctgggcctaccacggaagctatgaagttaagcctagtggctccgctagctctatggtcaatggcgtggtgaaattgctcacaaagccatgggacgtcatccccatggttactcagatcgcgatgaccgatacaacccctttcgggcagcaaagagtgtttaaagagaaggtagacactcgcacgccaaaagccaagaggggaacagcacagattatggaagtgaccgctaagtggctgtggggtttcctatcacgaaacaaaaagccccggatatgtactagagaggaatttaccaggaaagtccgcagtaatgccgcaatcggcgccgtgttcgttgacgagaaccagtggaactccgctaaggaggccgtggaagatgagcgtttttgggaccttgtccatcgggaaagagagctgcacaaacaagggaagtgcgcgacatgcgtgtacaacatgatgggaaagagggagaagaagctcggcgagttcggtaaagcaaaggggagccgcgccatttggtacatgtggctgggagctcgattcttggagtttgaagccctgggcttcatgaatgaggatcactggttttctcgggaaaactcgctctcaggcgtagagggggagggacttcataaactgggttatatcttaagagacattagcaagatcccgggcgggaatatgtacgcagatgacacggctggatgggataccaggataactgaagacgatctgcagaacgaggccaaaatcacagacattatggaacctgagcacgctttgctcgccaagtccatcttcaagctgacctatcagaataaagttgtgcgcgtccagagaccagcaaagaacggcactgtgatggatgtgattagtcggagggaccaacgtggttctgggcaggtcggaacatacggcctaaatacctttacaaacatggaagcgcagcttatccgacagatggagagcgagggcatattctccccctcagaactggagactcctaacctcgccgggcgcgttctggattggttggaaaaacatggagtggagagattaaagcggatggctattagtggtgacgactgtgtagtgaaaccaatcgatgacaggtttgccaccgcactgacggctctcaatgatatgggcaaggtccgcaaggacatcccccaatgggaaccgtctaaagggtggaacgattggcaacaggtgcctttctgcagccaccactttcatcagcttattatgaaggacggaagagagatagttgtgccctgtcggaatcaagatgagctggtcggcagggcccgagtgtcccagggtgcagggtggtcactacgtgaaaccgcctgcctgggaaaaagctatgcgcagatgtggcagctcatgtacttccacagacgcgacttgcggctggctgccaacgcaatctgttctgccgtaccagttgattgggtgcctacatccaggactacctggagtattcatgctcaccatcaatggatgacaactgaggacatgcttagcgtctggaatagagtgtggatcgaagagaacccctggatggaagataagacccacatttcgtcctggggcgacgttccatatctgggcaaacgcgaggaccagtggtgcgggtctctcatcggattaacggcccgggcaacatgggctaccaatatacaggtggccatcaaccaagtcaggcgactgattggtaatgagaactacttggattacatgacttcaatgaagagatttaagaatgaaagcgaccccgagggcgcgctgtggtga

SEQ ID NO: 14009 - RNA, 9879 nt, synthetic construct
  misc_feature 1..9879: note = derived and/or modified CDS sequence (opt3) from DENV-1__EU482808__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaacgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgagatgggtttgctggaaacaactaaaaaggacttaggcatcgggcacgtggccgttgagaaccaccatcacgcagctatgctagatgtggacctgcatccagccagtgcctggaccctctacgcagtcgctacaaccataattactcctatgatgcgtcacacaatcgaaaacacgaccgccaatatttcgcttactgcgatcgctaaccaagccgcaatactgatgggattggataaaggctggcccatcagcaagatggacattggtgtgccactgctcgccctggggtgctattcccaggtcaatcctcttacattaaccgctgcagtgctgatgctcgttgcccattacgcgatcattggcccgggattgcaggctaaggccaccagagaggcacagaagaggacagccgctggcatcatgaagaaccccactgtggatgggatagtagccattgacctggatccagtggtctatgacgcaaaatttgaaaagcagctaggacagatcatgctgctcatcctttgtacgtctcagattctgttgatgcgcaccacatgggctctgtgcgagtcaatcactctcgccaccggccctctgacaaccttatgggagggtagccccgggaaattctggaatactacgatagcggtttccatggccaacattttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtatcatggaggtggaccggagcgaagctaaggaggggctcaaaagaggagagaccacaaagcacgccgtctctcgtggcactgccaaacttaggtggtttgtggaacggaatctggtaaaaccagagggtaaggtgattgatttgggctgtgggcgcggaggctggtcctactattgcgcggggctgaaaaaggttaccgaagtgaaaggatacacaaagggcggtcctgggcacgaggaacccatcccgatggctacgtacggatggaacctcgtcaaattacattcaggcaaggacgtgttctttaccccacctgagaagtgtgatactctgctttgcgacataggcgagagctcgcccaatccaacaatcgaagaggggcgaaccctgagagtcctaaaaatggtggaaccctggctcaggggaaaccagttctgtattaagatcctgaatccttatatgccgtctgttgtagagactttggagcaaatgcagcggaaacacggtggcatgctggtgcgcaaccccctcagtagaaattccacacatgaaatgtactgggtcagctgcgggaccggaaacattgtgtcagcagttaatatgacgtccaggatgcttctgaaccgatttaccatggcccaccggaagccaacatatgagcgtgatgtggacttaggcgctggtactagacacgtcgccgtggaacctgaggtagcaaacctggatatcattgggcagcgcatcgaaaatataaaacatgagcacaagtctacctggcattacgacgaggataacccctataagacatgggcctaccacggaagctatgaagtgaaacctagtggctccgctagctctatggttaatggcgtcgtgaagttgctcactaaaccatgggacgtgattcccatggtcacccagatcgcgatgacagataccactcctttcgggcaacagagggtttttaaggagaaagtggacacgcggacaccaaaggccaagagaggaaccgcacagatcatggaagtaactgctaaatggctgtggggtttcctatcacgcgacaagaaacccaggatttgtacccgagaggaatttacacggaaggtgagaagtaacgccgcaataggcgccgtcttcgtggatgagaatcaatggaactccgctaaagaggccgttgaagacgagaggttttgggatcttgtgcatcgcgaacgtgagctgcacaagcaggggaagtgcgcgacgtgcgtctacaatatgatgggaaaacgggaaaagaaactcggcgagttcggtaaggcaaaagggagcagagccatctggtacatgtggctgggagctaggttcttggagtttgaagccctgggcttcatgaacgaggaccactggttttctcgcgaaaattcgctctcaggcgtggagggggagggacttcataagctgggttatattttacgagatatcagcaaaattccgggcgggaacatgtacgcagacgataccgctggatgggacactcggatcacagaagatgacctgcagaatgaggccaagataaccgatatcatggaacctgagcacgctttgctcgccaagtccattttcaaactgacttatcagaacaaggtagttagagtgcaaaggccagccaagaatggcacagtcatggacgtgatcagtcgcagagatcagcggggttctggacaggtgggaacctacggcctaaacacatttactaatatggaagcgcagcttattaggcaaatggagagcgagggcatcttctccccctcagaactggagacccctaacctcgccgggcgtgtcctggactggttggaaaagcatggagttgagcgattaaaacgcatggctataagtggtgacgattgtgtggtaaagccaattgacgatagatttgccacggcactgaccgctctcaacgacatgggcaaggtgcggaaagatatcccccagtgggaaccgtctaaggggtggaatgactggcagcaggtccctttctgcagccaccactttcatcaacttatcatgaaagatggaagggagattgtggttccctgtcgcaaccaggacgagctggtgggcagagcccgggtctcccagggtgcagggtggtcactaagggaaacagcctgcctgggaaagagctatgcgcagatgtggcaactcatgtacttccaccgacgtgatttgagactggctgccaatgcaatatgttctgccgtgccagtagactgggttcctacttcccgcaccacatggagtatccatgctcaccatcagtggatgactaccgaggatatgcttagcgtgtggaaccgggtctggattgaagagaatccctggatggaagacaaaacgcacatctcgtcctggggcgacgtgccatatctgggcaagagggaggatcagtggtgcgggtctctcattggattaacagccagagcaacctgggctactaacatccaagttgccataaatcaggtgcgccggctgatcggtaacgagaattacttggactacatgacatcaatgaagaggtttaaaaacgaaagcgatcccgagggcgcgctgtggtga

SEQ ID NO: 14010 - RNA, 9879 nt, synthetic construct
  misc_feature 1..9879: note = derived and/or modified CDS sequence (opt3) from DENV-1__EU482809__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatgctagcgaccgtatggggatgggaacaacctacttggccctgatggcaacattcaaaatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaagcttctgacggactttcaaagccatcagttgtgggccacactcctgtccctaaccttcatcagaactaccttttcactgcactatgcatggaaaacaatggctatggtgcttagcattgtcagtctcttccccctgtgtttgtctactacctcccagaagacgacatggctgccggtattactcggcagcctggggtgcaagcctcttaccatgtttctgatcgccgagaataaaatatggggaaggaagtcgtggccattgaacgaaggtatcatggccgtgggcattgtttcaatcctcctgtctagtctactgaaaaacgatgtgccccttgctgggcctctcattgcaggaggcatgctgatcgcctgttacgtcatatccggtagctctgcggacttgagcttagagaaggctgccgaggtgtcctgggaagaggaagcagagcattcaggggccagtcacaatattctggtagaagtgcaggatgacggaactatgaaaatcaaggatgaggagcgagacgatacactcaccatcctgcttaaagctactctgttggcagtcagcggcgtttatcccctatctattccagccacactgttcgtgtggtacttctggcaaaagaagaaacagcgctccggcgtgctctgggacaccccttcacccccagaagtcgagcgggcggtgctggatgacgggatatatagaatcatgcagaggggacttttaggtcgtagtcaggttggcgtaggggtgtttcaagaaaacgtcttccatacgatgtggcacgtgactcgcggagctgttctgatgtaccagggcaagcggctcgagccgagctgggcctccgtgaaaaaggacttgatttcttacggtgggggatggagactgcagggctcgtggaataccggcgaggaagtccaggtgatcgcagtagagcctgggaaaaaccccaagaatgtccaaacagccccaggaacctttaagacaagcgaaggtgaggtgggcgctattgccctcgatttcaaacccgggacttcaggatcccctatcgttaacagggaaggcaagatagtgggtctgtatgggaatggagtcgtgaccacgagtggcacatacgtttctgcaatcgctcaggccaaagcgagccaggagggcccacttcccgagattgaagacgaggtgtttcgaaagcggaacctgactatcatggatttgcaccctgggtccggaaaaacccgcagatatctaccggccattgtcagggaagcaatcaagcggcgactgagaacactcatattagctccaacccgcgtggtagcctcagagatggctgaagcactgaagggtatgcccattaggtaccaaactaccgccgtgaaatctgagcatacaggcaaggagatcgttgaccttatgtgccacgccacgttcactatgcgtctgctcagccctgtccgggtgccaaattataacatgatcattatggatgaagctcattttaccgaccccagttccatcgcggcaagagggtacataagcacaagggtgggaatgggcgaggccgctgccattttcatgaccgcaactcctccgggttctgtcgaagcctttccccagtcaaatgctgtaatccaggatgaggaacgcgacattccagagcgatcctggaacagtgggtatgagtggatcacagatttccctggaaaaaccgtgtggtttgttcccagcataaagtcgggcaatgacattgcgaactgtttgagaaaaaatggcaagcgggtgatccagctgtctaggaagacgttcgatactgaataccaaaaaacaaagaacaacgactgggactacgtcgtgaccaccgatatctccgagatgggggccaatttccgcgcagaccgtgttattgatccaagacggtgcctcaaacctgtgatcctgaaggacggacccgaaagggtcattcttgctggtccaatgccggtgactgtagccagcgcagcccagcgccgaggcagaatagggcggaaccacaataaagagggagatcagtatatctacatgggccagcctctaaacaatgacgaggatcatgctcactggacagaagccaagatgctgttggacaacattaatacccccgagggtatcatcccagcgttatttgaacccgagagggaaaagtcagcagccattgatggggagtatcgcctgagaggcgaggctaggaaaacattcgtggaactcatgcggcgtggagacctgcctgtttggcttagttacaaggtcgcctctgagggctttcaatattccgatcgccgatggtgcttcgacggggaaagaaacaatcaggtgctggaggaaaacatggatgtggagatatggactaaagagggagaaaggaagaaactccggccacgctggttggacgctagaacgtacagcgaccccctggcactaagggagtttaaggaattcgccgctggtcggcgatcagtcagtggcgatctgatcctcgagattgggaaacttcctcagcacctgacccagagagcccaaaatgcattagacaacttggttatgctgcataatagcgaacagggaggccgcgcgtataggcacgccatggaggagctcccggatacaatcgaaactctgatgcttctggctctcattgccgtgttgaccggtggggtaacactgtttttcttatccggccggggactaggcaagacctctatcgggctgctctgtgtgatggcaagctccgtccttctgtggatggcttcagtggagccacattggatagccgcatctatcattttggaatttttcctgatggttctcctgatccccgagcctgaccgtcagagaactccccaggataaccaacttgcctacgtggtcattggactcctgtttatgatcttgacggtagctgcgaatgagatgggtctgttagaaaccacaaagaaagacctaggcatagggcacgtggccgttgagaaccaccatcacgcagctatgctggatgtggacctccatccagccagtgcctggactctttacgcagtcgctaccacaattatcacccctatgatgaggcacactattgaaaacacaacggccaatatctcgctgaccgcgatagctaaccaggccgcaatcttgatgggactggataagggctggcccattagcaaaatggacatcggtgtgccactcctggcccttgggtgctattcccaggtcaatcctttaactctgacagctgcagtgctcatgttggttgcccattacgcgattatcggcccgggactgcaagctaaggccacccgcgaggcacagaaacggaccgccgctggcataatgaagaaccccacagtggatgggattgtagccatcgacctagatccagtggtctatgacgcaaagttcgaaaaacagctgggacagatcatgctccttattctgtgtacttctcaaatcttgctgatgcgaacgacctgggctctctgcgagtcaataacactggccactggccctttaaccacactttgggagggtagccccgggaagttttggaataccactattgcggtttccatggccaacatcttcagaggaagttacctggcaggcgctggtctcgccttctctctaatgaaaagcctgggcgggggaaggcgcggcacgggggcacagggagaaacattgggcgagaagtggaaacggcagctgaatcagctctcaaagtccgaatttaacacctataagagaagtggtattatggaggtggaccgtagcgaagctaaagaggggcttaagaggggagagactaccaaacacgccgtctctcggggcacagccaagctgcgctggttcgtggaacgaaatttggtaaaaccagagggtaaggtgatcgatctgggctgtgggagaggaggctggtcctactattgcgcggggctcaagaaagttactgaagtgaagggatacaccaaaggcggtcctgggcacgaggaacccataccgatggctacatacggatggaacttagtcaagctgcattcaggcaaagacgtgtttttcatcccacctgagaagtgtgatacgcttctgtgcgacattggcgagagctcgcccaatccaaccatcgaagaggggaggactctacgggtcctcaaaatggtggaaccctggctgcgcggaaaccaattttgtattaagatcttgaatccttatatgccgtctgttgtagagacactggagcagatgcagagaaagcacggtggcatgctcgtgaggaacccccttagtcgaaattccacccatgaaatgtactgggtcagctgcgggactggaaacattgtgtcagcagttaatatgacatcccggatgctgttaaaccgtttcaccatggcccacagaaaaccaacgtatgagcgcgatgtggacctgggcgctggtaccaggcacgtcgccgtggaacctgaggtagcaaacttggatatcatagggcagcggattgaaaatatcaagcatgagcacaaatctacatggcattacgacgaggataacccctataagacttgggcctaccacggaagctatgaagtgaaacctagtggctccgctagctctatggttaatggcgtcgtgaagctcctgaccaagccatgggacgtgatccccatggtcacacaaattgcgatgactgataccacaccttttgggcagcagagagttttcaaagagaaggtggacacccgcactccaaaagccaagaggggaacggcacaaataatggaagtaacagctaaatggctatggggttttctttcacgaaacaagaagccccggatctgtaccagagaggaattcactaggaaagtgcgcagtaatgccgcaattggcgccgtctttgtggacgagaaccagtggaattccgctaaggaggccgttgaagatgagcgtttctgggacctggtgcatcgggaaagagagctccacaaacaggggaagtgcgcgacctgcgtctacaacatgatgggaaaaagggaaaagaagctgggcgagtttggtaaagcaaaggggagccgcgccatctggtacatgtggttgggagctcgattcctggagttcgaagccctcggctttatgaatgaggatcactggttctctcgggaaaactcgctttcaggcgtggagggggagggactgcataaattaggttatattctgagagacatcagcaagataccgggcgggaatatgtacgcagatgacacagctggatgggatacgaggatcaccgaagacgatttgcagaacgaggccaaaattactgacatcatggaacctgagcacgctctcctggccaagtccatttttaaactaacatatcaaaataaggtagttcgcgtgcagagaccagcaaagaacggcaccgtcatggatgtgatcagtcggagggaccagcgtggttctgggcaggtgggaacttacggccttaatacattcaccaacatggaagcgcaactgatacgacagatggagagcgagggcattttttccccctcagaactcgagacacctaacctggccgggcgcgtcttggattggttagaaaaacatggagttgagagactgaagcggatggctatcagtggtgacgactgtgtggtaaaaccaatcgatgacaggttcgccactgcactcaccgctcttaatgatatgggcaaggtgcgcaaagacattccccagtgggaaccgtctaaggggtggaacgattggcagcaagtccctttttgcagccaccacttccatcagctgataatgaaggacggaagagagatcgtggttccctgtcggaatcaggatgagctagtgggcagggcccgagtctcccagggtgcagggtggtcactgcgtgaaacggcctgcctcggaaaaagctatgcgcaaatgtggcagttgatgtactttcacagacgcgacctgcggcttgctgccaacgcaatttgttctgccgtgccagtagattgggttcctacctccaggacaacttggagtatccatgctcaccatcagtggatgaccacagaggacatgctgagcgtgtggaatagagtctggattgaagagaacccctggatggaagataagactcacgtgtcgtcctggggcgacgttccatatctcggcaaacgcgaggaccaatggtgcgggtctttaatcggactgaccgcccgggcaacgtgggctacaaatatacaggtggccatcaaccaggtcaggcgattgctgggtaatgagaactacctcgattacatgacctcaatgaagagattcaaaaatgaaagcgaccccgagggcgcgctttggtga

SEQ ID NO: 14011 - RNA, 9879 nt, synthetic construct
  misc_feature 1..9879: note = derived and/or modified CDS sequence (opt3) from DENV-1__EU482810__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccagatgtgcgaccaccgtctcatgagtgcagccattaaagattctaaggctgtgcacgccgacatggggtactggatcgaaagcgagaaaaatgaaacatggaagctggcacgggcgtccttcattgaggttaagacgtgtatctggccaaaatcacataccctatggagcaacggagtgctggaatctgagatgataatccccaagatttatggcggtcctatctcccaacacaattaccgaccaggctacttcactcagacagccgggccgtggcatctcggaaaactggagcttgattttgacttgtgcgaaggcaccactgtagtcgtggatgagcactgcgggaacagaggacccagtctgaggacaaccacggtgactggcaagattatccacgaatggtgttgccgcagctgtaccttacctccactccggttcaaaggtgaggacgggtgctggtatggaatggagataagacccgtcaaggaaaaggaggaaaatctggttaaatctatggtgtccgctggctcaggtgaggtagacagttttagccttggcctgttgtgtatttcgatcatgatcgaagaggtgatgaggtcccgctggtctcgaaagatgctcatgacagggaccctggccgtcttctttctactgattatgggacagctcacttggaacgatctgatccggctttgcattatggtgggcgcaaatgctagcgaccgtatggggatgggaacaacctacttggccctgatggcaacattcaaaatgagacctatgtttgccgttggcttactcttcaggcgcctgacttcacgggaggtgcttctgctaaccataggtctcagtctggtcgcttccgtggaattgccaaactctctggaggaattaggggatggactcgcgatgggcatcatgattctgaagcttctgacggactttcaaagccatcagttgtgggccacactcctgtccatgaccttcatcagaactaccttttcactacactatgcatggaaaacaatggctatggttctgagcattgtgagtcttttccccctctgtctgtctactacctcccagaagacgacatggttgccggtcctgttaggcagcctcgggtgcaagcctctgaccatgtttcttatcgccgagaataaaatatggggaaggaagtcgtggccactgaacgaaggtatcatggccgtaggcattgtgtcaatcttgctctctagtctgctaaaaaacgatgttcccctggctgggcctcttattgcaggaggcatgctcatcgcctgttacgtgatatccggtagctctgcggacctgagcttggagaaggctgccgaggtctcctgggaagaggaagcagagcattcaggggccagtcacaatattttagtggaagtacaggatgacggaactatgaaaatcaaggatgaggagcgagacgatacactgaccatcctcctgaaagctactcttctggcagtgagcggcgtctatcccttgtctattccagccacactattcgtttggtacttctggcaaaagaagaaacagcgctccggcgtgctgtgggacaccccttcacccccagaagtgcagcgggcggtcctcgatgacgggatatatagaatcatgcagaggggactgcttggtcgtagtcaagtgggcgttggggtatttcaggagaacgtgttccatacgatgtggcacgtcactcgcggagctgtgttaatgtaccagggcaagcggctggaaccgagctgggcctccgttaaaaaggacctcatttcttacggtgggggatggagattgcagggctcgtggaataccggcgaggaggtgcaagtcatcgcagtggaacctgggaaaaaccccaagaatgtacagacagccccaggaacctttaagacaagcgagggtgaagtcggcgctattgccctggatttcaaacccgggacttcaggatcccctatcgtgaacagggagggcaagatagttggtctctatgggaatggagtggtcaccacgagtggcacatacgtgtctgcaatcgctcaggccaaagcgagccaagaaggcccactgcccgagattgaggacgaagtttttcgaaagcggaaccttactatcatggatctgcaccctgggtccggaaaaacccgcagatatttgccggccattgtgagggaggcaatcaagcggaagctacgaacactgatactcgctccaaccagagtcgtggcctcagaaatggctgaggcattaaaaggtatgcccattcgctaccagactaccgccgtaaagtctgaacatacaggcaaagagatcgtggacctgatgtgccacgccacgttcactatgaggcttctgagccctgttcgtgtcccaaattataacatgatcattatggatgaggctcattttaccgaccccagttccatcgcggcacgggggtacataagcacaagagtgggaatgggcgaagccgctgccattttcatgaccgcaactcctccgggttctgtggaggcctttccccagtcaaatgctgtcatccaggatgaagagagggacattccagaacgctcctggaacagtgggtatgagtggatcacagatttccctggaaagaccgtatggtttgtgcccagcataaaatcgggcaatgacattgcgaactgtctccgaaagaatggcaagagagttatccaattgtctcggaaaacgttcgatactgagtaccagaagacaaaaaacaacgactgggactacgtggtcaccaccgatatctccgaaatgggggccaatttcagggcagaccgcgtgattgatccacgtagatgcctgaagcctgttatcctcaaagacggacccgagcgggtgattctggctggtccaatgccggtcactgtggccagcgcagcccagaggcgcggccgaatagggagaaaccacaataaggaaggagatcagtatatctacatgggccaacctcttaacaatgacgaggatcatgctcactggacagaggccaagatgctactggacaacattaatacccccgaaggtatcatcccagcgttgtttgagcccgaacgggagaaatcagcagccattgatggggaatataggttacgcggcgaggctagaaagacattcgtagagctgatgaggcggggagacctccctgtgtggctgagtcacaaagttgcctctgaaggctttcagtactccgatcgtcgctggtgcttcgacggggagcgaaacaatcaggtccttgaagagaacatggatgtggaaatatggactaaggagggagagagaaaaaagctgaggccacggtggctcgacgctcgcacgtatagcgaccccttggcactgagagaatttaaagagttcgccgctggtaggcggtcagtgagtggcgatctaatcctggaaattgggaagctccctcagcatcttacccaacgagcccagaatgcactggacaacttagtcatgttgcacaatagcgagcagggaggcagagcgtaccgccatgccatggaagagctgccggatacaatcgagactctcatgctgcttgctctgattgccgttctcaccggtggggtgacattgtttttcctgtccggcaggggattaggcaagacctctatcgggctactgtgtgtaatggcaagctccgtgctcctttggatggcttcagtcgaaccacactggatagccgcatctatcattctggagtttttcttgatggtgctgctcatccccgaacctgaccggcagcgtactccccaagataaccagctggcctatgttgtgattggacttctctttatgatcctgacggtcgctgcgaatgagatgggtttgctggagaccacaaaaaaggacttaggcatagggcacgtagccgtggaaaaccatcaccatgcagctatgctagatgttgacctgcacccagccagtgcctggactctctacgcagtggctaccacaattatcacccctatgatgagacatactattgagaacacaacggccaatatctcgcttaccgcgatagctaaccaggccgcaatcctgatgggattggataaaggctggcccattagcaagatggacatcggtgtcccactgctcgccctggggtgctactcccaagtgaatcctcttactttaacagctgcagtcctgatgctcgtggcccactatgcgattatcggcccgggattgcaggctaaagccaccagggaagcacagaagcgcaccgccgctggcataatgaagaaccccacagttgatgggattgtggccatcgacctggatccagtagtgtacgacgcaaaattcgagaagcagctaggacaaatcatgctgctcattctttgtacttctcagatcctgttgatgcggacgacctgggctctgtgcgaatcaataacactcgccactggccctctgaccacattatgggagggtagccccgggaaattttggaataccactattgcggtctccatggccaacatcttccgaggaagttatcttgcaggcgctggtctggccttctctctcatgaagagcctaggcgggtcaagaaggggaacgggcgcacagggggagacactgggagaaaaatggaagcgccagttgaatcaactgtccaagagtgagtttaacacctacaaacggagcggcattatggaagttgacagatctgaggctaaggaaggtctcaaacgtggggagactaccaagcacgccgtgtccaggggaacagccaaacttcggtggttcgtcgagcgcaatctggtgaagccagaaggcaaggtaatcgatttgggttgtggccgagggggatggtcatattactgcgcgggcctgaaaaaggtgactgaggttaaagggtataccaagggaggccctggtcatgaagagcccataccgatggctacatacgggtggaacctcgtgaaattacacagcggaaaggacgtctttttcatcccacctgaaaaatgtgatacgctgctttgcgacattggcgagtcgtctcccaatccaaccatcgaggaaggcagaactctgagggtgctaaagatggtcgagccctggctccgggggaaccagttttgtattaagatcctgaatccttacatgccgagtgtggttgaaacattggagcagatgcagcgcaaacatggaggtatgctggtaagaaaccccctctccaggaatagcacccacgagatgtattgggtgtcatgcggcactgggaacattgtctccgcagtgaatatgacatctcgaatgcttctgaaccggttcaccatggcccaccgtaagccaacgtacgaaagagatgttgacttaggagctggcacccgccatgtggccgtcgagcctgaagtggcaaacctggatatcataggtcaaaggattgagaatatcaaacacgaacataagagcacatggcactatgacgaggataacccctacaaaacttgggcctatcatgggagttacgaggtaaagccttccggaagcgcttcttcaatggtgaatggcgttgtcaagttgctcaccaaaccatgggacgtgatccccatggtgacacagattgcgatgactgataccacaccttttggccagcaacgggtcttcaaggaaaaagttgacaccagaactccaaaggccaaacgcgggacggcacagataatggaggtgacagctaagtggctgtggggatttctaagtaggaacaagaaaccccgaatctgtacccgggaagagttcactagaaaggtaaggtccaatgccgcaattggtgccgtgtttgtcgacgaaaaccagtggaatagcgctaaagaggccgtggaggatgaacgcttctgggaccttgttcaccgtgagcgggaactgcacaagcagggcaaatgcgcgacctgcgtgtataacatgatggggaagagagagaagaaactcggagaatttggcaaggcaaaaggttctagggccatctggtacatgtggctgggggctcgcttcttggagttcgaggccctgggatttatgaatgaagatcattggttctcgcgagagaactcactcagcggcgtcgaaggcgaggggcttcacaagctgggatacattttacgggacatctccaaaataccgggtggcaatatgtatgcagatgacacagctgggtgggatacgagaatcaccgaggacgatctgcaaaacgaagccaagattactgacatcatggagcctgaacatgctttgctcgccaaaagtatttttaagctgacataccagaataaggtggtaagggttcagcgcccagcaaaaaacggaaccgtgatggatgtcatctctagacgggaccagaggggcagcggtcaagtggggacttatggactaaatacattcaccaacatggaggcgcagcttatacgtcagatggaatccgagggcattttttcacccagtgagctggatacacctaacctcgccggccgagtgctggactggttggaaaagcacggggtcgagcgcttaaaaagaatggctatctctggagacgattgtgttgtgaagccaatcgacgatcggttcgccactgcactgaccgctctcaatgacatgggtaaagtaaggaaggatattccccagtgggaaccgagcaagggctggaacgactggcaacaggtgcctttttgctcccaccatttccaccagcttataatgaaagatgggcgcgagatcgtcgtgccctgtagaaatcaggacgaactggttggacgggccagggtgtcacaaggcgcaggttggagcctacgagagacggcctgcctggggaagtcttacgcgcagatgtggcagctcatgtattttcatcgtagagatttgcgcctggctgccaacgcaatttgttccgccgtcccagtggactgggtacctaccagtcggacaacttggagcatccacgctcatcaccaatggatgaccacagaggatatgctttcggtttggaatagggtgtggattgaagagaacccctggatggaagacaaaactcacatctcctcttggggagacgtcccatacctgggcaagagagaggatcagtggtgcggctcactcatagggttaaccgcccgcgcaacgtgggctacaaatatccaggtggccattaaccaggttcggaggctgttgggaaatgaaaactatctggactacatgaccagcatgaaacgattcaagaatgagagtggtcccgagggcgcgctctggtga

SEQ ID NO: 14012 - RNA, 9879 nt, synthetic construct
  misc_feature 1..9879: note = derived and/or modified CDS sequence (opt3) from DENV-1__EU482811__SS-prME
  source 1..9879: mol_type = other RNA
agcgtgacaatgctgctcatgcttatgcccacagcactggctttccacttgactacgagaggaggggagcctcatatgatcgtctccaagcaggaaagagggaaatctttactgtttaagacctcagccggtgttaacatgtgcacactgattgcaatggacctcggagagctgtgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctactcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggcagcttcaaacttgaaaaggaggtcgctgagacccagcacggtacggtgttggttcagattaagtacgaaggcacagatgcgccttgcaaaataccattctcgacccaagacgagaagggggtgactcagaacggacgcctgatcacagcaaatcccattgtaaccgataaagaaaagcctgtcaacatcgaggccgagccaccctttggcgaatcttatatagtgattggtgctggggagaaagccctcaagctgtcctggttcaagaaaggctcaagtatcggaaagatgtttgaagcaactgccagaggcgctaggcggatggccatccttggggacaccgcatgggatttcggaagcattggtggcgtttttacatccgtggggaaactggtccatcagatcttcggaacggcgtacggcgtgttgttttctggtgtaagctggaccatgaagattgggataggcgtgctcctgacttggttaggactaaattcacgaagtacatccctaagcatgacctgtatcgctgttggcctcgtcacactgtaccttggggtgatggtgcaggccgactctggatgcgtcattaactggaaaggccgcgagttgaagtgtggttcagggatcttcgttactaatgaagtgcacacctggacggagcaatataagtttcaggcagatagtccgaaaagactgagcgccgctatcggaaaggcctgggaggaaggcgtgtgcggtattaggtccgcaacacggctcgagaacataatgtggaaacagatctctaacgaactgaatcatattttactggagaacgacatgaagttcaccgtagtcgtgggcgacgttgctgggatccttgtgcagggcaagaagatgattcgccctcaacccatggaatacaaatattcgtggaaaagctggggcaaggccaaaatcataggggcggatgtccaaaattccacttttatcattgacggaccaaacacccctgagtgtcccgatgaccagagagcctggaatatctgggaggtggaagattacggcttcggtatttttacaactaacatctggttgaagctcagggactcatatacccaggtttgcgatcaccgtctgatgagtgctgcaataaaagactctaaggccgtgcacgctgatatggggtactggattgagagcgagaagaatgagacatggaagctagcccgggcatccttcatcgaagtaaagacgtgtatttggccaaaatcacataccctgtggagcaacggagtcctcgagtctgagatgatcatacccaagatccacggcggtcctatttcccaacataattatcgaccaggctacttcactcagacagcggggccgtggcacctgggaaaacttgaattggactttgatctgtgcgagggcaccactgtggtggtcgacgaacactgcgggaacagaggacccagtttaaggacaaccacggttactggcaagatcattcatgagtggtgttgccgcagctgtaccctccctccactgcggttcagaggtgaggatgggtgctggtacggaatggaaatcaggcccgtgaaagagaaggaagagaatcttgtaaagtctatggtgtccgccggctcaggtgaagtcgacagttttagcctgggcttgctctgtatatcgattatgatcgaggaggtgatgcgctcccgatggtctcggaaaatgctgatgacagggaccctagctgttttctttctgctcatcatgggacagctgacttggaacgaccttattcgtttgtgcatcatggtgggcgccaatgcaagcgatagaatggggatgggaacaacctatctggctttaatggccacattcaagatgaggcctatgtttgcagtcggcctcctgttccgccggcttacttcaagagaagtgctgctactcaccattggtctgagtttggttgcctccgtggagctgccaaactctttagaggaactcggggacggactggctatgggcataatgatccttaaactgttgacggattttcaaagctaccagctctgggcgacactgctatccctgaccttcattaagactaccttttcacttcactatgcctggaaaacaatggcaatggtcctcagcatcgtaagtctgttccccttgtgtctgtctactacctcccagaagacgacatggttaccggtgctcctgggcagccttgggtgcaagcctctgaccatgtttttgattgctgaaaataaaatctggggaaggaagtcgtggccactcaacgagggtataatggccgttggcatcgtgtcaattctgctatctagtctgcttaaaaacgacgtccccctcgccgggcctctgatcgctggaggcatgttgattgcatgttacgtgatctccggtagctctgccgatttaagcctggagaaggcggctgaagtatcctgggaggaagaggccgaacattcaggggcaagtcacaatatactcgtggaggtccaggacgatggaactatgaaaattaaggacgaggaacgagatgacacactgaccatccttctgaaagccactttgctagctgttagcggcgtgtatcccctgtctatcccagcaacactcttcgtgtggcatttctggcaaaagaagaaacagcgctccggcgtcctgtgggataccccttcacccccagaggtggaacgggccgttcttgacgatgggatttacagaataatgcagaggggattactgggtcgtagtcaggtaggcgtgggggtctttcaagagaacgtgttccacacgatgtggcacgttactcgcggagcggtgctcatgtatcagggcaagcggttggagccgagctgggcttccgtcaaaaaggacctgatctcttacggtgggggatggagactccagggctcgtggaataccggcgaagaggtgcaggtaattgccgtcgaacctgggaaaaaccccaagaatgtgcaaacagcaccaggaacctttaagacacccgagggtgaagttggcgccatcgctctggacttcaaacctgggactagcggatcaccaattgtgaacagggagggcaagatcgtcggtctttacgggaatggagtggttaccacgtccggcacatatgtgagtgccatagcacaggctaaagcctctcaggagggccccctgcctgaaatcgaggatgaagtctttcgaaagcggaacttgactattatggacctacatccggggagcggaaaaacccgcagatacctgccagcgatcgtgagggaggccattaagcggaagctccgaacattaatcctggcacccaccagagtagtggcttccgaaatggccgaggctcttaaaggtatgcctatacgctatcaaactaccgcagttaagtcagagcacacaggcaaagaaattgtcgatctgatgtgccatgccacgttcactatgaggctcttgtctccagtgcgtgtgcccaattacaacatgatcatcatggacgaggcccactttaccgatcctagcagtattgctgcgcgggggtatatctccacaagagtcggaatgggcgaagcagccgctatattcatgaccgccactccgcccggtagcatggaggcatttccacagtctaatgccgtaattcaggacgaagagagggatatccctgagcgctcatggaactccgggtacgaatggattacagacttccccggaaagaccgtgtggtttgttccaagtatcaaagctggcaatgatatagcgaactgtctgcgaaagaatggcaagagagtgattcagctcagccggaaaacgttcgacactgagtatcaaaagaccaagaataacgattgggactacgtcgtgaccaccgacatctcggaaatgggggccaatttcagggcagatcgcgttatcgaccctcgtagatgcctgaagcccgtgattcttaaagatggaccagagcgggtcatcctagctggtccgatgcctgtgactgtagcctctgcagcccagaggcgcggccgaattgggagaaaccataataaggagggagaccagtacatatatatgggccagcccctgaacaatgatgaagaccacgctcactggacagaggccaagatgttgttagataacatcaataccccagaaggtattatccccgcgctgtttgagcctgaacgggagaaatccgcagccatcgacggggagtacaggctccgcggcgaagctagaaagacattcgtggagctgatgaggcggggagatcttccagtttggctgagctataaagtcgcctcagaaggctttcaatacagtgaccgtcgctggtgcttcgatggggagcgaaacaatcaggtgctcgaagagaacatggacgtggagatttggactaaggaaggagagaggaaaaagttgaggccccggtggctggatgctcgcacgtattctgaccctctagcactgagagaatttaaagagttcgccgctggtaggcggtccgtcagcggcgacctcatacttgaaatcgggaagctgccgcagcatttaacccagcgagcccaaaatgcattggataacctggttatgctccacaattcagagcagggaggcagagcgtaccgccatgccatggaggaactgccagacacaattgagactcttatgctgctcgctttgatcgccgtgctgaccggtggggtaacattatttttcctaagtggcaagggactgggcaaaaccagcattgggctcctttgtgtgatggcatcctctgtcctgttgtggatggctagcgtggaaccccactggatcgccgcatccataatcctggagtttttcctcatggttctgcttattcctgagcccgataggcagcggactccacaggacaaccaactcgcctatgtggtcatcggactgttgtttatgattctgacggtagctgcgaatgaaatgggtttactagagaccacaaagaaagatctgggcatcgggcacgtggccgttgaaaaccatcaccatgcagctatgctcgacgtggatcttcaccctgcctcagcctggactctgtacgcagtcgctaccacaataattacccccatgatgcgtcatactatcgagaacacaacggccaatatttctttgaccgcgatcgctaaccaggccgcaatactgatgggactcgacaagggctggccaatcagtaaaatggatattggtgtgcctctgcttgccttagggtgctactcgcaggtcaatccgctgactctcacagctgcagtgttgatgctggttgcccactatgcgatcattggccccggactacaagctaaggccaccagagaagcacagaagaggaccgccgctggcatcatgaaaaacccaacaatagacgggattgtggccatcgatctggaccctgtagtgtacgatgcaaagttcgagaaacagctcggacagatcatgcttctgattttgtgtactagccaaatcctgctcatgcgcacgacctgggctctgtgcgagtccataacattagccactggcccccttaccacactgtgggaaggttctccagggaagttttggaataccactattgcggtctcaatggccaacatcttccggggaagctatctcgcaggcgctggtctagccttctccctgatgaaaagtttgggcgggggacgaagaggcacgggggcacagggagagacactgggcgaaaagtggaagaggcagctcaatcagctttctaaaagcgagtttaacacctacaagcgctcaggtattatggaagttgaccggtccgaggctaaagaggggctgaagagaggagaaactaccaaacacgccgtgagtcgtggcacagccaagttgaggtggttcgtcgagcggaatctggtgaagcctgaaggtaaagtaatcgacctcggctgtgggcgcggaggctggagctattactgcgcggggttaaagaaagtgactgaggttaagggatataccaaaggcggtcccgggcatgaagaaccgataccaatggctacatacggatggaacctggtgaaacttcactctggcaaagatgtctttttcatccctcccgagaagtgtgacacgctgctatgcgatattggcgaatcctcaccaaatcccaccatcgaggaagggcgaactctcagagtgctgaagatggtcgagccttggttgaggggaaaccaattttgtattaaaatcctgaatccgtacatgcccagcgtggttgagacactcgaacagatgcagcggaagcatggtggcatgcttgtacgcaacccactgtcgagaaattctacccacgagatgtattgggtgagttgcgggactggaaacattgtctccgcagtgaatatgacaagcaggatgttactgaaccgattcaccatggcccaccggaaacctacgtacgaacgtgacgttgatttgggcgctggtaccagacatgtggccgtcgagcccgaagtggcaaacctcgacatcatagggcagcgcattgagaatatcaagcacgagcataaatcaacatggcactatgatgaagacaacccttacaagacttgggcctatcatggatcctacgaggtaaagccatctggcagcgctagttccatggtgaatggcgttgtcaaactgctaaccaagccctgggatgtgatccctatggtgacacaaattgcgatgactgacaccacaccatttgggcagcagagggtcttcaaagaaaaggttgatacccggactcccaaagccaagagaggaacggcacaaataatggaggtgacagctcgctggctttggggttttctgagcaggaacaagaaaccgcgaatctgtacccgggaagagttcactagaaaggtaaggtctaatgccgcaattggcgccgtgtttgtcgacgagaaccagtggaactcagctaaagaagccgtggaggacgatcgcttctgggacctcgttcaccgtgaacgggagctgcacaagcaggggaaatgcgcgacctgcgtgtataacatgatgggaaagagagaaaagaaattgggcgagtttggtaaggcaaaagggagtagggccatctggtacatgtggctgggagctcgcttcctcgagttcgaagcccttggctttatgaatgaggatcattggttctcccgagaaaacagcctgtctggcgtcgagggggagggattacacaagctgggttacattttgcgggacatctcgaaaatacctggcgggaatatgtatgcagatgacacagctggatgggatacgagaatcaccgaagacgatctccagaacgaggccaagattactgacatcatggaaccagagcatgctctgctagccaaatcaatttttaaacttacataccaaaataaggtggtaagggttcagcgccccgccaaaaacggcaccgtgatggatgtcatcagcagacgggaccagaggggttccggacaggtgggaacttatggcctgaatacattcaccaacatggaagcgcaactcatacgtcagatggagagtgagggcatttttctgcctaacgaattggagacaccaaatttagccgggcgagtgctggattggctcgaaaagtacggagtcgagcgccttaaaagaatggctatctctggtgacgactgtgttgtgaagcccatcgatgaccggttcgccactgcactgaccgctctaaacgatatgggcaaagtaaggaaggacattccgcagtgggaacctagcaaggggtggaatgattggcagcaagtgcccttttgctcccaccacttccatcagctgataatgaaagacggacgcgagatcgtcgtgccatgtagaaaccaggatgagctcgttggccgggccagggtgtcacagggtgcagggtggagtttgcgagaaacggcctgcctgggaaagtcttatgcgcaaatgtggcagcttatgtactttcaccgtagagacctgcgcctcgctgccaatgcaatttgtagcgccgtccctgtggattgggtacccacctcccggacaacttggtcaatccatgctcaccatcagtggatgaccacagaggacatgttaagcgtttggaacagggtgtggattgaagagaatccatggatggaagataaaactagaatctcttcctgggaggacgtcccctatctgggcaagcgcgaggaccaatggtgcggcagtttgatagggctgaccgcccgggcaacgtgggctacaaacatccaggtggccattaatcaggttaggcgactcatcggaaacgaaaattacagcgattacatgacctcgatgaaaagattcaagaacgagtccgaacctgagggtgcgctttggtga

SEQ ID NO: 14013 - RNA, 9879 nt, synthetic construct
  misc_feature 1..9879: note = derived and/or modified CDS sequence (opt3) from DENV-1__EU482812__SS-prME
  source 1..9879: mol_type = other RNA
tccgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggcgacacagaacggacgcttgattaccgcaaatcccatcgtgactgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaaccgccagaggcgctaggcggatggccattctgggggatacagcatgggacttcggaagcatcggtggcgtgtttacgtccgttgggaaacttgtgcatcagattttcggaaccgcgtacggcgtcctgttttctggtgtgagctggactatgaagatagggatcggcgtattgctcacatggctgggattaaattcacgaagtacctccctgagcatgacatgtattgctgtgggcctagttactctctacctgggggtcatggtgcaggccgattctggatgcgtgatcaactggaaaggccgcgaacttaagtgtggttcagggatcttcgtcaccaatgaggttcacacgtggacagaacaatataagtttcaggcagacagtccgaaaagattgagcgccgctattggaaaggcctgggaggagggcgtgtgcggtataaggtccgcaacccggctggaaaacatcatgtggaaacagatttctaacgagctcaatcatatcctgttagaaaacgacatgaagttcactgtggtagtcggcgatgtggctgggattctggcccagggcaaaaagatgatccgccctcaacccatggagtacaaatattcgtggaaaagctggggcaaggcgaagataatcggggccgacgttcagaataccacatttattatcgatggaccaaacactcctgaatgtcccgacgatcagagagcttggaatatttgggaggtggaggactacggcttcggtatctttaccacaaacatatggcttaagttgagggattcctatacgcaggtctgcgaccaccgtctcatgtcagcagccattaaagatagtaaggctgtgcacgccgacatggggtactggatcgaatctgagaaaaatgaaacctggaagctggcacgggcgagcttcattgaggttaagacttgtatctggccaaaatcccatacactatggtcaaacggagtgctggaaagcgagatgataatccccaagatttatggcggtcctatctctcaacacaattaccgaccaggctacttcacccagactgccgggccgtggcatctcggaaaactggagcttgattttgacttgtgcgaaggcacaaccgtagtcgtggatgagcactgcgggaacagaggaccctccctgaggacgactaccgtgacaggcaagattatccacgaatggtgttgccgcagttgtaccttacctccactccggttcagaggtgaggacgggtgctggtatggaatggagataaggcccgtcaaagaaaaggaggaaaatctggttaagagcatggtgtctgctggctccggtgaggtagactcatttagtcttggcctgttgtgtattagcatcatgatcgaagaggtgatgcgctcgcgatggtcccggaaaatgctcatgactgggacactggccgtcttctttctactgattatgggacagctcacctggaacgatctgatccgtctttgcattatggtgggcgcaaatgcttctgacagaatggggatgggaacaacttacttggccctgatggcaaccttcaagatgaggcctatgtttgccgttggcttactcttccgccggctgacgagcagagaggtgcttctgctaacaataggtctctcactggtcgctagtgtggaattgccaaactccctggaggaattaggggatggactcgcgatgggcatcatgattctgaaacttctgaccgactttcaatctcatcagttgtgggccactctcctgagcctaaccttcatcaagacaactttttccctgcactatgcatggaaaaccatggctatggttctttcaattgtgagcctcttccccctgtgtttgagtacgacatctcagaagaccacttggctgccggtcttactcggctccctggggtgcaagcctcttacaatgtttctgatcgccgagaataaaatatggggaaggcgaagctggccattgaacgaaggtatcatggccgtaggcattgtgtcgatcctcctgtcatctctactgaagaacgatgttccccttgctgggcctctcattgcaggaggcatgctgatcgcctgttacgtgataagtggttccagcgcggacttgtctttagagaaagctgccgaggtcagctgggaagaggaagcagagcattccggggcctcacacaatattctggtggaagtacaggatgacggaaccatgaagatcaaagatgaggagcgcgacgatactctcacaatcctgcttaaggctaccctgttggcagtgagtggcgtctatcccctaagcattccagccacgctgttcgtttggtacttctggcagaaaaagaagcagcggtctggcgtgctctgggacactccttcacccccagaagtggagagagcggtcctggatgacgggatatataggatcatgcagcgtggacttttaggtcgcagccaggtgggcgttggggtatttcaagaaaacgtgttccataccatgtggcacgtcacacggggagctgtgctgatgtaccagggcaaaagactcgagccgagttgggccagcgttaagaaagacttgatttcctacggtgggggatggaggctgcagggctcttggaataccggcgaggaagtgcaggtcatcgcagtggagcctgggaagaaccccaaaaatgtacaaacagccccaggaacttttaagacccccgaaggtgaggtcggcgctattgccctcgatttcaagcctgggacgtcgggaagcccaatcgtgaaccgagaaggcaaaatagttggtctgtatgggaatggagtggtcacaacttcaggcacctacgtgtccgcaatcgctcaggccaaggcgagtcaggagggcccccttcctgagattgaagacgaggtttttcggaaacgcaacctgacaatcatggatttgcacccggggtctggaaagaccagaaggtatctaccagccattgtgcgggaagcaatcaaacgaaagctgagaactctcatattagctcccacccgcgtcgtggccagcgagatggctgaagcactgaagggtatgcctattaggtaccaaacaacggccgtaaaatccgagcatactggcaaggagatcgtggaccttatgtgccacgccaccttcacaatgcgtctgctctcaccagttcgggtccccaattataacatgatcattatggatgaagctcattttaccgacccttctagcatcgcggcaagagggtacataagtactagggtgggaatgggcgaggccgctgccattttcatgacagcaaccccgcccggttccgtggaagcctttccacagagcaatgctgtcatccaggatgaggaacgcgacattcctgagcgatcttggaactcagggtatgagtggatcacggatttccccggaaaaactgtatggtttgtgccatccataaagagtggcaatgacattgcgaactgtttgaggaaaaatggcaagcgggttatccagctgagcaggaagacattcgataccgaataccagaaaaccaagaacaacgactgggactacgtggtcactacagatatctcggagatgggggccaatttccgcgcagaccgtgtgattgatcctagacggtgcctcaaacccgttatcctgaaggacggaccagaaagggtgattcttgctggtccgatgcctgtcaccgtggcctctgcagcccagcgccgaggcagaatagggcggaaccacaataaagagggagatcagtatatctacatgggccagcccctaaacaatgacgaggatcatgctcactggacagaagccaagatgctgttggacaacattaatactccagagggtatcatccccgcgttatttgaacctgagagggaaaagtccgcagccattgatggggagtatcgcctgagaggcgaggctaggaaaacgttcgtagaactcatgcggcgtggagacctgccagtgtggcttagctacaaggttgcctcagagggctttcaatatagtgatcgccgatggtgcttcgacggggaaagaaacaatcaggtcctggaggaaaacatggatgtggagatatggaccaaagagggagaaaggaagaaactccggccccgctggttggacgctagaacatactctgaccctctggcactaagggagtttaaggagttcgccgctggtcggcgatccgtgagcggcgatctgatcctcgagattgggaaacttccgcagcacctgactcagagagcccaaaatgcattagacaacttggtcatgctgcataattcagaacagggaggccgcgcgtataggcacgccatggaggagctcccagataccatcgaaacactgatgcttctggctctcattgccgttttgaccggtggggtgactctgtttttcttaagtggccggggactaggcaagacgagcatcgggctgctctgtgtaatggcatcctctgtgcttctgtggatggctagcgtcgagccccattggatagccgcatccatcattttggaatttttcctgatggtgctcctgatccctgagcccgaccgtcagagaaccccacaggataaccaacttgcctacgttgtgattggactcctgtttatgatcttgacagtcgctgcgaatgagatgggtctgttagaaactaccaagaaagacctaggcatagggcacgtagccgtggagaaccaccatcacgcagctatgctggatgttgacctccatcctgcctcagcctggacactttacgcagtggctaccactattatcacacccatgatgaggcacacgattgaaaacaccactgccaatatctctctgacagcgatagctaaccaggccgcaatcttgatgggactggataagggctggccaattagtaaaatggacatcggtgtccctctcctggcccttgggtgctatagccaggtgaatccgttaaccctgaccgctgcagtcctcatgttggtggcccattacgcgattatcggccccggactgcaagctaaggccacacgcgaggcacagaaacggactgccgctggcataatgaagaacccaacggttgatgggattgtggccatcgacctagatcctgtagtgtatgacgcaaagttcgaaaaacagctgggacagatcatgctccttattctgtgtaccagccaaatcttgctgatgcgaacaacttgggctctctgcgagtccataaccctggccacaggccccttaaccactctttgggagggttctccagggaagttttggaatacgacaattgcggtctcaatggccaacatcttcagaggaagctacctggcaggcgctggtctcgccttctccctaatgaaaagtctgggcgggggaaggcgcggcaccggggcacagggagaaactttgggcgagaagtggaaacggcagctgaatcagctctctaagagcgaatttaacacctataagagatcaggtattatggaggttgaccgttccgaagctaaagaggggcttaagaggggagagacaactaaacacgccgtgagtcggggcaccgccaagctgcgctggttcgtcgaacgaaatttggtgaaacctgagggtaaggtaatcgatctgggctgtgggagaggaggctggagctactattgcgcggggctcaagaaagtgacagaagttaagggatacacgaaaggcggtcccgggcacgaggaaccgataccaatggctacctacggatggaacttagtgaagctgcattctggcaaagacgtctttttcatccctcccgagaagtgtgatactcttctgtgcgacattggcgagtcctcaccaaatcccacaatcgaagaggggaggaccctacgggtgctcaaaatggtcgaaccttggctgcgcggaaaccaattttgtattaagatcttgaatccgtatatgcccagcgtggttgagactctggagcagatgcagagaaagcacggtggcatgctcgtaaggaacccactttcgcgaaattctacacatgaaatgtactgggtgagttgcgggaccggaaacattgtctccgcagtgaatatgacgagccggatgctgttaaaccgtttcaccatggcccacagaaaacctacatatgagcgcgatgttgacctgggcgctggtactaggcacgtggccgtcgaacccgaggtggcaaacttggatatcatagggcagcggattgaaaatatcaagcatgagcacaaatcaacctggcattacgacgaggataacccttataagacatgggcctaccacggatcctatgaagtaaaaccatctggcagcgctagttccatggtgaatggcgttgtcaagctcctgactaagccctgggacgtgatccctatggtgacccaaattgcgatgacagataccactccatttgggcagcagagagtcttcaaagagaaggttgacacgcgcacacccaaagccaagaggggaaccgcacaaataatggaagtgactgctaaatggctatggggttttcttagccgaaacaagaagccgcggatctgtaccagagaggagttcacaaggaaagtacgctctaatgccgcaattggcgccgtgtttgtcgacgagaaccagtggaactcagctaaggaggccgtggaagatgagcgtttctgggacctggttcatcgggaaagagagctccacaaacaggggaagtgcgcgacgtgcgtgtacaacatgatgggaaaaagggaaaagaagctgggcgagtttggtaaagcaaaggggagtcgcgccatctggtacatgtggttgggagctcgattcctggagttcgaagccctcggctttatgaatgaggatcactggttctcccgggaaaacagcctttctggcgtcgagggggagggactgcataaattaggttatattctgagagacatctcgaagatacctggcgggaatatgtacgcagatgacaccgctggatgggatactaggatcacagaagacgatttgcagaacgaggcccgcattaccgacatcatggaaccagagcacgctctcctggccaaatcaatttttaagctaacttatcaaaataaagtggtaagagttcagcggcccgcaaagaacggcacagtgatggatgtcatcagcaggcgtgaccagcgaggttccggacaggtgggaacctacggccttaatacattcactaacatggaagcgcaactgatacgccagatggagagtgagggcatattttctcctagcgaactcgagaccccaaacctggccgaaagagtgttggattggttagagaagtatggggtcgaacggctgaaaaggatggctatctccggagacgactgtgttgtgaagcccatcgatgaccgcttcgccacggcactcaccgctcttaatgatatgggtaaagtaagaaaggacattccgcagtgggagccttcaaaaggctggaacgattggcagcaagtgcccttttgcagtcatcacttccaccagctgataatgaaggacgggcgggagatcgtcgtgccatgtaggaatcaggatgagctagttggacgagcccgtgtgtctcagggcgcaggttggagcctgagagagacagcctgcctcgggaagtcctacgcgcaaatgtggcagttgatgtattttcatcgccgggacctgaggcttgctgccaacgcaatttgttcagccgtccctgtggattggatccccactagcagaaccacatggtctattcacgctcatcaccagtggatgactaccgaagacatgctgtccgtatggaatcgcgtttggatcgaggaaaacccatggatggaggataaaacgcatataagtagctggggagacgtgccctacctcggcaagcgggaggaccaatggtgcggctcgttaatcgggctgacagccagggcaacctgggctactaatattcaggtcgccatcaaccaggtgcgaagattgattggaaatgaaaactacctggattatatgacatccatgaaacggttcaagaatgagtctgaccctgaaggtgcgctctggtga

SEQ ID NO: 14014 - RNA, 9879 nt, synthetic construct
  misc_feature 1..9879: note = derived and/or modified CDS sequence (opt3) from DENV-1__EU482813__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcaccccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcactagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaagaggccttgaagctgtcatggtttaagaaaggcagtagcatcggaaagatgttcgaagcaactgccagaggcgctaggcggatggccatcctcggggataccgcatgggactttggatccattggtggcgttttcacatctgtggggaaactggtccatcagatctttggaacggcgtacggcgtgcttttcagcggtgtatcatggaccatgaagattgggataggcgtgctgttgacttggctcggactgaatagtcgatccacaagcttatctatgacctgtatcgctgttggcctggtcacactatacctcggggtgatggtgcaggccgattcaggatgcgtcattaactggaaaggccgcgagctgaagtgtggtagtgggatctttgttactaatgaagtgcacacctggacggagcagtataagttccaagcagacagcccgaaaagactttccgccgctatcggaaaggcctgggaggaaggcgtgtgcggtattaggtctgcaacacggttggagaacataatgtggaaacagatctcgaacgaactgaatcatattctcctggagaacgacatgaagtttaccgtagtcgtgggcgatgttgctgggatcttagcccagggaaaaaagatgattcgccctcagcccatggaatacaaatatagctggaagtcctggggcaaggcgaaaatcataggggccgacgtgcaaaatactaccttcatcattgatggaccaaacacacctgagtgtcccgacgatcagagagcttggaatatctgggaggtcgaagactacggctttggtattttcactaccaacatctggctgaagcttagggattcatatacacaggtgtgcgaccaccgtttgatgagtgcagccataaaagattctaaggctgttcacgccgacatggggtactggattgagagcgaaaaaaatgagacgtggaagctcgcacgggcgtccttcatcgaagtgaagacctgtatttggccaaaatcacatactctgtggagcaacggagtactagagtctgagatgatcatacccaagatctatggcggtcctatttcccagcacaattaccgaccaggctactttacacaaaccgccgggccgtggcatctgggaaaactcgaactggatttcgacctttgcgagggcactacagtcgtggtggatgaacactgcgggaacagaggacccagtttgaggaccacgactgtcaccggcaagatcattcacgagtggtgttgccgcagctgtacactgcctccattacggtttaaaggtgaggacgggtgctggtatggaatggaaatcagacccgttaaggagaaggaagagaatctcgtgaaatctatggtatccgctggctcaggtgaagtggacagtttcagcctgggccttctgtgtatatcgattatgatcgaggaggtcatgaggtcccgctggtctcgaaagatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaaaatgagacctatgttcgccgtgggcctgttatttaggcgcctcacctcacgggaagtcctgcttctgacgattggtctaagtctcgtggcttccgttgagctgccaaactctttggaagagctgggggatggattagcgatgggcataatgatcctcaagctgcttacagacttccagagccatcaactgtgggccaccttgctctccctgacttttattaaaaccacattctcactacactatgcatggaagactatggctatggtgctgagcatcgtcagtctttttcccctctgtctgtctaccacgtcccagaagacaacctggttgccggtactgttaggcagcctcgggtgcaaacctctgactatgttccttattgccgaaaataagatctggggaagaaaatcgtggccactgaacgagggtataatggccgtgggcatcgtttcaattttgctctctagtctgctaaagaacgatgtgcccctggctgggcctcttatcgcaggaggcatgctcattgcctgttacgtcatctccggtagctctgcggacctgagcttggagaaagctgccgaagtgtcctgggaggaagaggcagaacattcaggggccagtcacaatatattagtagaggtgcaggatgacggaacaatgaagattaaagatgaggaaagggacgataccctgactatcctcctgaaggctacacttctggcagtcagcggcgtttatcccttgtctatcccagccaccctattcgtgtggtacttttggcagaagaaaaagcaacgatccggcgtgctgtgggacacgccttcacccccagaggtcgaacgcgcggtgctcgatgacgggatttatcggataatgcagagaggactgcttggtaggagtcaggttggcgtaggggtgttccaggagaacgtctttcatactatgtggcacgtgacccgtggagctgttttaatgtaccaaggcaaacgcctggagccgagctgggcctccgtgaagaaagacctcatctcttacggtgggggatggcggttgcagggctcgtggaatacaggcgaagaggtccaggtgattgcagtagaacctgggaagaaccccaagaatgtccagaccgccccaggaacattcaaaactagcgagggtgaagtgggcgctatcgccctggattttaagcccgggacctcaggatcccctattgttaacagagagggcaaaatcgtgggtctctatgggaatggagtcgtgacgacaagtggcacttacgtttctgcaatagctcaagccaaggcgagccaggagggcccactgcccgaaatcgaggacgaagtgttcaggaaacgaaaccttaccattatggatctgcaccctgggtccggaaagacacggcgctatttgccggccatcgtcagagaggcaattaagaggaaactacggaccctgatcctcgctccaactcgagtggtagcctcagaaatggctgaggcattaaagggtatgcccataagataccagaccacagccgtgaaatctgagcatacgggcaaggaaattgttgacctgatgtgccacgccacttttaccatgcgccttctgagccctgtcagggtgccaaattataacatgatcatcatggatgaggctcatttcacagaccccagttccattgcggcacgtgggtacatcagcacccgggtgggaatgggcgaagccgctgccatatttatgactgcaacacctccgggttctgtcgaggccttcccccaatcaaatgctgtaattcaggatgaagagagagacatcccagagaggtcctggaacagtgggtatgaatggattaccgattttcctggaaaaacggtgtggttcgttcccagcatcaagtcgggcaatgacatagcgaactgtctccgcaagaatggcaaacgagtgattcagttgtctagaaagactttcgatacagagtaccagaaaaccaagaacaacgactgggactacgtcgtgaccactgatatctccgaaatgggggccaattttcgggcagacagggttatcgatccacgccgttgcctgaaacctgtgattctcaaggacggacccgagagagtcatcctggctggtccaatgccggtgacagtagccagcgcagcccaacggaggggccgcattgggcgaaaccacaataaggagggagatcagtatatatacatgggccagcctcttaacaatgacgaagatcatgctcactggaccgaggccaaaatgctactggacaacatcaatacacccgaaggtattatcccagcgttgttcgagcccgaaagagagaagtcagcagccatcgatggggagtatcggttaaggggcgaagctcgcaaaacttttgtggagctgatgagaaggggagacctccctgtttggctgagttacaaggtcgcctctgaaggcttccagtattccgatcggcgttggtgctttgacggggagcgcaacaatcaagtgcttgaagagaacatggatgtggagatttggacgaaagaaggagagcgaaagaaactgagaccaaggtggctcgacgctcggacctacagcgaccccttggcactgcgcgaattcaaggagtttgccgctggtagaaggtcagtcagtggcgatctaatactggaaatcgggaagctccctcagcaccttacacagcgggcccagaatgcactggacaacttagttatgttgcataatagcgagcaaggaggccgagcgtatagacacgccatggaggaactgccggatactattgagaccctcatgctgcttgctctgatcgccgtgctcacaggtggggtaaccttgttctttctgtccggccgcggattaggcaaaacttctattgggctactgtgtgtgatggcaagctccgtcctcctttggatggcttcagtggaaccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgaaatgggtttgctggagacaactaagaaagacttaggcatcgggcacgtggccgttgaaaaccaccatcacgcagctatgctagatgtggacctgcatccagccagtgcctggaccctctacgcagtcgctacaaccataattactcctatgatgcgtcacacaatcgagaacacgaccgccaatatttcgcttactgcgatcgctaaccaagccgcaatactgatgggattggataagggctggcccatcagcaaaatggacattggtgtgccactgctcgccctggggtgctattcccaggtcaatcctcttacattaaccgctgcagtgctgatgctcgttgcccattacgcgatcattggcccgggattgcaggctaaggccaccagagaagcacaaaagaggacagccgctggcatcatgaaaaaccccactgtggatgggatagtagccattgacctggatccagtggtctatgacacgaagtttgagaaacagctaggacagatcatgctgctcatcctttgtacctctcagattctgttgatgcgcacaacttgggcactgtgcgagtcaatcaccctcgctacaggccctctgaccactttatgggaaggtagccccgggaagttctggaatacgacaatagccgtttccatggcgaacattttccggggaagttaccttgccggcgcaggtctggctttttctctcatgaaaagcctaggcgggggacgaagaggcaccggggcccaaggagagactctgggcgaaaagtggaagaggcagttgaatcagctgtcaaaatccgagttcaacacctataagcgcagtggtatcatggaagtggaccggagcgaggcaaaagaggggctcaagagaggagaaacaactaaacacgctgtctctcgtggcaccgccaagcttaggtggtttgtggagcggaatctggtaaagccagaaggtaaagtgattgatttgggctgtgggcgcggaggctggtcctactattgcgccgggctgaagaaagttacagaggtgaagggatacacgaaaggcggtcctgggcacgaagagcccatcccgatggcgacctacggatggaacctcgtcaagttacattcaggcaaagacgtgttctttataccacctgagaagtgtgatactctgctttgcgacatcggcgaaagctcgcccaatccaacaattgaggaagggcgaaccctgagagtcctaaagatggtggagccctggctcaggggaaaccagttctgtatcaaaattctgaatccttatatgccgtctgttgtagagactttggaacaaatgcagcggaagcacggtggcatgctggtgcgcaaccccctcagtagaaattccacacatgagatgtactgggtcagctgcgggaccggaaacatcgtgtcagctgttaatatgacgtccaggatgcttctgaaccgatttaccatggcacaccggaaaccaacatatgaacgtgatgtggacttaggcgccggtactagacacgtcgctgtggagcctgaagtagccaacctggatattatcgggcagcgcatagagaatattaagcatgagcacaaatctacctggcattacgacgaagataacccctataagacatgggcataccacggaagctatgaggtgaagcctagtggctccgccagctctatggttaatggcgtcgtgaaattgctcactaagccatgggacgtgatccccatggtcacccagatcgctatgacagataccactcctttcgggcaacagagggtttttaaagaaaaggtggacacgcggacaccaaaagcgaagagaggaaccgcccagattatggaggtaactgcaaagtggctgtggggtttcctatcacgcaacaaaaagcccaggatatgtacccgagaagagtttacacggaaagtgagaagtaatgctgccatcggcgcagtcttcgtggacgagaaccaatggaattccgccaaggaagctgttgaggatgaaaggttttgggaccttgtgcatcgcgagcgtgaactgcacaaacaggggaagtgcgccacgtgcgtctacaacatgatgggaaagcgggagaaaaagctcggcgagttcggtaaagcgaaggggagcagagcaatttggtacatgtggctgggagccaggttcttggaatttgaggctctgggcttcatgaatgaagatcactggttttctcgcgagaactcgctctcaggcgtggagggggaaggacttcataaactgggttatatcttacgagacattagcaagatcccgggcgggaatatgtacgccgatgacaccgcaggatgggatactcggataacagaggacgatctgcagaacgaagctaaaatcaccgacattatggagcctgaacacgccttgctcgctaagtccatcttcaagctgacttatcagaataaagtagttagagtgcaaaggccagccaagaacggcacagtcatggatgtgattagtcgcagagaccagcggggttctgggcaggtgggaacctacggcctaaatacatttactaacatggaggcacagcttatcaggcaaatggagagcgaaggcatattctccccctcagagctggaaacccctaacctcgcggggcgtgtcctggattggttggagaaacatggagttgaacgattaaagcgcatggccattagtggtgacgactgtgtggtaaaaccaatcgatgacagatttgctacggccctgaccgcactcaatgatatgggcaaggtgcggaaggacatcccccagtgggagccgtctaaagggtggaacgattggcagcaggtccctttctgcagccaccactttcatcaacttattatgaaggacggaagggagatagtggttccctgtcgcaatcaggatgaactggtgggcagagctcgggtctcccagggtgccgggtggtcactaagggagacagcatgcctgggaaaaagctatgcccagatgtggcaactcatgtacttccaccgacgtgacttgagactggcggctaacgccatctgttctgcagtgccagtagattgggttcctacttcccgcaccacatggagtattcatgcccaccatcagtggatgactaccgaagacatgcttagcgtgtggaatcgggtctggatcgaggaaaacccctggatggaggataagacgcacatttcgtcctggggcgacgtgccatatctgggcaaaagggaggaccagtggtgcgggtctctcatcggattaacagctagagccacctgggcaactaatatacaagttgctatcaaccaggtgcgccggctgattggtaatgaaaactacttggattacatgacatcaatgaagaggtttaagaatgagagcgaccccgaaggcgccctgtggtga

SEQ ID NO: 14015 - RNA, 9879 nt, synthetic construct
  misc_feature 1..9879: note = derived and/or modified CDS sequence (opt3) from DENV-1__EU482814__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggctttggtcttgagactagaaccgaaacatggatgtcctctgagggggcctggaaacagatccagagggtggaaacttgggctctgcggcaccctggattcaccgttattgcattgtttctcgcccatgctatcggcacatcgattacccagaagggcatcatattcatcctgctgatgctcgtgacgccatcaatggccatgcgctgcgtcgggattggaagcagagattttgtggagggtttaagtggcgcgacttgggtagacgttgtgctggagcacgggtcctgtgtcacaaccatggcaaaggataaacccactcttgacatcgaattgctgaagacagaggtgaccaaccctgccgtgctaaggaaactctgcattgaagctaagatctctaatacgaccacagatagccggtgtccaactcaaggagaggccaccctggtcgaagagcaggacgcaaacttcgtttgccgccgaacatttgtggatagaggctggggtaatgggtgtggacttttcggcaaaggctccctgataacttgcgctaagtttaagtgcgtaaccaaattggaggggaagacagtgcagtacgaaaacctcaaatattcagtcattgtgaccgttcacactggagaccagcatcaagtgggtaatgagagtacggaacacggcacaaccgccactatcaccccccaggcgcctagcacagagattcagctgaccgactacggggccttaactctggattgttctccaaggacaggactcgacttcaacgaaatggtccttctgacgatgaaggagaaatcctggttggtgcataagcagtggtttctagatctgccgctcccctggacctcaggcgcaagcactagtcaagagacatggaatcggaaagacctgcttgtaaccttcaagacagctcacgccaagaaacaggaagttgtggtcctgggttctcaggagggggctatgcacactgccttgaccggcgcaacggaaatccaaacctccggaacaactaccatcttcgccggccatctcaagtgccgtctgaaaatggataagttaacactgaaagggatgagctatgtgatgtgtactggatcgtttaagctagagaaggaagtcgctgagacccagcacggtacggtgctcgttcagattaaatacgagggcacagacgcgccttgcaagataccattctctacccaggatgaaaaaggggtgactcaaaacggacgcctgatcacagcaaatcccattgtaaccgacaaggagaaacctgtcaacatcgaagccgagccaccctttggcgagtcctatatagtgattggtgctggggaaaaggcccttaagttgtcatggttcaaaaagggcagtagcatcggaaaaatgtttgaggcaactgccagaggcgctaggcggatggccatcctgggggataccgcatgggacttcggatccattggtggcgtttttacatctgtggggaagctcgtccatcagatcttcggaacggcgtacggcgtgctgtttagcggtgtatcatggaccatgaaaattgggataggcgtgcttctgacttggttgggactcaatagtcgatccacaagcctgtctatgacctgtatcgctgttggcttagtcacactgtacctaggggtgatggtgcaggccgattcaggatgcgtcattaactggaagggccgcgaactcaagtgtggtagtgggatcttcgttactaatgaggtgcacacctggacggaacagtataaatttcaagcagacagcccgaagagactgtccgccgctatcggaaaagcctgggaggagggcgtgtgcggtattaggtctgcaacacggcttgaaaacataatgtggaagcagatctcgaacgagttgaatcatattctgctcgaaaacgacatgaaattcaccgtagtcgtgggcgatgttgctgggatcctggcccagggaaagaaaatgattcgccctcagcccatggagtacaagtatagctggaagtcctggggcaaagcgaagatcataggggccgacgtgcaaaatactacctttatcattgatggaccaaacacacctgaatgtcccgacgatcagagagcttggaatatctgggaggtcgaggactacggcttcggtattttcactaccaacatctggttaaaactgagggattcatatacacaggtgtgcgaccaccgtcttatgagtgcagccataaaggattctaaagctgttcacgccgacatggggtactggattgaaagcgagaagaatgaaacgtggaagttggcacgggcgtcctttatcgaggtgaaaacctgtatttggccaaagtcacatactctctggagcaacggagtactggaatctgagatgatcatacccaaaatctatggcggtcctatttcccagcacaattaccgaccaggctacttcacacaaaccgccgggccgtggcatctaggaaagctggagctcgattttgacctgtgcgaaggcactacagtcgtggtggatgagcactgcgggaacagaggacccagtcttaggaccacgactgtcaccggcaaaatcattcacgaatggtgttgccgcagctgtacattgcctccactgcggttcaagggtgaggacgggtgctggtatggaatggagatcagacccgttaaggaaaaagaggaaaatttagtgaagtctatggtatccgctggctcaggtgaggtggacagttttagcctcggcctgctttgtatatcgattatgatcgaagaggtcatgaggtcccgctggtctcgaaaaatgctgatgaccgggactttggccgtgttctttctcctgatcatgggacagctaacatggaacgatctgattcggctctgcatcatggttggcgcaaatgctagcgaccgtatggggatgggaaccacatacctggcccttatggcaactttcaagatgagacctatgtttgccgtgggcttgctgttcaggcgcttaacctcacgggaggtcctcctgcttacgattggtctgagtctagtggcttccgttgaactcccaaactctctggaggaattgggggatggactggcgatgggcataatgatcttaaaactcctgacagactttcagagccatcaactttgggccaccctgttgtccctcactttcattaagaccacattttcactgcactatgcatggaagactatggctatggtgctaagcatcgtcagtctgttccccctttgtctctctaccacgtcccagaaaacaacctggctgccggtattgctgggcagcttagggtgcaagcctctcactatgttcctgattgccgagaataaaatctggggaagaaagtcgtggccacttaacgaaggtataatggccgtgggcatcgtttcaattctgttgtctagtctcctgaaaaacgatgtgcccctagctgggcctctgatcgcaggaggcatgcttattgcctgttacgtcatctccggtagctctgcggacctcagcctggagaaggctgccgaggtgtcctgggaagaggaagcagagcattcaggggccagtcacaatatattggtagaagtgcaggatgacggaacaatgaaaattaaggatgaggagagggacgataccttaactatcctgctcaaggctacactgcttgcagtcagcggcgtttatcccctgtctatcccagccaccttgtttgtgtggtacttctggcagaaaaagaaacaacgatccggcgtgctatgggacacgccttcacccccagaagtcgagcgcgcggtgctggatgacgggatttatcggataatgcagagaggactcctgggtaggagtcaggttggcgtaggggtgtttcaggaaaacgtcttccatactatgtggcacgtgacccgtggagctgttcttatgtaccaaggcaagcgcttagagccgagctgggcctccgtgaaaaaggacctgatctcttacggtgggggatggcggctccagggctcgtggaatacaggcgaggaagtccaggtgattgcagtagagcctgggaagaaccccaaaaatgtccagaccgccccaggaacatttaagactagcgaaggtgaggtgggcgctatcgccttggatttcaaacccgggacctcaggatcccctattgttaacagagaaggcaagatcgtgggtctgtatgggaatggagtcgtgacgacaagtggcacttacgtttctgcaatagctcaagccaaagcgagccaggagggcccactccccgagatcgaagacgaggtgtttaggaagcgaaacctgaccattatggatcttcaccctgggtccggaaagacacggcgctatctgccggccatcgtcagagaagcaattaaaaggaagttgcggaccctaatcctggctccaactcgagtggtagcctcagagatggctgaagcactcaaaggtatgcccataagataccagaccacagccgtgaagtctgagcatacgggcaaagagattgttgacttaatgtgccacgccactttcaccatgcgcctgcttagccctgtcagggtgccaaattataacatgatcatcatggatgaagctcattttacagaccccagttccattgcggcacgtgggtacatcagcacccgggtgggaatgggcgaggccgctgccatattcatgactgcaacacctccgggttctgtcgaagcctttccccaatcaaatgctgtaattcaggatgaggaaagagacatcccagagaggtcctggaacagtgggtatgagtggattaccgatttccctggaaagacggtgtggttcgttcccagcatcaagtcgggcaatgacatagcgaactgtctgcgcaaaaatggcaagcgagtgattcagctctctagaaaaacttttgatacagaataccagaagaccaaaaacaacgactgggactacgtcgtgaccactgatatctccgagatgggggccaatttccgggcagacagggttatcgatccacgccgttgcttgaagcctgtgattctgaaggacggacccgaaagagtcatcctcgctggtccaatgccggtgacagtagccagcgcagcccaacggaggggccgcattgggcgaaaccacaataaagagggagatcagtatatatacatgggccagcctctgaacaatgacgaggatcatgctcactggaccgaagccaagatgcttctagacaacatcaatacacccgagggtattatcccagcgctgtttgaacccgagagagaaaaatcagcagccatcgatggggagtatcggttgaggggcgaggctcgcaagactttcgtggaattaatgagaaggggagacctgcctgtttggctcagttacaaagtcgcctctgagggctttcagtattccgatcggcgttggtgcttcgacggggaacgcaacaatcaagtgctggaggaaaacatggatgtggagatttggacgaaggagggagaacgaaaaaagcttagaccaaggtggctggacgctcggacctacagcgaccccctcgcattgcgcgagtttaaggaattcgccgctggtagaaggtcagtcagtggcgatctgatactagagatcgggaaactgcctcagcacctcacacagcgggcccagaatgcacttgacaacctggttatgttacataatagcgaacaaggaggccgagcgtatagacacgccatggaggagttgccggatactattgaaaccctgatgctcctggctcttatcgccgtgctgacaggtggggtaaccctctttttcttgtccggccgcggactgggcaagacttctattgggttactatgtgtgatggcaagctccgtcctgctctggatggcttcagtggagccacattggatcgccgcatctataatccttgaatttttcctgatggttttgctgattcccgagcctgacaggcagcggacgccccaggataaccagctcgcctacgtggtcatcggactgctttttatgattctcaccgtagctgcgaatgagatgggtctgttggaaacaactaaaaaggacctgggcatcgggcacgtggccgttgagaaccaccatcacgcagctatgttagatgtggacctacatccagccagtgcctggaccctgtacgcagtcgctacaaccataattactcctatgatgcgtcacacaatcgaaaacacgaccgccaatatttcgctcactgcgatcgctaaccaagccgcaatacttatgggactggataaaggctggcccatcagcaagatggacattggtgtgccattgctggccctcgggtgctattcccaggtcaatcctctgacacttaccgctgcagtgttaatgctggttgcccattacgcgatcattggcccgggactccaggctaaggccaccagagaggcacaaaaaaggacagccgctggcatcatgaagaaccccactgtggatgggatagtagccattgacttggatccagtggtctatgacgcaaaattcgaaaagcagctgggacagatcatgctactgatcctctgtacgtctcagattcttctgatgcgcaccacatgggctttgtgcgagtcaatcactctggccaccggccctctcacaaccctgtgggagggtagccccgggaaattctggaatactacgatagcggtttccatggccaacatttttcggggaagttacttagcaggcgctggtcttgccttctctctgatgaagagcctcggcgggggacgaagaggcacaggggcacaaggagaaaccctaggcgagaagtggaaaaggcagctgaatcagttgtcaaagtccgaatttaacacttataaacgcagtggtatcatggaggtggaccggagcgaagctaaggaggggctgaaaagaggagagaccacaaagcacgccgtctctcgtggcactgccaagctcaggtggttcgtggaacggaatcttgtaaaaccagagggtaaggtgattgatctgggctgtgggcgcggaggctggtcctactattgcgcggggttgaaaaaggttaccgaagtgaaaggatacacaaagggcggtcctgggcacgaggaacccatcccgatggctacgtacggatggaacctggtcaaactccattcaggcaaggacgtgtttttcataccacctgagaagtgtgataccttactgtgcgacatcggcgagagctcgcccaatccaactattgaagaggggcgaacacttagagtcctgaaaatggtggaaccctggctaaggggaaaccagttttgtatcaagattctcaatccttatatgccgtctgttgtagagaccctggagcaaatgcagcggaaacacggtggcatgttggtgcgcaaccccctgagtagaaattccactcatgaaatgtactgggtcagctgcgggacaggaaacatcgtgtcagcagttaatatgacctccaggatgctccttaaccgattcacgatggcccaccggaagccaacctatgagcgtgatgtggacctgggcgctggtacaagacacgtcgccgtggaacctgaggtagcaaacttagatattatcgggcagcgcatagaaaatattaaacatgagcacaagtctacttggcattacgacgaggataacccctataagacctgggcctaccacggaagctatgaagtgaaacctagtggctccgctagctctatggttaatggcgtcgtgaagctgttgacaaaaccatgggacgtgatccccatggtcactcagatcgcgatgaccgatacaaccccttttgggcaacagagggttttcaaggagaaagtggacactcggacgccaaaggccaagagaggaacagcacagattatggaagtaaccgctaaatggctctggggttttctgtcacgcaacaagaaacccaggatatgtactcgagaggaattcacccggaaggtgagaagtaatgccgcaatcggcgccgtctttgtggacgagaaccaatggaattccgctaaagaggccgttgaagatgagaggttctgggacctagtgcatcgcgaacgtgagcttcacaagcaggggaagtgcgcgacatgcgtctacaacatgatgggaaaacgggaaaagaaactgggcgagttcggtaaggcaaaagggagcagagccatttggtacatgtggctcggagctaggtttctggagttcgaagccttgggctttatgaatgaggatcactggttctctcgcgaaaactcgctgtcaggcgtggagggggagggactccataagcttggttatatcctgcgagacattagcaaaatcccgggcgggaatatgtacgcagatgacacggctggatgggatacccggataactgaagacgatttacagaacgaggccaagatcacagacattatggaacctgagcacgctctgttggccaagtccatctttaaactcacctatcagaataaggtagttagagtgcaaaggccagcaaaaaacggcactgtcatggatgtgattagtcgcagagaccagcggggttctgggcaggtgggaacatacggcctgaataccttcacaaacatggaagcgcagctaatcaggcaaatggagagcgagggcatattttccccctcagaacttgagactcctaacctggccgggcgtgtcctcgattggctggaaaagcatggagttgagcgattgaaacgcatggctattagtggtgacgactgtgtggtaaagccaatcgatgacagattcgccaccgcattaacggctctgaatgatatgggcaaggtgcggaaagacatcccccagtgggaaccgtctaaggggtggaacgattggcagcaggtccctttttgcagccaccacttccatcaactcattatgaaagacggaagggagatagtggttccctgtcgcaatcaggatgagcttgtgggcagagcccgggtctcccagggtgcagggtggtcactgagggaaaccgcctgcctaggaaagagctatgcgcagatgtggcaactgatgtactttcaccgacgtgacctcagattggctgccaacgcaatctgttctgccgtgccagtagattgggttcctacatcccgcactacctggagtattcatgctcaccatcagtggatgacaactgaggacatgctgagcgtgtggaatcgggtctggatcgaagagaacccctggatggaagataaaacccacatttcgtcctggggcgacgtgccatatcttggcaagagggaggaccagtggtgcgggtctctgatcggactcacggccagagcaacatgggctaccaatatacaagttgccatcaaccaggtgcgccggttaattggtaatgagaactacctggattacatgacttcaatgaagaggttcaaaaatgaaagcgaccccgagggcgcgttgtggtga

SEQ ID NO: 14016 - RNA, 9879 nt, synthetic construct
  misc_feature 1..9879: note = derived and/or modified CDS sequence (opt3) from DENV-1__EU482815__SS-prME
  source 1..9879: mol_type = other RNA
agcgtgaccatgctgctcatgcttatgcccgccgctctggccttccacttgaccactagaggcggggaacctcatatgatcgtctccaagcaggaaagggggaagtctttactgtttaagacgtcagccggtgttaatatgtgcaccctaattgcgatggacctcggcgagttctgtgaagatacaatgacttacaagtgcccacggataaccgaagctgaaccggacgatgtggactgttggtgcaatgccacagatacctgggtaacttatgggacatgtagtcaaaccggagaacaccgccgagacaagcgtagcgtggcactggcaccccatgtcggccttggtctggagacgagaactgaaacctggatgtcctctgagggggcttggaaacagatccagagggtggaaacatgggcattgcggcaccctggatttactgttattgccctcttcctggctcatgccatcggcacctcgattacacagaagggcatcatatttatcctgctcatgttagtgaccccatcaatggcgatgcgctgcgtcgggattggaagcagagatttcgtggagggtctgagtggcgcaacgtgggtagacgttgtgcttgagcacgggtcctgtgtcactacaatggccaaggataaacccaccttggacatcgaactgctaaagactgaggtgacaaaccctgctgtgctcaggaaactgtgcattgaagccaagatctctaataccacgaccgatagccggtgtccaacacaaggagaggcaactcttgtcgaagaacaggacgctaactttgtttgccgccgaaccttcgtggatagaggctggggtaatgggtgtggactgtttggcaaaggctccttgataacatgcgccaagttcaagtgcgtaactaaactcgaggggaagaccgtgcagtacgaaaacctgaaatattcagtcacagtgaccgttcacactggagaccagcatcaagtgggtaatgagagtacggaacacggcacaaccgcgactattacaccccaggcccctagcacagagatccagttaaccgactacggggcactgactctcgattgttctccaaggacaggacttgactttaacgaaatggtcctgttgacgatgaaggagaaatcctggctagtgcataagcagtggttcctggatctcccgctgccctggacctcaggcgctagcacaagtcaagagacatggaatcggaaagaccttctggtaacctttaagacagcccacgctaagaaacaggaagttgtggtcttgggttctcaggagggggccatgcacactgcactcaccggcgccacggaaattcaaacctccggaacaactaccatcttcgctggccatctgaagtgccgtttaaaaatggataagctgacactaaaagggatgagctatgtgatgtgtactggatcgttcaagctcgagaaggaagtcgcggagacccagcacggtacggtgctggttcagatcaaatacgagggcacagacgcaccttgcaagattccattttctacccaggatgaaaaaggggtgactcaaaacggacgccttataacagccaatcccatcgtaaccgacaaggagaaacctgtcaacattgaagctgagccacccttcggcgagtcctatatcgtgataggtgccggggaaaaggcattgaagctgtcatggtttaaaaagggcagtagcattggaaaaatgttcgaggccactgctagaggcgccaggcggatggcaatcctcggggataccgcgtgggactttggatccatcggtggcgttttcacatctgtggggaagctggtccatcagatttttggaacggcttacggcgtgcttttcagcggtgtatcatggaccatgaaaatcgggattggcgtgctgttgacttggctcggactgaatagtcgatccactagcttatctatgacctgtatagccgttggcctggtcacactatacctcggggtgatggtgcaggcagattcaggatgcgtcatcaactggaagggccgcgaactgaagtgtggtagtgggatttttgttactaatgaggtgcacacctggacggaacagtataaattccaagccgacagcccgaagagactttccgctgccatcggaaaagcatgggaggagggcgtgtgcggtatcaggtctgctacacggttggaaaacattatgtggaagcagatatcgaacgagctgaatcatatcctcctggaaaacgacatgaaatttaccgtagtcgtgggcgatgttgccgggattttagcgcagggaaagaaaatgatccgccctcagcccatggagtacaagtatagctggaagtcctggggcaaagccaagattatcggggctgacgtgcaaaatactaccttcataatcgatggaccaaacacacctgaatgtcccgacgatcagagagcatggaatatttgggaggtcgaggactacggctttggtatcttcactaccaacatttggctgaaacttagggattcatatacacaggtgtgcgaccaccgtttgatgagtgccgctatcaaggattctaaagccgttcacgcagacatggggtactggatagaaagcgagaagaatgaaacgtggaagctcgcgcgggcctccttcattgaggtgaaaacctgtatctggccaaagtcacatactctgtggagcaacggagtactagaatctgagatgattatccccaaaatatatggcggtcctatctcccagcacaattaccgaccaggctactttacacaaaccgctgggccgtggcatctgggaaagctcgagctggatttcgacctttgcgaaggcactacagtcgtggtggatgagcactgcgggaacagaggacccagtttgaggaccacgactgtcaccggcaaaattatccacgaatggtgttgccgcagctgtacactgcctccattacggtttaagggtgaggacgggtgctggtatggaatggagattagacccgttaaggaaaaagaggaaaatctcgtgaagtctatggtatccgccggctcaggtgaggtggacagtttcagcctgggccttctgtgtatctcgataatgattgaagaggtcatgaggtcccgctggtctcgaaaaatgttgatgaccgggactctcgcagtgtttttcctgctaatcatgggacagctgacatggaacgatctcatccggctgtgcattatggttggcgctaatgccagcgaccgtatggggatgggaaccacataccttgcattgatggccacttttaagatgagacctatgttcgctgtgggcctgttatttaggcgcctcacctcacgggaggtcctgcttctgacgatcggtctaagtctcgtggcgtccgttgaactgccaaactctttggaggaactgggggatggattagccatgggcattatgatactcaaactgcttacagacttccagagccatcaactgtgggcaaccttgctctccctgacttttatcaagaccacattctcactacactatgcttggaagactatggccatggtgctgagcattgtcagtctttttcccctctgtctgtctaccacgtcccagaaaacaacctggttgccggtactgttaggcagcctcgggtgcaagcctctgactatgttcttcatcgccgagaataaaatttggggaagaaagtcgtggccacttaacgaaggtatcatggctgtgggcatagtttcaatcctgttgtctagtctcctgaaaaacgatgtgcccctagcagggcctctgattgccggaggcatgcttatcgcgtgttacgtcatttccggtagctctgctgacctcagcctggagaaggccgcagaggtgtcctgggaagaggaagccgagcattcaggggctagtcacaatatcttggtagaagtgcaggatgacggaacaatgaaaataaaggatgaggagagggacgataccttaactattctgctcaaggcaacactgcttgccgtcagcggcgtttatcccctgtctatcccagcgaccttgtttgtgtggtacttctggcagaaaaagaaacaacgatccggcgtgctatgggacacgccttcacccccagaagtcgagcgcgctgtgctggatgacgggatctatcggattatgcagagaggactcctgggtaggagtcaggttggcgtaggggtgtttcaggaaaacgtcttccatactatgtggcacgtgacccgtggagccgttcttatgtaccaaggcaagcgcttagagccgagctgggcatccgtgaaaaaggacctgatatcttacggtgggggatggcggctccagggctcgtggaatacaggcgaggaagtccaggtgatcgccgtagagcctgggaagaaccccaaaaatgtccagaccgctccaggaacatttaagactagcgaaggtgaggtgggcgccattgcattggatttcaaacccgggacctcaggatcccctatcgttaacagagaaggcaagattgtgggtctgtatgggaatggagtcgtgacgacaagtggcacttacgtttctgctatcgcccaagcgaaagccagccaggagggcccactccccgagatagaagacgaggtgtttaggaagcgaaacctgaccatcatggatcttcaccctgggtccggaaagacacggcgctatctgccggcaattgtcagagaagctatcaaaaggaagttgcggaccctaattctggccccaactcgagtggtagcttcagagatggcagaagccctcaaaggtatgcccatcagataccagaccacagccgtgaagtctgagcatacgggcaaagagatagttgacttaatgtgccacgctactttcaccatgcgcctgcttagccctgtcagggtgccaaattataacatgattatcatggatgaagcgcattttacagaccccagttccatcgcagcccgtgggtacattagcacccgggtgggaatgggcgaggctgccgcaatcttcatgactgccacacctccgggttctgtcgaggcttttccccaatcaaatgcggtaatacaggatgaggaaagagacattccagagaggtcctggaacagtgggtatgagtggatcaccgatttccctggaaagacggtgtggttcgttcccagcattaagtcgggcaatgacatcgccaactgtctgcgcaaaaatggcaagcgagtgatacagctctctagaaaaacttttgatacagaataccagaagaccaaaaacaacgactgggactacgtcgtgaccactgatatttccgagatgggggcaaatttccgggctgacagggttatcgatccacgccgttgcttgaagcctgtgatcctgaaggacggacccgaaagagtcattctcgccggtccaatgccggtgacagtagcaagcgccgctcaacggaggggccgcatcgggcgaaaccacaataaagagggagatcagtatatttacatgggccagcctctgaacaatgacgaggatcatgcccactggaccgaagcgaagatgcttctagacaacataaatacacccgagggtatcattccagcactgtttgaacccgagagagaaaaatcagccgctatcgatggggagtatcggttgaggggcgaggcccgcaagactttcgtggaattaatgagaaggggagacctgcctgtttggctcagttacaaagtcgcttctgagggctttcagtattccgatcggcgttggtgcttcgacggggaacgcaacaatcaagtgctggaggaaaacatggatgtggagatctggacgaaggagggagaacgaaagaaacttagaccaaggtggctggacgcacggacctacagcgaccccctcgccttgcgcgagtttaaagagttcgctgccggtagaaggtcagtcagtggcgatctgattctagagatagggaaactgcctcagcacctcacacagcgggcacagaatgcgcttgacaacctggttatgttacataatagcgaacaaggaggccgagcctatagacacgctatggaggagttgccggatactatcgaaaccctgatgctcctggcccttattgcagtgctgacaggtggggtaaccctctttttcttgtccggccgcggactgggcaagacttctatcgggttactatgtgtgatggctagctccgccctgctctggatggcatcagtcgagccacattggattgccgcttctatcatacttgaatttttcctgatggtgttgctgatccccgagcctgacaggcagcggacgccccaggataaccagctcgcgtacgttgtgattggactgctttttatgatcctcaccgtcgccgcaaatgagatgggtctgttggaaacaactaaaaaggacctgggcattgggcacgtagctgtggagaaccaccatcacgccgccatgttagatgttgacctacatccagcaagtgcttggaccctgtacgccgtggcgacaaccatcataactcctatgatgcgtcacacaattgaaaacacgaccgctaatatctcgctcactgccattgcaaaccaagccgctatccttatgggactggataaaggctggcccataagcaagatggacatcggtgtcccattgctggcactcgggtgctattcccaggtgaatcctctgacacttaccgccgcggtcttaatgctggtggctcattacgccattatcggcccgggactccaggcaaaggccaccagagaggctcagaagaggacagccgcaggcattatgaagaaccccactgttgatgggatcgtggctatagacttggatccagtagtgtatgacgccaaattcgaaaagcagctgggacagattatgctactgatcctctgtacgtctcagatccttctgatgcgcaccacatgggcgttgtgcgagtcaattactctggccaccggccctctcacaaccctgtgggagggtagccccgggaaattctggaatactacgatcgcagtctccatggctaacatatttcggggaagttacttagccggcgcaggtcttgctttctctctgatgaaaagcctcggcgggggacgaagaggcacaggggcccaaggagaaaccctaggcgagaagtggaaaaggcagctgaatcagttgtcaaagtccgaatttaacacttataaacgcagtggtattatggaggttgaccggagcgaagccaaggaggggctgaaaagaggagagaccacaaagcacgcggtgtctcgtggcactgctaagctcaggtggttcgtcgaacggaatcttgtgaaaccagagggtaaggtaatcgatctgggctgtgggcgcggaggctggtcctactattgcgcagggttgaaaaaggtgaccgaagttaaaggatacacaaagggcggtcctgggcacgaggaacccattccgatggccacgtacggatggaacctggtgaaactccattcaggcaaggacgtctttttcatcccacctgagaagtgtgataccttactgtgcgacataggcgagagctcgcccaatccaactatcgaagaggggcgaacacttagagtgctgaaaatggtcgaaccctggctaaggggaaaccagttttgtattaagatcctcaatccttatatgccgtctgtggttgagaccctggagcaaatgcagcggaaacacggtggcatgttggtacgcaaccccctgagtagaaattccactcatgaaatgtactgggtgagctgcgggacaggaaacattgtctcagctgtgaatatgacctccaggatgctccttaaccgattcacgatggcccaccggaagccaacctatgagcgtgatgttgacctgggcgcaggtacaagacacgtggccgtcgaacctgaggtggctaacttagatatcattgggcagcgcatcgaaaatataaaacatgagcacaagtctacttggcattacgacgaggataacccctataagacctgggcgtaccacggaagctatgaagtaaaacctagtggctccgccagctctatggtgaatggcgttgtcaagctgttgacaaaaccatgggacgtgattcccatggtgactcagatcgcaatgaccgatacaaccccttttgggcaacagagggtcttcaaggagaaagttgacactcggacgccaaaggctaagagaggaacagcccagatcatggaagtgaccgcaaaatggctctggggttttctgtcacgcaacaagaaacccaggatttgtactcgagaggagttcacccggaaggtaagaagtaatgccgctataggcgccgtgtttgtcgacgagaaccaatggaactccgcgaaagaggcagtggaagatgagaggttctgggacctagttcatcgcgaacgtgagcttcacaagcaggggaagtgcgccacatgcgtgtacaacatgatgggaaaacgggaaaagaaactgggcgagttcggtaaggctaaagggagcagagccatctggtacatgtggctcggagcaaggtttctggagttcgaggctttgggctttatgaatgaggatcactggttctctcgcgaaaactcgctgtcaggcgtcgagggggagggactccataaacttggttatattctgcgagacatcagcaaaattccgggcgggaatatgtacgccgatgacacggctggatgggatacccggatcactgaagacgatttacagaacgaggccaagataacagacatcatggaacctgagcacgcactgttggcgaagtccatttttaaactcacctatcagaataaggtggtaagagttcaaaggccagccaaaaacggcactgtgatggatgtcatcagtcgcagagaccagcggggttctggacaggtgggaacatacggcctgaataccttcacaaacatggaagctcagctaattaggcaaatggagagcgagggcatcttttccccctcagaacttgagactcctaacctggccgggcgtgtgctcgattggctggaaaagcatggagtcgagcgattgaaacgcatggcaataagtggtgacgactgtgttgtgaagccaattgatgacagattcgctaccgccttaacggcactgaatgatatgggcaaggtacggaaagacatcccccagtgggaaccgtctaaggggtggaacgattggcaacaggtgcctttttgcagccaccacttccatcaactcatcatgaaagacggaagggagattgtcgtgccctgtcgcaatcaggatgagcttgttggcagagcccgggtgtcccagggtgcggggtggtcactgagggaaaccgcttgcctaggaaagagctatgcccagatgtggcaactgatgtactttcaccgacgtgacctcagattggcagccaacgctatatgttctgccgtcccagtggattgggtacctacatcccgcactacctggagtatccatgcacaccatcagtggatgacaactgaggacatgctgagcgtttggaatcgggtgtggattgaagagaacccctggatggaagataaaacccacatctcgtcctggggcgacgtcccatatcttggcaagagggaggaccagtggtgcgggtctctgattggactcacggctagagccacatgggcgaccaatatccaagtggctataaaccaggttcgccggttaatcggtaatgagaactacctggattacatgacttcaatgaagaggttcaaaaatgaaagcgaccccgagggcgccttgtggtga

SEQ ID NO: 14017 - RNA, 9879 nt, synthetic construct
  misc_feature 1..9879: note = derived and/or modified CDS sequence (opt3) from DENV-1__EU482816__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgagatgggtttgctggaaacaactaaaaaggacttaggcatcgggcacgtggccgttgagaaccaccatcacgcagctatgctagatgtggacctgcatccagccagtgcctggaccctctacgcagtcgctacaaccataattactcctatgatgcgtcacacaatcgaaaacacgaccgccaatatttcgcttactgcgatcgctaaccaagccgcaatactgatgggattggataaaggctggcccatcagcaagatggacattggtgtgccactgctcgccctggggtgctattcccaggtcaatcctcttacattaaccgctgcagtgctgatgctcgttgcccattacgcgatcattggcccgggattgcaggctaaggccaccagagaggcacagaagaggacagccgctggcatcatgaagaaccccactgtggatgggatagtagccattgacctggatccagtggtctatgacgcaaaatttgaaaagcagctaggacagatcatgctgctcatcctttgtacgtctcagattctgttgatgcgcaccacatgggctctgtgcgagtcaatcactctcgccaccggccctctgacaaccttatgggagggtagccccgggaaattctggaatactacgatagcggtttccatggccaacattttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtatcatggaggtggaccggagcgaagctaaggaggggctcaaaagaggagagaccacaaagcacgccgtctctcgtggcactgccaaacttaggtggtttgtggaacggaatctggtaaaaccagagggtaaggtgattgatttgggctgtgggcgcggaggctggtcctactattgcgcggggctgaaaaaggttaccgaagtgaaaggatacacaaagggcggtcctgggcacgaggaacccatcccgatggctacgtacggatggaacctcgtcaaattacattcaggcaaggacgtgttctttaccccacctgagaagtgtgatactctgctttgcgacataggcgagagctcgcccaatccaacaatcgaagaggggcgaaccctgagagtcctaaaaatggtggaaccctggctcaggggaaaccagttctgtattaagatcctgaatccttatatgccgtctgttgtagagactttggagcaaatgcagcggaaacacggtggcatgctggtgcgcaaccccctcagtagaaattccacacatgaaatgtactgggtcagctgcgggaccggaaacattgtgtcagcagttaatatgacgtccaggatgcttctgaaccgatttaccatggcccaccggaagccaacatatgagcgtgatgtggacttaggcgctggtactagacacgtcgccgtggaacctgaggtagcaaacctggatatcattgggcagcgcatcgaaaatataaaacatgagcacaagtctacctggcattacgacgaggataacccctataagacatgggcctaccacggaagctatgaagtgaaacctagtggctccgctagctctatggttaatggcgtcgtgaagttgctcactaaaccatgggacgtgattcccatggtcacccagatcgcgatgacagataccactcctttcgggcaacagagggtttttaaggagaaagtggacacgcggacaccaaaggccaagagaggaaccgcacagatcatggaagtaactgctaaatggctgtggggtttcctatcacgcaacaagaaacccaggatttgtacccgagaggaatttacacggaaggtgagaagtaatgccgcaataggcgccgtcttcgtggacgagaaccaatggaactccgctaaagaggccgttgaagatgagaggttttgggaccttgtgcatcgcgaacgtgagctgcacaagcaggggaagtgcgcgacgtgcgtctacaacatgatgggaaaacgggaaaagaaactcggcgagttcggtaaggcaaaagggagcagagccatctggtacatgtggctgggagctaggttcttggagtttgaagccctgggcttcatgaatgaggatcactggttttctcgcgaaaactcgctctcaggcgtggagggggagggacttcataagctgggttatattttacgagacatcagcaaaattccgggcgggaatatgtacgcagatgacaccgctggatgggatactcggatcacagaagacgatctgcagaacgaggccaagataaccgacatcatggaacctgagcacgctttgctcgccaagtccattttcaaactgacttatcagaataaggtagttagagtgcaaaggccagccaagaacggcacagtcatggatgtgatcagtcgcagagaccagcggggttctggacaggtgggaacctacggcctaaatacatttactaacatggaagcgcagcttattaggcaaatggagagcgagggcatcttctccccctcagaactggagacccctaacctcgccgggcgtgtcctggattggttggaaaagcatggagttgagcgattaaaacgcatggctataagtggtgacgactgtgtggtaaagccaattgatgacagatttgccacggcactgaccgctctcaatgatatgggcaaggtgcggaaagacatcccccagtgggaaccgtctaaggggtggaacgattggcagcaggtccctttctgcagccaccactttcatcaacttatcatgaaagacggaagggagattgtggttccctgtcgcaatcaggatgagctggtgggcagagcccgggtctcccagggtgcagggtggtcactaagggaaacagcctgcctgggaaagagctatgcgcagatgtggcaactcatgtacttccaccgacgtgacttgagactggctgccaacgcaatatgttctgccgtgccagtagattgggttcctacttcccgcaccacatggagtatccatgctcaccatcagtggatgactaccgaggacatgcttagcgtgtggaatcgggtctggattgaagagaacccctggatggaagataaaacgcacatctcgtcctggggcgacgtgccatatctgggcaagagggaggaccagtggtgcgggtctctcattggattaacagccagagcaacctgggctactaatatccaagttgccataaaccaggtgcgccggctgatcggtaatgagaactacttggattacatgacatcaatgaagaggtttaaaaatgaaagcgaccccgagggcgcgctgtggtga

SEQ ID NO: 14018 - RNA, 9879 nt, synthetic construct
  misc_feature 1..9879: note = derived and/or modified CDS sequence (opt3) from DENV-1__EU482821__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaacatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaaacagagattttgtggagggtcttagcggcgccacatgggtagacgttgtgttggagcacgggagttgtgtcaccactatggcgaaggataaacccacactggacatcgaactactcaagaccgaggtgacgaatcctgcagtgctgaggaaactttgcattgaagccaagatctccaacaccacaactgattctcggtgtccaacccaaggagaggctacactggtcgaggaacaagacgccaatttcgtttgccgccgaacttttgtggatagaggctggggtaacgggtgtggattgttcggcaaaggcagcctcataacctgcgcaaagtttaagtgcgtaacaaaactggaggggaagattgtgcagtacgaaaatttaaaatattccgtcatcgtgaccgttcacactggagaccagcatcaagtgggtaacgagtcaacggaacacggcacaaccgctactattacaccccaagcccctaccaccgagatccagctgactgactacggggcgctcacacttgattgtagtccaaggacgggactggacttcaatgaaatggtcttgctaaccatgaaggagaaaagctggctggtgcataagcagtggtttctcgatctgccgcttccctggacttctggcgcctccacatcacaagagacctggaaccggcaggacctgttggtaacattcaaaactgcacacgctaagaagcaggaagttgtggtcctcggtagccaagagggggccatgcacaccgctctgacgggcgccaccgaaatccagacaagtggaactaccacaatttttgcaggccatttaaaatgccgtctgaagatggataaactaactctcaaggggatgtcttatgtgatgtgtaccggatccttcaaactggagaaggaagtcgccgagacgcagcacggtacagtgcttgttcagataaagtacgagggcaccgacgctccttgcaaaatcccattcagcactcaagatgaaaagggggtgacacagaatggacgcttgattaccgcgaaccccatcgtaactgacaaagagaagcctgtcaatatagaagcagagccaccctttggcgagtcgtatattgtgatcggtgccggggaaaaagctctgaagctctcttggttcaagaaaggctcctcaatcggaaagatgtttgaggccaccgcaagaggcgccaggcggatggctattctgggggatacagcctgggacttcggaagtatcggtggcgtttttacgagcgtggggaaacttgtccatcagattttcggaaccgcatacggcgtgctgttttccggtgtatcttggactatgaagatagggatcggcgtgttgctcacatggctgggattaaacagccgatcaaccagtctgtccatgacatgtattgcggttggcctagtcactctctacctgggggtgatggtgcaggctgatagcggatgcgtcatcaattggaaaggccgcgaacttaagtgtggttctgggatcttcgttaccaacgaggtgcacacgtggacagaacaatataagtttcaggccgactcaccgaaaagattgagtgcagccattggaaaggcttgggaggagggcgtgtgcggtataaggagcgccacccggctggaaaacatcatgtggaaacagatttccaatgagctcaaccatatcctgttagaaaatgacatgaagttcactgtagtcgtgggcgatgttgcagggattctggctcagggcaaaaagatgatccgccctcaacccatggagtacaaatattcttggaagtcgtggggcaaggccaaaataatcggggcggacgtgcagaacaccacatttattatcgatggaccaaatactcctgaatgtcccgacgatcagagagcctggaacatttgggaggtcgaggactacggcttcggtatctttaccacaaatatatggcttaagttgagggatagctatacacaggtgtgcgaccaccgtctcatgtccgctgcaattaaagattcaaaggccgttcacgctgacatggggtactggatcgaaagtgagaaaaacgaaacctggaagctggcccgggcatctttcattgaggtgaagacttgtatctggccaaaaagccatacactatggtccaatggagtactggaatcagagatgataatccccaagatttatggcggtcctatcagccaacacaactaccgaccaggctacttcacccagactgcggggccgtggcatctcggaaaactggagcttgattttgacttgtgcgaaggcacaaccgtcgtggtggatgagcactgcgggaatagaggaccctctctgaggacgactaccgtcacaggcaagattatccacgaatggtgttgccgctcctgtaccttacctccactccggttcagaggtgaggacgggtgctggtatggaatggagataaggcccgttaaagaaaaggaggaaaacctggtgaagagtatggtaagcgccggctctggtgaggtggactccttttcacttggcctgttgtgtattagtatcatgatcgaagaggtcatgcgcagccgatggtcgcggaaaatgctcatgactgggacactggctgtgttctttctactgattatgggacagctcacctggaatgatctgatccgtctttgcattatggttggcgccaacgcatccgacagaatggggatgggaacaacttacttggctctgatggccaccttcaagatgaggcctatgtttgcagtgggcttactcttccgccggctgacgtctagagaggtccttctgctaacaataggtctcagcctggtggcctcagttgaattgccaaatagtctggaggaattaggggatggactcgctatgggcatcatgattctgaaacttctgaccgactttcaatcccatcagttgtgggcgactctcctgtctctaaccttcatcaagacaacttttagcctgcactatgcctggaaaaccatggcaatggtgctttccattgtctcactcttccccctgtgtttgagcacgacaagtcagaagaccacttggctgccggtattactcggctctctggggtgcaagcctcttacaatgtttctgatcgctgagaacaaaatatggggaaggcgatcctggccattgaacgaaggtatcatggccgtgggcattgttagcatcctcctgtcgtcactactgaagaatgatgtgccccttgccgggcctctcattgctggaggcatgctgatcgcatgttacgtcatatctggtagttccgccgacttgagcttagagaaagcggctgaggtgtcttgggaagaggaagccgagcatagcggggcatcccacaacattctggtagaagtgcaggatgacggaaccatgaagatcaaagatgaggagcgcgacgatactctcacaatcctgcttaaggccaccctgttggctgtctcaggcgtttatcccctaagtattccagcaacgctgttcgtgtggtacttctggcagaaaaagaagcagcggagcggcgtgctctgggacactccttctcccccagaagtcgggagagccgtgctggatgacggaatatataggatcatgcagcgtggtcttttaggccgctcccaggttggggtaggagtgtttcaagagaatgtcttccataccatgtggcacgtgacacggggcgcggttctgatgtaccagggtaaaagactcgaaccgtcatgggctagtgtgaagaaagacttgattagctacgggggaggctggaggctgcagggctcctggaacaccggggaggaggtccaggtgatcgccgtagaacctggaaagaatcccaaaaacgtccaaacagcaccaggtacttttaagacccccgagggcgaagtgggggccattgctctcgatttcaagcctggaacgtctggctcgccaatcgttaatcgagagggtaaaatagtggggctgtatggaaacggcgtcgtgacaactagcggcacctacgtttcagccatcgcacaggctaaggcctcccaggaagggccccttcctgagattgaggacgaagtgtttcggaaacgcaatctgacaatcatggatttgcacccgggaagtggtaagaccagaaggtatctaccagcgattgtccgggaggccatcaaacgaaagctgagaactctcatattagcacccacccgcgtggtagcttctgaaatggccgaggctctgaagggcatgcctattaggtaccaaacaacggcagtgaaaagcgaacatactgggaaggagatcgttgaccttatgtgccacgccaccttcacaatgcgtctgctctccccagtccgggtgcccaactataatatgatcattatggatgaggcccattttaccgacccttcatctatcgctgcgagaggatacataagcactagggtgggcatgggtgaagcagccgctattttcatgacagccaccccgcccgggagtgtcgaggcatttccacagtccaacgccgtaatccaggatgaggaacgcgacattcctgaacgaagctggaactctggatatgagtggatcacggatttccccggcaaaactgtgtggtttgttccatcaataaagtccggcaacgacattgctaattgtttgaggaaaaatgggaagcgggtgatccagctgagtaggaagacattcgataccgagtaccagaaaaccaagaacaatgactgggactacgtcgtgactacagatatcagcgaaatgggagcgaacttccgcgccgaccgtgttattgatcctagacggtgcctcaaacccgtgatcctgaaggacggtccagagagggtcattcttgcaggcccgatgcctgtgaccgtagcttcggccgcacagcgccgagggagaataggacggaatcacaacaaagaaggcgatcagtatatctacatgggtcagcccctaaataacgacgaggatcatgcccactggacagaggctaagatgctgttggacaatattaacactccagaagggatcatccccgccttatttgagcctgaaagggagaagtctgcggcaattgatggcgaatatcgcctgagaggagaggccaggaaaacgttcgtggagctcatgcggcgtggcgacctgccagtttggctttcctacaaggtcgctagcgaagggtttcaatattcagatcgccgatggtgcttcgacggagagagaaataaccaggtgctggaagagaatatggatgtggaaatatggaccaaagagggtgagaggaagaaactccggccccgctggttggacgccagaacatacagtgaccctctggctctaagggaatttaaggagttcgcagccggccggcgatctgtctccggggatctgatcctcgaaattggaaaacttccgcagcacctgactcagagagctcaaaacgccttagacaatttggttatgctgcataacagcgagcagggcggtcgcgcatataggcacgcgatggaggaactcccagataccatcgagacactgatgcttctggccctcattgctgtgttgaccgggggcgtaactctgtttttcttatcaggacggggcctagggaagacgagtatcggactgctctgtgtgatggccagctccgtccttctgtggatggcatctgtggaaccccattggatagctgccagcatcattttggagtttttcctgatggttctcctgatccctgaacccgaccgtcagagaaccccacaggataatcaacttgcatacgtggtcattggtctcctgtttatgatcttgacagtagccgctaacgagatgggcctgttagagactaccaagaaagacctagggataggacacgtggcggttgaaaaccaccatcacgccgcaatgctggatgtggacctccatcctgcttccgcctggacactttacgccgtcgcaaccactattatcacacccatgatgaggcacacgattgagaataccactgctaacatctcactgacagccatagcgaatcaggctgccatcttgatgggcctggataagggttggccaatttctaaaatggacatcggggtgcctctcctggcacttggctgctatagtcaggtcaacccgttaaccctgaccgccgctgtgctcatgttggttgcacattacgccattatcggacccggcctgcaagcgaaggctacacgcgaagcccagaaacggactgcagccgggataatgaagaatccaacggtggatggaattgtagctatcgacctagatcctgtggtctatgacgccaagttcgagaaacagctgggccagatcatgctccttattctgtgtacctcgcaaatcttgctgatgcgaacaacttgggcactctgcgaaagcataaccctggctacaggtcccttaaccactctttgggaggggtccccaggaaagttttggaacacgacaattgccgtttctatggcgaatatcttcagaggctcatacctggccggtgcaggcctcgctttcagcctaatgaaatccctagggggaggcaggcgcgggaccggagcccagggcgagactttgggtgaaaagtggaaacggcagctgaaccagctcagtaagtctgagtttaatacctataagagaagcgggattatggaagtggaccgttcagaggcaaaagaaggacttaagaggggcgagacaactaaacacgctgtctcccggggtaccgccaagctgcgctggttcgtggagcgaaacttggtaaaacctgaaggcaaggtgatcgatctggggtgtggaagaggcgggtggagttactattgcgccggactcaagaaagttacagaggtgaagggctacacgaaaggtgggcccggacacgaggagccgataccaatggcgacctacggctggaatttagtcaagctgcatagcggcaaagacgtgtttttcatccctcccgaaaagtgtgatactcttctgtgcgacattggggagtcttccccaaaccccacaatcgaggaaggaaggaccctacgggtcctcaaaatggtggagccttggctgcgcggtaatcaattttgtattaagatcttgaacccgtatatgccctcagttgtagaaactctggagcagatgcagagaaagcacggcgggatgctcgtgaggaatccacttagccgaaactcgacacatgagatgtactgggtctcttgcggaaccggcaatattgtgagtgctgttaacatgacgtcccggatgctgttaaaccgtttcaccatggcacacagaaaacctacatatgaacgcgatgtggacctgggtgccgggactaggcacgtcgctgtggagcccgaagtagccaatttggatatcataggacagcggattgagaacatcaagcatgaacacaaaagcacctggcattacgacgaggataatccttataagacatgggcataccacggctcatatgaggtgaaaccatccggctctgccagcagtatggttaacggggtcgtgaagctcctgactaagccctgggacgtgatccctatggtcacccaaattgctatgacagataccactccatttggacagcagagagttttcaaagaaaaggtggacacgcgcacacccaaagcgaagaggggtaccgcccaaataatggaggtaactgcaaaatggctatggggctttctttcccgaaataagaagccgcggatctgtaccagagaagagttcacaaggaaagtgcgcagcaacgctgccattggggcagtctttgtggacgaaaatcagtggaactctgccaaggaggctgttgaggatgaacgtttctgggacctggtgcatcgggagagagaactccacaaacagggaaagtgcgccacgtgcgtctacaatatgatgggcaaaagggagaagaagctgggtgaatttgggaaagcgaagggatcacgcgcaatctggtacatgtggttgggcgcccgattcctggagttcgaggctctcggctttatgaacgaagatcactggttcagtcgggaaaattcccttagcggggtggaaggagagggtctgcataaattaggctatattctgagagacatctctaacatacctgggggaaatatgtacgccgatgacaccgcaggctgggatactaggatcacagaggacgatttgcagaacgaagctcgcattaccgacatcatggagccagaacacgccctcctggctaagtcgatttttaaactaacttatcaaaataaggtagttagagtgcagcggcccgccaaaaacggtacagtcatggatgtgatctcaaggcgtgaccagcgagggagcggacaggtgggcacctacggccttaacacattcactaatatggaggcacaactgatacgccagatggaatccgaggggatttttagtccttctgagctcgaaaccccaaacctggcggagagagtcttggattggttagaaaagtatggagttgagcggctgaagaggatggccatcagcggtgacgactgtgtggtaaaacccatcgatgaccgcttcgctacggccctcaccgcacttaatgatatgggcaaggtgagaaaagacattccgcagtgggaaccttccaaggggtggaacgattggcagcaagtccccttttgctcacatcacttccaccagctgataatgaaagacggacgggagatcgtggttccatgtaggaatcaggatgagctagtgggccgagctcgtgtcagtcagggtgccgggtggtctctgagagaaacagcatgcctcggaaagagctacgcccaaatgtggcagttgatgtattttcatcgccgggacctgaggcttgcggctaacgccatttgttccgcagtgcctgtagattggatccccacttcaagaaccacatggagcattcacgcccatcaccagtggatgactaccgaggacatgctgtctgtttggaatcgcgtgtggatcgaagagaacccatggatggaagataagacgcatatatccagttggggcgacgtcccctacctcggcaaacgggaggaccaatggtgcgggagcttaatcggactgacagctagggccacctgggcaactaatattcaggtggctatcaaccaggttcgaagattgattggtaatgagaactacctggattatatgacatcgatgaagcggttcaaaaatgaatccgaccctgagggcgccctctggtga

SEQ ID NO: 14019 - RNA, 9879 nt, synthetic construct
  misc_feature 1..9879: note = derived and/or modified CDS sequence (opt3) from DENV-1__EU482822__SS-prME
  source 1..9879: mol_type = other RNA
agcgtgaccatgctgctcatgcttatgcccaccgcactggctttccacttgactacgagaggaggggagcctcatatgatcgtcaccaagcaggaaaggggaaaatccttactgtttaagacatctgccggtgttaatatgtgcactttaattgccatggacctcggagagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccattctgaggaaactttgcatcgaagctaagatatccaataccacaactgattctcggtgtccaacccaaggagaggccacactgatggaagaacaagacgcaaacttcgtgtgccgccgaacttttgtcgatagaggctggggtaatgggtgtggattgttcggcaaaggcagcctcattacctgcgctaagtttaagtgcgttacaaaactggaggggaagatcgtgcagtacgaaaacttaaaatattccgtaattgtgaccgtccacactggagaccagcatcaagtgggtaatgagtcaacggaacacggcacaaccgccactatcacaccccaggcgcctacaagtgagatccagctgaccgactacggggccctcactcttgattgtagcccaaggacaggactggacttcaacgaaatggttttgctaacgatgaaggagaaatcttggctggtgcataagcagtggtttctcgatctgccgcttccctggacctccggcgcatcaactagccaagagacatggaatcggcaggacctgttggtcaccttcaaaacagctcacgccaagaagcaggaagtggtagttctcggtagtcaagagggggctatgcacactgccctgaccggcgcaacggaaattcagacctctggaacaactaccatatttgccggccatttaaaatgccgtctgaagatggataaactaacactcaaggggatgtcctatgtgatgtgtactggcagcttcaaactggagaaggaagtcgctgagacccagcacggtacggtgcttgtccagatcaagtacgagggcacagacgcgccttgcaaaattccattctcgacccaagatgaaaagggggtgactcagaacggacgcttgatcacagcaaatcccatagttaccgacaaagagaagcctgtgaacattgaagccgagccaccctttggcgagtcttatatcgtaatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtctttacatccatagggaaacttgtgcatcagatcttcggaacggcgtacggcgttctgttttctggtgtgagctggaccatgaagattgggatcggcgtcttgctcacttggctgggattaaattcacgaagtacatccctgagcatgacctgtatcgctgtgggcctagtaacactctacctgggggtgatggttcaggccgattctggatgcgtcattaactggaaaggccgcgaacttaagtgtggttcagggatattcgtgactaatgaggtgcacacctggacggaacaatataagtttcaggcagacagtccgaaaagattgagcgccgctatcggaaaggcctgggaggagggcgtctgcggtattaggtccgcaacacggctggaaaacatcatgtggaaacagatttctaacgagctcaatcatatcctgttagaaaacgacatgaagttcaccgttgtggtgggcgatgtagtcgggatactggctcagggcaagaagatgatccgccctcaacccatggagcacaaatactcgtggaaaagctggggcaaggccaaaattatcggggcggacgtgcagaatactacctttattatcgatggaccaaacacacctgaatgtcccgacgatcagagagcctggaatatatgggaggttgaggactatggcttcggtatttttactaccaacatctggcttaagatgagggattcctacacacaggtgtgcgaccaccgtttgatgtcagctgcaattaaagatagtaaggccgtccatgctgacatggggtattggatcgaatctgagaaaaatgaaacgtggaagctcgcccgggccagcttcatagaggtgaagacctgtatctggccaaaatcccacactctgtggtcaaacggagttctagaaagcgagatgattatccccaagatttacggcggtcctatctctcaacataattatcgaccaggctacttcacacagaccgcggggccgtggcacctgggaaaactcgagctggattttgacctttgcgaaggcactacagtggtagtcgatgagcactgcgggaacagaggaccctccttgaggaccacgactgtgaccggcaagataattcatgaatggtgttgccgcagttgtacactgcctccattacggttcaaaggtgaggacgggtgctggtacggaatggagatcagacccgtgaaggaaaaggaggaaaatctcgtcaaaagcatggtttctgccggctccggtgaggtggactcatttagtctgggccttctgtgtatcagcattatgatcgaagaggtaatgaggtcgcgctggtcccgaaagatgttgatgaccgggactctcgctgtgttcctgctactgattatgggacagctcacatggaacgatctgatacggctttgcatcatggtcggcgccaatgcatctgaccgtatggggatgggaaccacatatttggctctgatggccacttttaaaatgagacctatgttcgcagtgggcttactctttaggcgcctgaccagccgggaggttcttctgctaacgattggtctctcactggtggccagtgtcgaattgccaaactccctggaggaattaggggatggactcgctatgggcatcatgattctgaaacttctgacagacttccaatctcaccagttgtgggcgaccctcctgagcctaacttttatcaaaaccacactgtcccttcattacgcctggaagactatggcaatggtgctctcaatagttagcctgatccccttgtgtctgagtaccacgtctcagaagacaacctggttaccggtgctcctgggctcccttgggtgcaaacctctgactatgttcttgattgctgagaataagatctggggaagaaaaagctggccactcaacgaaggtattatggccgtcggcgtagtgtcgatcctgctatcatctctgcttaagaacgatgttcccctcgccgggcctctgatagctggaggcatgttgattgcatgttatgtgatcagtggttccagcgccgacttatctctggagaaagcggctgaggtcagctgggaagaggaagccgagcactccggggcatcacatagtatcctcgtggaagtacaggatgacggaacaatgaagattaaagatgaggagagggacgataccctgactatacttctgaaggccacattgctagctgtgagcggcgtctaccccctgtctatcccagcaaccctctttgtttggtatttctggcaaaagaaaaagcagcgatccggcgtgctgtgggacacgccttcacccccagaagtggagcgcgccgtccttgatgacgggatttaccggatcatgcagagaggattactgggtaggagtcaggtgggcgttggggtatttcaagaaaatgtgttccacactatgtggcacgtcacccgtggagcggtgctcatgtatcagggcaaacgcttggagccgagctgggcttccgttaagaaagacctgatttcttacggtgggggatggcggctccagggctcgtggaacacaggcgaggaagtgcaggtcatcgccgtggagcctgggaagaatcccaagaacgtacaaaccgcaccaggaacattcaaaactcccgaaggtgaggtcggcgccatagctctggattttaagcctgggaccagcggatcaccaatcgtgaatagagaaggcaaaattgttggtctttacgggaacggagtggtcacgacatccggcacttatgtgagtgccatcgcacaggctaaggcctctcaggagggccccctgcctgagattgaagacgaggttttcaggaaacgaaatttgaccatcatggatctacatccggggagcggaaagacacggcgctacctgccagcgatagtgagagaagccattaagaggaaactccggaccttaatcctggcacccactcgagtcgtggcttccgagatggccgaagctcttaagggtatgcctatcagatatcaaaccacagcagtaaaatcagagcacacgggcaaggagattgtggacctgatgtgccatgccacttttaccatgcgcctcttgtctccagttagggtccccaactacaatatgatcataatggatgaagcccacttcacagaccctagcagtattgctgcgcgtgggtatatctccacccgggtgggaatgggcgaggcagccgctatttttatgactgccacaccgcccggtagcgtggaagcattcccacagtctaacgccgtcatccaggatgaggaaagagacatacctgagaggtcatggaactccgggtacgagtggattaccgattttcccggaaaaacggtatggttcgtgccaagtatcaagagcggcaacgacatcgctaattgtctgcgcaagaacggcaaacgagttattcagctctcgagaaagacttttgatacagaatatcagaagaccaagaataacgactgggactacgtggtcaccactgatatctctgagatgggggcgaacttccgggccgacagggtgattgatcctcgccgttgcctgaaacccgttatacttaaggacggaccagaaagagtgatcctagcaggtccgatgcctgtcacagtggcttccgccgcacagcggaggggccgcattgggcgaaatcataacaaggagggagatcagtacatctatatgggccagcccctgaataacgacgaggatcacgcccactggaccgaagctaaaatgttgttagacaatatcaacacaccagagggtattatacccgccctgtttgaacctgagagagaaaagagcgcggcaatcgatggggagtaccggctcaggggcgaggcccgcaaaactttcgtagaactgatgagaaggggagaccttccagtgtggctgtcatataaggttgctagtgagggcttccaatactctgatcggcgttggtgctttgacggggaacgcaataaccaggtcctcgaggaaaatatggatgtggagatttggacgaaagagggagaacgaaagaaattgagacccaggtggctggacgcccggacctattccgaccctctagctctgcgcgagttcaaggaatttgcagccggtagaaggagcgtgtcaggcgatctcatccttgagattgggaagctgccgcagcatttaacacagcgggctcaaaacgccttggacaatctggtcatgctccacaacagtgaacagggaggccgagcatacagacatgcgatggaggagctgccagatactatcgaaacccttatgctgctcgccttgatagctgttctgacaggtggggtgaccttattctttctaagcggccgcggactgggcaaaacttccatcgggctcctttgtgtaatggcctctagcgtgctgttgtggatggcatccgtcgagccccactggattgctgcctcaatcattctggagttctttctcatggtgctgcttatccctgagcccgacaggcagcggacgccacaggataatcaactcgcatatgttgtgataggactgttgttcatgattctgaccgtcgccgctaacgagatgggtttactagaaacaactaagaaagacctgggcatcgggcacgtagcggtggagaatcatcaccatgccaccatgctcgatgttgaccttcaccctgcatctgcttggacactgtacgccgtggccaccactattatcacacccatgatgcgtcatacgatagaaaacaccactgcaaacatcagtttgacagctattgccaatcaggcggctatcctgatgggactcgataagggctggccaatttcgaaaatggacatcggtgtccctctgcttgccttagggtgctacagccaggtgaacccgctgaccctcaccgcagccgtcttgatgctggtggctcactatgcaataattggccccggactacaagccaaggcgacaagagaggctcagaagaggactgccgcaggcatcatgaaaaatccaacggttgatgggatcgtggccattgacctggatcctgtagtgtacgacgctaagtttgaaaaacagctcggacagatcatgcttctgatattgtgtacctcccaaattctgctcatgcgcacaacttgggccctgtgcgagtctatcaccttagcaacaggcccccttaccactctgtgggagggttcaccagggaagttctggaacacgacaattgctgtcagcatggccaatatctttcggggatcctatctcgcgggcgccggtctagcattcagtctgatgaaatctttgggcgggggacgaagaggcaccggggctcagggagaaactctgggcgagaagtggaagaggcagctcaaccagcttagcaaatcagaatttaatatatacaagcgctccggtatcatggaggttgaccggagtgaagccaaagaggggctgaagagaggagagaccacacgtcacgcagtgagcaggggcactgctaaattgcggtggttcgtcgaacgcaacctggtgaagcctgagggtaaggtaattgatctcggctgtgggcgaggaggctggtcttattactgcgccgggctaaagaaggtgaccgaagttaaaggatatacaaagggcggtcccgggcatgaggaaccgatcccaatggccacgtacggatggaatctggtgaaacttcactccggcaaggacgtcttctttacccctcccgagaaatgtgatactctgctatgcgacattggcgagtcaagcccaaaccccacaatcgaagaggggagaaccctcagggtgctgaagatggtcgaaccttggttgcggggaaatcaattctgtattaagatcctgaacccgtacatgccctcggtggttgagactctcgagcagatgcagcgcaaacatggtggcatgcttgtaagaaatccactgtctaggaacagtacacacgaaatgtattgggtgtcctgcgggaccggaaatatagtcagcgcggtgaacatgacgtcacgaatgttactgaatcggtttaccatggctcaccgtaagcctacatacgagaaagatgttgacttgggcgcaggtactagacatgtggccgtcgaacccgaggtggctaacctcgatattatcgggcagcgcatcgaaaacattaagcacgagcataaatccacctggcactatgacgaggataatccttacaagacatgggcctatcatggatcttacgaagtaaagccaagcggcagtgcatccagcatggtgaacggcgttgtcaaactgctaactaagccctgggacgtgatacctatggtgacccaaatcgccatgacagataccactccattcgggcagcagagggtctttaaagagaaggttgacacgcggacacccaaagctaagagaggaaccgtgcaaattatggaagtaactgcgcgctggctttggggtttcctgtctaggaataagaaaccgcgaatctgtacccgggaggaatttacaagaaaggtgaggtcaaacgccgcaattggcgctgtcttcgtggacgagaatcagtggaacagtgccaaagaggcagttgaagatgagcgcttttgggacctcgtgaagaaagaacgtgagctgcacaagcaggggaagtgcgccacgtgcgtctataatatgatgggaaaacgggaaaagaaattgggcgagttcggtaaggctaaagggtccagagccatctggtacatgtggctgggagcgaggtttctcgagttcgaagcacttggctttatgaacgaggatcactggttcagccgcgaaaattctctgtcgggcgtggagggggagggattacataagctgggttacatattgcgagacatctcaaaaattcctggcgggaacatgtatgccgatgacaccgctggatgggatactcggatcacagaagacgatctccagaatgaggccaagattaccgacatcatggaaccagagcacgcactgctagctactagcatattcaaacttacataccaaaacaaagtagttagagtgcagaggcccgccaagaatggcaccgtcatggatgtgatttcccgcagagaccagcggggtagtggacaggtgggaacatatggcctgaacacttttaccaatatggaagctcaactcatcaggcagatggagtctgagggcatcttcctgcctagcgaattggagacgccaaacttagccgaacgtgtcctggattggctcgagaaatacggggttgaacgacttaagcgcatggcaatttccggagacgactgtgtggtaaaacccatagatgacagatttgcgaccgccctgacagctctaaacgatatgggtaaggtgcggaaggacatcccgcagtgggagccttcaaaaggctggaatgattggcagcaagtccccttctgcagtcatcactttcaccagctgattatgaaggacgggagggagatcgtggttccatgtcgcaaccaggatgaactcgtggggagagcacgggtctctcagggcgcaggttggagcttgagggagactgcttgcctggggaaatcctatgcccaaatgtggcagcttatgtacttccatcgacgtgacctgagactcgcagccaatgcgatttgttcagctgtgcctgtagattgggttcccaccagccgcacaacttggtctatccacgcccatcaccagtggatgaccacggaagacatgttatccgtgtggaaccgggtctggatagaggaaaatccatggatggaggataagacacatgtgagtagctggggagacgttccctatctgggcaaaagggaggaccaatggtgcggctcgttgatcgggctgaccgcaagagccacttgggcttccaacattcaggtggccatcaatcaggtccgccggctcattggaaacgaaaattaccttgattacatgacatctatgaagaggtttaagaacgagggtgaccctgaaggcgcactgtggtga

SEQ ID NO: 14020 - RNA, 9879 nt, synthetic construct
  misc_feature 1..9879: note = derived and/or modified CDS sequence (opt3) from DENV-1__EU482476__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacggcatgaagttcaccgtggtagtcggggacgtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtaccagcattatgatcgaagaggtcatgaggtcgcgctggtcccgaaagatgctcatgactggaacactggctgtgttcctactgctcatcatgggccagctgacctggaacgaccttattcggttgtgcatcatggttggggccaatgcatctgatcgtatgggaatgggcacaacttatctggctttaatggccacctttaaaatgagacctatgttcgcagtgggtctcctgtttaggcgccttacgagccgggaggtcctgctactcacaattgggctgtcattggtggccagtgttgaactgccaaactccttagaggaactcggagacggcctggctatgggcataatgatccttaagctgttgaccgatttccaatctcaccagctctgggcgactctgctaagcctgacctttattaaaacaactctttccctccattacgcctggaagaccatggcaatggtgctgtcaatcgtcagcttgttccccctgtgtttaagtacgacatctcagaagaccacttggctcccggtactgcttgggtccctgggatgcaaacctttgacaatgtttctcattgctgagaataagatctggggtagaaaaagctggccactgaacgaaggcataatggccgtgggggttgtgtcgatcctactgtcatctcttctcaagaacgacgtccccctggccggacctttgattgctggcggtatgttaatcgcatgttatgtgattagtgggtccagcgccgatctgtctctcgagaaagcggctgaggtaagctgggaagaggaagccgagcactccggagcatcacataatatcctggtggaagtccaggacgatggcaccatgaagataaaagacgaggagagggatgacactcttacaattctgttgaaggccaccctactggctgttagtggcgtgtaccccctcagcatcccagcaacgctgttcgtgtggtatttttggcaaaagaaaaagcagcgatctggggtcctttgggatactccttcacccccagaagtggagcgcgccgttttagacgatggaatctaccggattatgcagagaggtctgctcggcaggagccaggtaggggtgggagtcttccaagaaaacgtgttccacaccatgtggcacgttacacgtggcgcggtgttgatgtatcagggtaaacgcctggagccgagttgggctagcgtcaagaaagacctcatatcctacgggggaggctggcggctgcagggctcttggaataccggggaggaagtgcaggtaatcgccgtcgagcctggaaagaaccccaagaatgtgcaaacagcaccaggtacttttaaaacccccgaaggcgaggttggggccattgctcttgacttcaagcctggaacgtcgggcagcccaatcgtgaacagagaaggtaaaattgtcgggctgtacggaaatggcgtggttacaacttcaggcacctatgtgtccgccatcgcacaggctaaggccagtcaggaggggcccttgcctgagatagaagatgaggtctttaggaaacgaaacctaacaatcatggacctgcatccgggatctggtaagacccggcgctacctcccagcgattgtgagagaagccatcaagaggaaattacggactctgattcttgcacccacccgagtagtggctagcgagatggccgaagctctgaagggcatgcctatcagatatcaaacaacggcagttaaatccgagcacactgggaaggagatagtcgatctcatgtgccatgccaccttcacaatgcgcttgctgtcaccagtgagggtgcccaattacaacatgattatcatggacgaagcccactttaccgatccttctagcatcgctgcgcgtggatatattagtactcgggtcggcatgggtgaggcagccgctatcttcatgacagccaccccgcccgggtccgtagaagcatttccacagagcaatgccgtgatacaggacgaggaaagagatattcctgagaggtcttggaactcaggatacgagtggatcacggacttccccggcaaaactgtttggtttgtgccatccattaagagtggcaatgatatcgctaactgtctccgcaagaatgggaaacgagtcatacagctgagcagaaagacattcgacaccgaatatcagaaaaccaagaacaacgattgggactacgtggttactacagacatttcggagatgggagcgaattttcgggccgatagggtgatcgaccctcgccgttgccttaaacccgtcatcctaaaggatggtccagaaagagtgattctggcaggcccgatgcctgtaaccgtggcttctgccgcacagcggagggggcgcatcggacgaaaccataataaggagggcgaccagtacatttatatgggtcagcccttgaacaatgatgaggaccacgcccactggacagaagctaaaatgttactggataacataaatactccagaggggatcattcccgccctcttcgaacctgagagagaaaagtccgcggcaatcgacggcgagtaccggctgaggggagaggcccgcaaaacgttcgttgaacttatgagaaggggcgatctgccagtctggctcagctataaggtggcttcagaggggtttcaatacagtgaccggcgttggtgcttcgatggagaacgcaacaatcaggtgttggaggaaaacatggacgtcgagatctggaccaaagagggtgaacgaaagaaactgagacccaggtggctagatgcccggacatattctgaccctctggctctccgcgagtttaaggagttcgcagccggcagaaggtccgttagcggggaccttattctggagataggaaagttaccgcagcatttgactcagcgggctcaaaatgccctggataacctcgtgatgctgcacaattcagaacagggcggtcgagcatacagacatgcgatggaggagcttccagacaccatcgaaacactgatgctcttggccctgattgctgtattaaccgggggcgtgactctatttttcctgagtggacgcggcctcgggaaaacgagcatcggacttctgtgtgtcatggcctcctctgtgttgctgtggatggcaagcgttgagccccactggattgctgcctccatcatactcgaatttttcctgatggtgcttctcatccctgagcccgataggcagcggaccccacaggacaaccaactggcatatgtcgtaattggtttgctgtttatgatcttaacagtggccgctaatgagatgggcctactggaaactaccaagaaagatctcgggattggacacgttgcggtggagaaccatcaccatgccacaatgcttgacgtcgatctgcaccctgcatcagcttggaccttgtacgccgtggccactacaatcataacgcccatgatgcgtcataccattgaaaacactacagcaaatatctctctgaccgctattgccaaccaggcggctatcctcatgggcctggacaagggttggccaataagtaaaatggatatcggggtccctcttttagccctgggctgctacagccaggtgaatccgctcaccttgacagcagccgttctgatgctagtggctcactatgcaattatcggacccggcctgcaagccaaggcgactagagaggctcagaagaggacggccgcagggattatgaaaaacccaaccgtagacggaatcgtggccatagatctcgaccctgtcgtttacgatgctaagttcgaaaaacagcttggccagattatgctgttgatcctgtgtacaagccaaatcctcctgatgcgcactacctgggccttatgcgagtccattacacttgcaaccggtcccctgactacgctctgggaggggtctccaggaaagttttggaatacaaccatcgctgtgtcaatggccaacatattccggggcagctatctagcgggtgccggcctggcattttccttgatgaaaagtctagggggaggccgaagagggactggagctcagggcgaaaccctcggtgagaagtggaagaggcagcttaatcagctgtctaaaagcgagttcaacatttacaagcgctcagggatcatggaggtcgaccggtccgaagccaaagagggattgaagagaggcgagacaactcgtcacgcagtgagtaggggtaccgctaaactgcggtggttcgtagaacgcaatctcgtgaagcctgagggcaaggttattgacttagggtgtggacgaggcgggtggagctattactgcgccggactgaaaaaggtgacagaagtcaaaggctatacgaagggtgggcccggacatgaggaaccgatcccaatggccacctacggctggaaccttgtgaaactgcactctggcaaggatgtctttttcactcctcccgagaaatgtgacacactactctgcgatataggggagtcctcaccaaatcccaccatcgaagagggaagaactctgagggtgttgaagatggttgaaccttggctgcggggtaaccaattttgtattaagatcctcaatccgtacatgcccagcgtagtggagacacttgagcagatgcagcgcaaacatggcgggatgctggtcagaaacccattatcgagaaattctacccacgaaatgtattgggtgagttgcggaacgggcaacattgtttccgcggtgaatatgaccagccgaatgctgttgaaccggttcacaatggctcaccgtaagcctacttacgagagagacgtcgatctcggtgcagggacccgccatgtggccgtagaacccgaggtggctaacctggacatcattggacagaggatcgaaaatataaaacacgagcataagtcaacatggcactatgatgaggacaacccttacaaaacttgggcctatcatggctcctacgaagttaagccatctggcagcgcaagttccatggtcaatggggtggtgaagctacttaccaaaccctgggatgtcattcctatggttacacaaatcgccatgaccgacactacgccatttggacagcagcgggtgttcaaggagaaagtagatacaagaacccccaaggctaaacgcggtactgcgcaaatcatggaagtgaccgccaggtggctgtggggctttctcagccgaaacaagaagccgcggatttgtacaagagaggagttcacgaggaaagtccgctctaatgcagctataggggccgtgtttgttgacgagaaccagtggaactcagcaaaggaggccgtggaagacgagcgtttctgggatctggtccagaaagaacgggagttgcacaagcagggaaaatgcgctacctgcgtgtataacatgatgggcaagagagaaaagaaactgggtgagtttgggaaggccaaaggaagtagggcgatctggtacatgtggctcggcgcacgcttccttgagtttgaagccctgggcttcatgaatgaggaccactggttctcccgagaaaacagcttatctggggtagagggagagggtctgcataagttgggctacattctccgggatatctcgaaaattcctgggggaaatatgtatgctgacgatactgccggctgggacacaagaatcaccgaagatgacctgcaaaacgaggcaaagataactgatatcatggaaccagagcacgctctacttgccacatcaatttttaaactgacctaccagaataaggttgtgagggtccagcgccccgctaagaacggtacagtgatggacgtgatcagcagacgggatcagagggggtccggacaagtcggcacttatggcctcaataccttcacgaacatggaagcccagctgattcgtcagatggagagtgaggggatctttttgccttctgaattagagaccccaaacctggcagaacgagttctcgactggcttgagaaatacggagtggaacgcctgaagagaatggcgataagcggtgatgactgtgtagtgaaacccattgacgatcggttcgccacagctctagccgcactgaatgacatgggcaaggtcaggaaagatatcccgcagtgggagccttccaaggggtggaacgactggcaacaggtgcccttttgctcacatcacttccaccagctcatcatgaaggatggacgcgagattgttgtgccatgtagaaatcaggacgaattggtcggccgggctagggtgagtcaaggtgccgggtggtctctgcgagagactgcatgccttggaaaaagctatgcccagatgtggcagctgatgtactttcatcgtagagatctccgcttagcggctaacgccatatgttccgcagtacctgttgactgggtgcccacctcacggacaacttggagcatccacgcccatcaccaatggatgaccacggaagatatgctgtctgtctggaatagggtgtggattgaggaaaacccatggatggaggacaagacacatgtttccagttggggcgatgtgccctatttgggcaaaagagaggaccagtggtgcgggagcctgatcggactcaccgctcgcgccacttgggcatcgaatattcaggtcgctatcaaccaggtgcggaggcttataggtaatgaaaactacctggactacatgacatccatgaagcgattcaaaaatgagggcgatcctgaaggggccctatggtga

SEQ ID NO: 14021 - RNA, 9879 nt, synthetic construct
  misc_feature 1..9879: note = derived and/or modified CDS sequence (opt3) from DENV-1__EU482477__SS-prME
  source 1..9879: mol_type = other RNA
agcgtgaccatgctgctcatgcttatgcccacagcactggctttccacttgactacgagaggaggggaacctcatatgatcgtctccaagcaggaaagggggaaatctttactgtttaagacctcagccggtgttaatatgtgcacactaattgccatggacctcggcgaactgtgtgaagatactatgacctacaaatgcccacggattacagaagcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctagcaccgagatccagctgacagactacggggccctcacccttgattgttctccaaggactggactggacttcaacgaaatggtcttgctaacaatgaaggagaaatcctggctggtgcataagcagtggtttctcgatctgccgcttccctggacgtcaggcgcaagcaccagtcaagagacttggaatcggcaggacctgttggtaacattcaaaaccgctcacgccaagaagcaggaagttgtggtcctcggttctcaagagggggctatgcacacagccctgactggcgcaaccgaaatccagacgtccggaaccacaactatttttgccggccatttaaaatgccgtctgaagatggataaactaaccctcaaggggatgagctatgtgatgtgtacaggatcgttcaaactggagaaggaagtcgctgagactcagcacggtaccgtgcttgttcagataaagtacgagggcacggacgcgccttgcaaaatcccattctctacacaagatgaaaagggggtgacccagaacggacgcttgattactgcaaatcccatcgtaacagacaaagagaagcctgtcaacatagaagccgagccaccctttggcgagtcctatattgtgatcggtgctggggaaaaagccctgaagctctcatggttcaagaaaggcagtagcatcggaaagatgtttgaggcaaccgccagaggcgctaggcggatggccattctgggggatactgcatgggacttcggatccatcggtggcgtttttacctctgtggggaaacttgtccatcagattttcggaacagcgtacggcgtgctgtttagcggtgtatcatggacgatgaagatagggatcggcgtgttgctcacctggctgggattaaatagtcgatccactagcctgtctatgacatgtattgctgttggcctagtcaccctctacctgggggtgatggtgcaggccgattcaggatgcgtcatcaactggaaaggccgcgaacttaagtgtggtagtgggatcttcgttacaaatgaggtgcacacttggaccgaacaatataagtttcaggcagacagcccgaaaagattgtccgccgctattggaaaggcctgggaggagggcgtgtgcggtataaggtctgcaacgcggctggaaaacatcatgtggaaacagatttcgaacgagctcaatcatatcctgttagaaaacgacatgaagttcacagtagtcgtgggcgatgttgctgggattctggcccagggcaagaaaatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttaacttgtgcgaaggcaccactgtcgtggtggacgagcactgcgggaatagaggacccagtctgaggacaaccacggtcactggcaagattatccacgaatggtgttgccgcagctgtaccttacctccactccggttcaaaggtgaggatgggtgctggtatggaatggagataagacccgttaaggaaaaggaggaaaacctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaatgacctgatccggctttgcattatggttggcgcaaacgctagcgatcgtatggggatgggaacaacctacttggccctgatggcaacattcaaaatgagacctatgttagccgtgggcctcctgtttaggcgccttacttcacgggaggtcctgctactcaccataggtctgagtttggtggcttccgttgaactgccaaattctttagaggaactcggggacggactggcgatgggcatcatgattcttaagctgttgacggatttccaaagccatcagctctgggccacactgctatccctgacctttatcaaaactacctattcacttcactacgcatggaagacaatggctatggtgctcagcattgtcagtctgttccccttgtgtctgtctactacctcccagaagacgacatggttaccggtactcctgggcagccttgggtgcaaacctctgaccatgtttttgatcgccgagaacaagatatggggaagaaaatcgtggccactcaacgaaggtatcatggccgtgggcattgtttcaatcctgctatctagtctgcttaagaatgacgtgcccctcgctgggcctctgattgcaggaggcatgttgatcgcctgttatgtcatatccggtagctctgcggatttaagcctggagaaagctgccgaggtgtcctgggaagaggaagcagagcattcaggggccagtcacaacattctcgtagaagtgcaggacgatggaactatgaagatcaaagacgaggagagggatgacacactgaccatccttctgaaggctactttgctagcagtcagcggcgtttaccccctgtctattccagccacactcttcgtgtggtatttttggcaaaagaaaaagcagcgatccggcgtgctgtgggataccccttcacccccagaagtcgagcgcgcggtgcttgacgatgggatataccggatcatgcagagaggattactgggtaggagtcaggttggcgtaggggtgttccaagaaaatgtcttccatacgatgtggcacgtgactcgtggagctgttctcatgtaccagggcaaacgcttggagccgagctgggcctccgtgaagaaagacctgatttcttatggtgggggatggcggctccagggctcgtggaacaccggcgaggaagtccaggtgatcgcagtagagcctgggaagaatcccaagaacgtccaaacagccccaggaacctttaaaacaagcgaaggtgaggtgggcgctattgccctggacttcaagcccgggacttcaggatcccctatcgttaatagagaaggcaaaatagtgggtctttacgggaacggagtcgtgaccacgagtggcacatatgtttctgcaatcgctcaggccaaggcgagccaggagggcccactgcccgagattgaaaatgaggtgtttaggaaacgaaacttgactatcatggatctacaccctgggtccggaaagacccggcgctacctgccggccattgtcagagaagcaatcaagaggaaactccggacattaatactggctccaacccgagtggtagcctcagagatggctgaagcacttaagggtatgcccattagatatcaaactaccgccgtgaaatctgagcatacaggcaaggagatcgttgacctgatgtgccacgccacgttcactatgcgcctcttgagccctgtcagggtgccaaattacaacatgatcattatggatgaagctcattttaccgaccccagttccatcgcggcacgtgggtatataagcacacgggtgggaatgggcgaggccgctgccattttcatgaccgcaactcctccgggttctgtcgaagcctttccccagtcaaatgctgtaatccaggatgaggaaagagacattccagagaggtcctggaacagtgggtacgagtggatcacagatttccctggaaaaaccgtgtggtttgttcccagcataaagtcgggcaatgacattgcgaactgtctgcgcaagaacggcaaacgagtgatccagctctctagaaagacgttcgatactgaataccagaagacaaagaataacgactgggattatgtcgtgaccaccgacatctccgagatgggggccaattttcgggcagacagggttattgatccacgccgttgcctgaaacctgtgatccttaaggacggacccgaaagagtcattctagctggtccaatgccggtgactgtagccagcgcagcccagcggaggggccgcatagggcgaaaccacaataaggagggagatcagtacatctatatgggccagcctctgaacaatgacgaggatcatgctcactggacagaagccaaaatgttgttagacaacattaatacccccgagggtatcatcccagcgctgttcgaacccgagagagaaaagtcagcagccattgatggggagtaccggctcaggggcgaggctcgcaaaacattcgtggaactgatgagaaggggagaccttcctgtttggctgagttataaggtcgcctctgagggctttcaatactccgatcggcgttggtgcttcgacggggaacgcaacaatcaggtgctcgaggaaaacatggatgtggagatatggactaaagagggagaacgaaagaaattgagaccaaggtggctggacgctcggacgtatagcgatcccctagcactgcgcgagtttaaggagttcgccgctggtagaaggtcagtcagtggcgacctcatccttgagattgggaagctgcctcagcacttaacccagcgggcccaaaatgcattggacaacctggttatgctccataatagcgaacagggaggccgagcgtacagacacgccatggaggagctgccggatacaatcgaaactcttatgctgctcgctttgattgccgtgctgaccggtggggtaacattatttttcctatccggccgcggactgggcaaaacctctatcgggctcctttgtgtgatggcaagctccgtcctgttgtggatggcttcagtggagccacattggatagccgcatctatcattctggaatttttcctcatggttctgcttatccccgagcctgacaggcagcggactccccaggataaccaactcgcctacgtggtcattggactgttgtttatgatcctgacggtagctgcgaacgagatgggtttactagaaaccacaaagaaagacctgggcatagggcacgtggccgttgagaatcaccatcacgcagctatgctcgatgtggaccttcatccagccagtgcctggactctgtatgcagtcgctaccacaattatcacccctatgatgcgtcacactattgaaaacacaacggccaatatctcgttgaccgcgatagctaaccaggccgcaatcctgatgggactcgataagggctggcccattagcaaaatggacatcggtgtgccactgcttgccttagggtgctactcccaggtcaatcctctgactctcacagctgcagtgttgatgctggttgcccattatgcgattatcggcccgggactacaagctaaggccaccagagaggcacagaagaggaccgccgctggcataatgaaaaaccccacagtggatgggattgtagccatcgacctggatccagtggtctacgacgcaaagttcgaaaaacagctcggacagatcatgcttctgattttgtgtacttctcaaatcctgctcatgcgcacgacctgggctctgtgcgagtcaataacattagccactggccctcttaccacactgtgggagggtagccccgggaagttttggaataccactattgcggtttccatggccaacatcttccggggaagttatctcgcaggcgctggtctagccttttctctgatgaagtcattgggcgggggacgaagaggcacgggggcacagggagaaacactgggcgagaagtggaagaggcagctcaatcagcttagcaaatccgagttcaacacctacaagcgcagtggtattatggaggtggatcggagcgaagctaaagaggggctgaagagaggagagactaccaaacacgccgtctctcgtggcacagccaagttgaggtggttcgtggaacggaatctggtaaagccagagggtaaagtgatcgacctcggctgtgggcgcggaggctggtcctattactgcgcggggttaaagaaagttactgaagtgaagggatacaccaaaggcggtcctgggcacgaggaacccataccgatggctacatatggatggaacctggtcaaacttcattcaggcaaagacgtgtttttcatcccacctgagaagtgtgatacgctgctatgcgacattggcgagagctcgcccaatccaaccatcgaagaggggcgaactctcagagtcctgaagatggtggaaccctggttgaggggaaaccaattttgtattaaaatcctgaatccttacatgccgtctgttgtagagacactcgagcagatgcagcggaagcacggtggcatgcttgtgcgcaaccccctgagtagaaattccacccatgaaatgtattgggtcagctgcgggactggaaacattgtgtcagcagttaacatgacatccaggatgttactgaatcgattcaccatggcccaccggaaaccaacgtacgagcgtgatgtggacttgggcgctggtaccagacacgtcgccgtggaacctgaggtagcaaacctcgatatcatagggcagcgcattgaaaatatcaagcatgagcacaaatctacatggcattatgacgaggataacccctacaagacttgggcctatcacggaagctacgaagtgaagcctagtggctccgctagctctatggttaatggcgtcgtgaaactgctaaccaagccatgggacgtgatccccatggtcacacaaattgcgatgactgataccacaccttttgggcagcagagggttttcaaagagaaggtggacacccggactccaaaagccaagagaggaacggcacaaataatggaagtaacagctaagtggctttggggttttctgtcacgcaacaaaaagcccaggatctgtacccgagaggagttcactcggaaagtgagaagtaatgccgcaattggcgccgtctttgtggatgagaaccagtggaactccgctaaggaggccgttgaagacgagaggttctgggacctcgtgcatcgcgaacgtgagctgcacaaacaggggaagtgcgcgacctgcgtctacaacatgatgggaaagcgggagaaaaagttgggcgagtttggtaaagcaaaggggagcagagccatctggtatatgtggctgggagctaggttcctcgagtttgaagcccttggcttcatgaatgaggatcactggttctctcgcgaaaactcgctgtcaggcgtggagggggagggattacataaactgggttacattttgcgagacatcagcaagataccgggcgggaatatgtatgcagatgacacagctggatgggatacgcggatcaccgaagacgatctccagaacgaggccaaaattactgacatcatggaacctgagcacgctctgctagccaagtccatttttaaacttacataccaaaataaagtagttagagtgcagaggccagcaaagaacggcaccgtcatggatgtgatcagtcgcagagaccagcggggttctggacaggtgggaacttatggcctgaacacattcaccaatatggaagcgcaactcataaggcagatggagagcgagggcatattttccccctcagaactggagacacctaacttggccgggcgtgtcttagattggctggaaaaacatggagttgagcgactcaagcgcatggctatcagtggtgacgattgtgtggtaaaaccaatcgacgacagattcgccactgcacttaccgctctgaatgatatgggcaaggtgcggaaggacattccccagtgggaaccgtctaaagggtggaacgattggcagcaagtccctttttgcagccaccacttccatcagctaataatgaaggacggaagggagatcgtggttccctgtcgcaatcaggatgagctggtgggcagagcccgggtctcccagggtgcagggtggtcactcagggaaacggcctgcttgggaaaaagctacgcgcaaatgtggcagctgatgtattttcaccgacgtgaccttagactggctgccaacgcaatttgttctgccgtgccagtagattgggttcctacctcccgcacaacttggagtatccatgctcaccatcagtggatgaccacagaggacatgctcagcgtgtggaatcgggtctggattgaagagaacccctggatggaagataagactcacatctcgtcctggggcgacgtgccatacttaggcaaaagggaggatcaatggtgcgggtctctgataggattgaccgccagagcaacgtgggctacaaatatccaggttgccattaaccaggtgcgccggctgatcggtaatgagaactacctcgactatatgacctcaatgaagaggttcaagaatgaaagcgaccccgagggcgcgctttggtga

SEQ ID NO: 14022 - RNA, 9879 nt, synthetic construct
  misc_feature 1..9879: note = derived and/or modified CDS sequence (opt3) from DENV-1__EU482478__SS-prME
  source 1..9879: mol_type = other RNA
agcgtgaccatgctgctcatgcttatgcccacggccctggctttccacttgactacgagaggaggggaacctcatatgatcgtctccaagcaggaaagagggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagccacacgcaggtctgcgaccaccgtctgatgtccgctgcaatcaaagattcaaaggccgtgcatgctgacatggggtattggattgaaagtgagaaaaatgaaacctggaagctagcccgggcatctttcatcgaggttaagacttgtatatggccaaaaagccacacactgtggtccaacggagtgctcgaatcagagatgatcattcccaagatctacggcggtcctattagccaacataattatcgaccaggctacttcacccagactgcggggccgtggcacctgggaaaacttgagttggattttgacctgtgcgaaggcacaaccgtagtcgtggatgagcactgcgggaacagaggaccctctttaaggacgactaccgtgacaggcaagatcatacatgaatggtgttgccgctcctgtaccctccctccactgcggttcagaggtgaggacgggtgctggtacggaatggagattaggcccgtcaaagaaaaggaggaaaatcttgttaagagtatggtgagcgccggctctggtgaggtagactccttttcactgggcttgctctgtatcagtatcatgattgaagaggtgatgcgcagccgatggtcgcggaaaatgctgatgactgggacactagctgtcttctttctgctcatcatgggacagctgacctggaacgatcttattcgtttgtgcataatggtgggcgccaatgcatccgacagaatggggatgggaacaacttatctggctttaatggccaccttcaagatgaggcctatgtttgcagttggcctcctgttccgccggcttacgtctagagaggtgctgctactcacaatcggtctgagcttggtcgcctcagtggaactgccaaacagtttagaggaactcggggatggactggctatgggcattatgatccttaaactgttgaccgactttcaatcccaccagctctgggcgactctgctatctctgaccttcattaagacaacttttagccttcattacgcctggaaaaccatggcaatggttctctccatcgtgtcactgttccccttgtgtctgagcacgacaagtcagaagaccacttggttaccggtcctcctgggctctcttgggtgcaagcctctgacaatgtttttgatagctgagaataaaatctggggaaggcgatcctggccactcaacgaaggtattatggccgtaggcatcgtgagcattctgctatcgtcactgcttaagaacgatgttcccctcgccgggcctctgatcgctggaggcatgttgatagcatgttatgtgatttctggtagttccgccgacttaagcctggagaaagcggctgaggtctcttgggaagaggaagccgagcacagcggggcatcccataatatcctcgtggaagtacaggatgacggaaccatgaagatcaaagatgaggagcgcgacgatactctgacaattcttctgaaggccaccttgctagctgtgtcaggcgtctaccccctgagtataccagcaacactcttcgtttggtatttctggcagaagaagaagcagcggagcggcgtgctgtgggacactccttctcccccagaagtggagagagccgtccttgatgacgggatctacaggattatgcagcgtggattactgggtcgctcccaggtgggcgttggggtatttcaagaaaacgtgttccacaccatgtggcacgtcacacggggagcggtgctcatgtatcagggcaaaagattggagccgtcatgggctagtgttaagaaagacctgatcagctacggtgggggatggaggctccagggctcctggaataccggcgaggaagtgcaggtcattgccgtggagcctgggaagaaccccaaaaatgtacaaacagcaccaggaacttttaagacccccgaaggtgaggtcggcgccatcgctctggatttcaagcctgggacgtctggatcgccaatagtgaaccgagaaggcaaaatcgttggtctttacgggaatggagtggtcacaactagcggcacctatgtgtcagccattgcacaggctaaggcctcccaggagggccccctgcctgagatcgaagacgaggtttttcggaaacgcaacttgacaattatggatctacatccggggagtggaaagaccagaaggtacctgccagcgatcgtgcgggaagccataaaacgaaagctcagaactttaattctggcacccacccgcgtcgtggcttctgagatggccgaagctcttaagggtatgcctatcaggtatcaaacaacggcagtaaaaagcgagcacactggcaaggagatcgtggacctgatgtgccatgccaccttcacaatgcgtctcttgtccccagttcgggtccccaattacaacatgattatcatggatgaagcccactttaccgacccttcatctatagctgcgagagggtatattagcactagggtgggaatgggcgaggcagccgctatcttcatgacagccaccccgcccggtagtgtggaagcatttccacagtccaatgccgtcattcaggatgaggaacgcgacatccctgagcgaagctggaactctgggtacgagtggataacggatttccccggaaaaactgtatggtttgtgccatcaattaagtccggcaatgacatcgctaactgtctgaggaaaaatggcaagcgggttatccagctcagtaggaagacattcgataccgaatatcagaaaaccaagaacaacgactgggactacgtggtcactacagatattagcgagatgggggcgaatttccgcgccgaccgtgtgatcgatcctagacggtgcctgaaacccgttattcttaaggacggaccagaaagggtgatactagcaggtccgatgcctgtcaccgtggcttcggccgcacagcgccgaggcagaatcgggcggaaccataataaagagggagatcagtacatttatatgggccagcccctgaacaatgacgaggatcacgcccactggacagaagctaagatgttgttagacaacatcaatactccagagggtatcattcccgccctgtttgaacctgagagggaaaagtctgcggcaatagatggggagtaccgcctcagaggcgaggccaggaaaacgttcgtagaactgatgcggcgtggagaccttccagtgtggctgtcctataaggttgctagcgagggctttcaatactcagatcgccgatggtgcttcgacggggaaagaaacaatcaggtcctcgaggaaaacatggatgtggagatctggaccaaagagggagaaaggaagaaattgcggccccgctggctggacgccagaacatatagtgaccctctagctctgagggagtttaaggagttcgcagccggtcggcgatctgtgtccggcgatctcattcttgagatcgggaaactgccgcagcatttaactcagagagctcaaaatgccttggacaacctggtcatgctccacaatagcgaacagggaggccgcgcatacaggcatgcgatggaggagctgccagataccattgaaacacttatgctgctcgccttgatcgctgttctgaccggtggggtgactttatttttcctatcaggccggggactgggcaagacgagtatagggctcctttgtgtaatggccagctccgtgctgttgtggatggcatctgtcgagccccactggatcgctgccagcattatcctggaatttttcctcatggtgctgcttattcctgagcccgaccgtcagagaaccccacaggataaccaactcgcatatgttgtgatcggactgttgtttatgatactgacagtcgccgctaatgagatgggtttactagaaactaccaagaaagacctgggcattgggcacgtagcggtggagaaccatcaccatgccgcaatgctcgatgttgaccttcaccctgcttccgcctggacactgtacgccgtggcaaccactatcattacacccatgatgaggcatacgatcgaaaacaccactgctaatatatcattgacagccatcgcgaaccaggctgccattctgatgggactcgataagggctggccaatctctaaaatggacattggtgtccctctgcttgcattagggtgctacagtcaggtgaatccgctgaccctcaccgccgctgtcttgatgctggtggcacactatgccatcataggccccggactacaagcgaaggctacacgcgaggcccagaaacggactgcagccggcattatgaagaacccaacggttgatgggatcgtggctatcgacctggatcctgtagtgtacgacgccaagttcgaaaaacagctcggacagattatgcttctgatcttgtgtacctcgcaaatactgctcatgcgaacaacttgggcactgtgcgagagcattaccttagctacaggcccccttaccactctgtgggagggttccccagggaagttttggaatacgacaatcgccgtctctatggcgaacattttcagaggatcatatctcgccggcgcaggtctagctttcagcctgatgaaatccttgggcgggggaaggcgcggcaccggggcccagggagaaactctgggcgagaagtggaaacggcagctcaatcagcttagtaagtctgaatttaacacctacaagagaagcggtatcatggaggttgaccgttcagaagcaaaagaggggctgaagaggggagagacaactaaacacgctgtgtcccggggcaccgccaagttgcgctggttcgtcgaacgaaatctggtgaaacctgagggtaaggtaatagatctcggctgtgggagaggaggctggagttattactgcgccgggttaaagaaagtgacagaagttaagggatatacgaaaggcggtcccgggcatgaggaaccgatcccaatggcgacctacggatggaacctggtgaaacttcacagcggcaaagacgtctttttcattcctcccgagaagtgtgatactctgctatgcgacatcggcgagtcttccccaaatcccacaattgaagaggggaggaccctccgggtgctgaaaatggtcgaaccttggttgcgcggaaaccaattttgtatcaagattctgaatccgtacatgccctcagtggttgagactctcgagcagatgcagagaaagcatggtggcatgcttgtaaggaacccactgagccgaaattcgacacacgaaatgtattgggtgtcttgcgggaccggaaacatcgtcagtgctgtgaatatgacgtcccggatgttactgaaccgtttcaccatggcacacagaaaacctacatacgagcgcgatgttgacttgggcgccggtactaggcatgtggctgtcgaacccgagatagccaacctcgatattatcgggcagcggatcgaaaatattaagcacgagcataaaagcacctggcactatgacgaggataacccttacaagacatgggcatatcatggatcatacgaagtgaaaccatccggctctgccagcagtatggtaaatggcgtggttaagctgctaactaagccctgggacgtcatacctatggtgacccaaatcgctatgacagataccactccatttgggcagcagagagtgttcaaagagaaggtcgacacgcgcacacccaaagcgaagaggggaaccgcccaaattatggaagttactgcaaaatggctttggggttttctgtcccgaaacaagaagccgcggatctgtaccagagaggagttcacaaggaaagtgcgcagcaatgctgccattggcgcagtatttgtggacgagaaccagtggaactctgccaaggaggctgtcgaagatgagcgtttctgggacctcgtgcaccgggaaagagagctgcacaaacaggggaagtgcgccacgtgcgtttataacatgatgggaaaaagggaaaagaagttgggcgagtttggtaaagcgaaggggtcacgcgcaatctggtacatgtggctgggagcccgattcctcgagttcgaagctcttggctttatgaatgaggatcattggttcagtcgggaaaactccctgagcggcgtggagggggagggattacacaaactgggttacatattgagagacatctctaagattcctggcgggaatatgtatgccgatgacaccgcaggatgggatactaggatcacagaagacgatctccagaacgaggctcgcattaccgacatcatggaaccagagcatgccctgctagctaaatcgatatttaaacttacttaccaaaataaagtcgtgagagtacagcggcccgccaagaacggcacagttatggatgtgatttcaaggcgtgaccagcgaggtagcgggcaggtcggaacctatggcctgaatacattcactaacatggaagcacaactcatccgccagatggagtccgagggcatctttagtccttctgaactggagaccccaaacttggcggaaagagtgttagattggctggagaagtacggggtggaacggctcaaaaggatggccattagcggagacgactgtgtcgttaagcccatagatgaccgcttcgctacggcccttaccgcactgaatgatatgggtaaagtgagaaaggacatcccgcagtgggagccttccaaaggctggaacgattggcagcaagtacccttttgctcacaccacttccatcagctaattatgaaggacgggcgggagatcgtggtcccatgtaggaatcaggatgaactggtgggacgagctcgtgttagtcagggcgccggttggtctctcagagagacagcatgcttgggaaagagctatgcccaaatgtggcagctgatgtactttcaccgccgggaccttaggctggcggctaacgccatttgttccgcagtgcctgtcgattggatccccacttcaagaaccacatggagcatacatgcccaccatcagtggatgactaccgaagacatgctctctgtgtggaatcgcgtatggatcgaggaaaacccatggatggaggataaaacgcacatttccagttggggagacgttccctatttaggcaagcgggaggaccaatggtgcggcagcctgatcgggttgacagctagggccacctgggcaactaatattcaggtggctatcaaccaggtccgaagactgattggaaatgaaaactacctcgattacatgacatcgatgaaacggttcaagaatgagggtgaccctgaaggcgccctttggtga

SEQ ID NO: 14023 - RNA, 9879 nt, synthetic construct
  misc_feature 1..9879: note = derived and/or modified CDS sequence (opt3) from DENV-1__EU482479__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacattaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatatgtaccgggagcttcaaactggagaaggaagtcgccgagacgcagcacggtacagtgcttgttcagatcaagtacgagggcaccgacgctccttgcaaaattccattctcgactcaagatgaaaagggggtgacacagaacggacgcttgatcaccgcgaatcccatagtaactgacaaagagaagcctgtcaacattgaagcagagccaccctttggcgagtcttatatcatcattggtgccggggaaaaagctctgaagctctcctggttcaagaaaggctcaagtatcggaaagatgtttgaggccaccgcaagaggcgccaggcggatggctattctgggggatacagcctgggacttcggaagcataggtggcgtgtttacgtccgttgggaaacttgtgcatcagatcttcggaaccgcatacggcgtcctgttttctggtgtgagctggactatgaagattgggatcggcgtattgctcacatggctgggattaaattcacgaagtacctccctgagcatgacatgtatcgcggtgggcctagttactctctacctgggggtcatggtgcaggctgattctggatgcgtgattaactggaaaggccgcgaacttaagtgtggttcagggatattcgtcaccaatgaggttcacacgtggacagaacaatataagtttcaggccgacagtccgaaaagattgagcgcagccatcggaaaggcttgggaggagggcgtgtgcggtattaggtccgccacccggctggaaaacatcatgtggaaacagatttctaacgagctcaatcatatcctgttagaaaacgacatgaagttcactgtggtagtcggcgatgtggcagggatactggctcagggcaaaaagatgatccgccctcaacccatggagtacaaatattcgtggaaaagctggggcaaggccaaaattatcggggcggacgttcagaataccacatttattatcgatggaccaaacactcctgaatgtcccgacgatcagagagcctggaatatatgggaggtggaggactacggcttcggtatttttaccacaaacatctggcttaagttgagggattcccacacgcaggtctgcgaccaccgtctcatgtcagctgcaattaaagatagtaaggccgtgcatgctgacatggggtattggatcgaatctgagaaaaatgaaacctggaagctggcccgggcatccttcatagaggttaagacttgtatctggccaaaatcccacacactatggtcaaacggagtgctggaaagcgagatgattatccccaagatttacggcggtcctatctctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagataattcatgaatggtgttgccgcagttgtaccttacctccactccggttcagaggtgaggacgggtgctggtacggaatggagatcaggcccgtcaaagaaaaggaggaaaatctggttaagagcatggtgtctgccggctccggtgaggtagactcatttagtcttggcctgttgtgtatcagcattatgatcgaagaggtgatgcgctcgcgatggtcccggaaaatgctcatgactgggacactggctgtcttctttctactgattatgggacagctcacctggaacgatctgatacgtctttgcatcatggtgggcgccaatgcatctgacagaatggggatgggaacaacttatttggctctgatggccaccttcaagatgaggcctatgtttgcagttggcttactcttccgccggctgacgagcagagaggtgcttctgctaacaattggtctctcactggtcgccagtgtggaattgccaaactccctggaggaattaggggatggactcgctatgggcatcatgattctgaaacttctgaccgactttcaatctcaccagttgtgggcgactctcctgagcctaaccttcatcaagacaactttttccctgcattacgcctggaaaaccatggcaatggttctttcaatagtgagcctcttccccctgtgtttgagtacgacatctcagaagaccacttggctgccggtcttactcggctccctggggtgcaagcctcttacaatgtttctgatcgctgagaataaaatttggggaaggcgaagctggccattgaacgaaggtatcatggccgtaggcattgtgtcgatcctcctgtcatctctactgaagaacgatgttccccttgccgggcctctcatagctggaggcatgctgattgcatgttatgtgatcagtggttccagcgccgacttgtctttagagaaagcggctgaggtcagctgggaagaggaagccgagcactccggggcatcacataatatcctggtggaagtacaggatgacggaaccatgaagattaaagatgaggagcgcgacgatactctcacaatactgcttaaggccaccctgttggctgtgagtggcgtctaccccctaagcatcccagcaacgctgttcgtttggtatttctggcagaaaaagaagcagcggtctggcgtgctctgggacactccttcacccccagaagtggagagagccgtcctggatgacgggatttacaggatcatgcagcgtggacttttaggtcgcagccaggtgggcgttggggtatttcaagaaaacgtgttccacaccatgtggcacgtcacacggggagcggtgctgatgtatcagggcaaaagactcgagccgagttgggctagcgttaagaaagacttgatttcctacggtgggggatggaggctgcagggctcttggaataccggcgaggaagtgcaggtcatcgccgtggagcctgggaagaaccccaaaaatgtacaaacagcaccaggaacttttaagacccccgaaggtgaggtcggcgccatagctctcgatttcaagcctgggacgtcgggaagcccaatcgtgaaccgagaaggcaaaattgttggtctgtacgggaatggagtggtcacaacttcaggcacctatgtgtccgccatcgcacaggctaaggccagtcaggagggcccccttcctgagattgaagacgaggtttttcggaaacgcaacctgacaatcatggatttgcatccggggtctggaaagaccagaaggtacctaccagcgatagtgcgggaagccattaaacgaaagctgagaactctcatcttagcacccacccgcgtcgtggctagcgagatggccgaagctctgaagggtatgcctatcaggtatcaaacaacggcagtaaaatccgagcacactggcaaggagattgtggaccttatgtgccatgccaccttcacaatgcgtctgctctcaccagttcgggtccccaattacaacatgatcataatggatgaagcccactttaccgacccttctagcattgctgcgagagggtatatcagtactagggtgggaatgggcgaggcagccgctattttcatgacagccaccccgcccggttccgtggaagcatttccacagagcaatgccgtcatccaggatgaggaacgcgacatacctgagcgatcttggaactcagggtacgagtggattacggatttccccggaaaaactgtatggtttgtgccatccatcaagagtggcaatgacatcgctaactgtttgaggaaaaatggcaagcgggttattcagctgagcaggaagacattcgataccgaatatcagaaaaccaagaacaacgactgggactacgtggtcactacagatatctcggagatgggggcgaatttccgcgccgaccgtgtgattgatcctagacggtgcctcaaacccgttatactgaaggacggaccagaaagggtgatccttgcaggtccgatgcctgtcaccgtggcttctgccgcacagcgccgaggcagaattgggcggaaccataataaagagggagatcagtacatctatatgggccagcccctaaacaatgacgaggatcacgcccactggacagaagctaagatgctgttggacaacatcaatactccagagggtattatacccgccttatttgaacctgagagggaaaagtccgcggcaatcgatggggagtaccgcctgagaggcgaggccaggaaaacgttcgtagaactcatgcggcgtggagacctgccagtgtggcttagctataaggttgcttcagagggctttcaatacagtgatcgccgatggtgcttcgacggggaaagaaacaatcaggtcctggaggaaaacatggatgtggagatttggaccaaagagggagaaaggaagaaactccggccccgctggttggacgccagaacatattctgaccctctggctctaagggagtttaaggagttcgcagccggtcggcgatccgtgagcggcgatctgatcctcgagattgggaaacttccgcagcatctgactcagagagctcaaaatgccttagacaacttggtcatgctgcacaattcagaacagggaggccgcgcatacaggcatgcgatggaggagctcccagataccatcgaaacactgatgcttctggccctcatagctgttttgaccggtggggtgactctgtttttcttaagtggccggggactaggcaagacgagcatcgggctgctctgtgtagtggcctcctctgtccttctgtggatggcaagcgtggagccccactggattgctgcctccatcattttggaatttttcctgatggttctcctgatccctgagcccgaccgtcagagaaccccacaggataaccaacttgcatatgtggtcataggactcctgtttatgattttgacagtagccgctaatgagatgggtctgttagaaactaccaagaaagacctaggcatcgggcacgtggcggttgagaaccatcaccatgccgcaatgctggatgtggacctccaccctgcttcagcctggacactttacgccgtcgcaaccactattatcacacccatgatgaggcatacgatagaaaacaccactgctaatatctctctgacagccattgcgaaccaggctgccatcttgatgggactggataagggctggccaattagtaaaatggacatcggtgtgcctctcctggcacttgggtgctactcgcaggtcaatccgttaaccctgaccgccgctgtgctcatgttggttgcacactatgccataattggccccggactgcaagcgaaggctacacgcgaggcccagaaacggactgcagccggcatcatgaagaacccaacggtggatgggatcgtagctattgacctagatcctgtggtctacgacgccaagttcgaaaaacagctgggacagatcatgctccttatactgtgtaccagccaaattttgctgatgcgaacaacttgggcactctgcgagtccatcaccctggctacaggccccttaaccactctttgggagggttctccagggaagttttggaatacgacaattgccgtttcaatggcgaacatcttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtataatggaggtggaccgttccgaagcaaaagaggggcttaagaggggagagacaactaaacacgctgtcagtcggggcaccgccaagctgcgctggttcgtggaacgaaatttggtaaaacctgagggtaaggtgatcgatctgggctgtgggagaggaggctggagctattactgcgccgggctcaagaaagttacagaagtgaagggatatacgaaaggcggtcccgggcatgaggaaccgattccaatggcgacctacggatggaacttagtcaagctgcactctggcaaagacgtgtttttcatccctcccgagaagtgtgatactcttctgtgcgacattggcgagtcctcaccaaatcccacaatcgaagaggggaggaccctacgggtcctcaaaatggtggaaccttggctgcgcggaaaccaattttgtattaagatcttgaatccgtacatgcccagcgttgtagagactctggagcagatgcagagaaagcatggtggcatgctcgtgaggaacccactttcgcgaaattctacacacgaaatgtattgggtcagttgcgggaccggaaacatagtgtccgctgttaatatgacgagccggatgctgttaaaccgtttcaccatggcacacagaaaacctacatacgagaaggatgtggacctgggcgccggtactcgccatgtcgctgtggaacccgaggtagccaacttggatattatcgggcagaggatcgaaaatattaaacacgagcataagtcaacctggcactatgacgaggataacccttacaaaacatgggcatatcatggatcctacgaagtgaagccatctggcagcgccagttccatggttaatggcgtcgtgaagctcctgactaaaccctgggacgtgatacctatggtcacccaaatcgctatgacagataccactccatttgggcagcagcgggttttcaaggagaaagtggacacgagaacacccaaggcgaaacgcggaaccgcccaaattatggaagtaactgcaaagtggctatggggttttcttagcaggaacaagaaaccgcgaatctgtacccgggaggagttcacaagaaaggtgaggtctaatgctgccattggcgcagtctttgtggacgagaaccagtggaactcagccaaagaggctgttgaagatgagcgcttctgggacctggtgcaccgtgaacgggagctccacaagcaggggaaatgcgccacgtgcgtctataacatgatgggaaagagagaaaagaaactgggcgagtttggtaaggcgaaagggagtagggcaatctggtacatgtggttgggagcccgcttcctggagttcgaagctctcggctttatgaatgaggatcattggttctcccgagaaaacagcctttctggcgtggagggggagggactgcacaagttaggttacatactgcgggacatctcgaaaattcctggcgggaatatgtatgccgatgacaccgcaggatgggatactagaatcacagaagacgatttgcagaacgaggctaggattaccgacatcatggaaccagagcatgccctcctggctaagtcaatatttaaactaacttaccaaaataaggtagttcgcgtgcagagacccgccaagaacggcacagtcatggatgtgattagccggagggaccagcgtggttccggacaggtgggaacctatggccttaatacattcactaacatggaagcacaactgatccgacagatggagagtgagggcatcttttctcctagcgaactcgagaccccaaacctggcggaacgcgtcttggattggctaaagaagtacggggttgagagactgaaacggatggccatttccggagacgactgtgtggtaaagcccatagatgacaggttcgctacggccctcaccgcacttaatgatatgggtaaagtgcgcaaggacatcccgcagtgggaaccttcaaagggctggaacgattggcagcaagtccccttttgcagtcaccacttccatcagctgattatgaaagacgggagagagatcgtggttccatgtcggaatcaggatgagctagtgggaagggctcgagtctctcagggcgccggttggagcctgcgtgaaacagcatgcctcgggaagtcctatgcccaaatgtggcagttgatgtactttcacagacgcgacctgcggcttgcggctaacgccatttgttcagcagtgcctgtagattggatccccactagcaggaccacatggtctatacatgcccaccatcagtggatgactaccgaggacatgctgtccgtttggaatagagtgtggatcgaagagaacccatggatggaagataaaacgcacattagtagctggggagacgtcccctatctcggcaagcgcgaggaccaatggtgcggctcgttaatcgggctgacagctcgggccacctgggcaactaatattcaggtggctatcaaccaggttaggcgattgattggaaatgagaactacctggattacatgacatccatgaaaagattcaagaatgaaggtgaccctgagggcgccctctggtga

SEQ ID NO: 14024 - RNA, 9879 nt, synthetic construct
  misc_feature 1..9879: note = derived and/or modified CDS sequence (opt3) from DENV-1__EU482480__SS-prME
  source 1..9879: mol_type = other RNA
agcgtgaccatgctgctcatgcttatgcccactgcactggctttccacttgactacgagaggaggggaacctcatatgatcgtctccaagcaggaaagagggaaatctttactgtttaagacctcagccggtgttaatatgtgcaccctgattgccatggacctcggagagttctgtgaagatactatgacctacaaatgcccacggattaccgaagcggaaccggacgatgtggactgttggtgcaatgctaccgatacttgggtaacatatgggacctgtacgcaaatcggagagcaccgccgagacaagcgtagtgtggccctggcaccccatgtcggccttggtctggagactagaaccgaaacatggatgagctccgagggggcctggaaacagattcagagggtggaaacttgggctttgcggcaccctggatttaccgttatcgcactcttcctggcccatgctattggcacatctatcacccagaagggcataatctttattctgctcatgttagccacgccatcgatggcgatgcgctgcgtggggatcggatcaagagatttcgtcgagggtctgagcggcgcaacttgggtggacgtagttcttgagcacgggagttgtgtgacaaccatggccaaggataaacccactttggacattgaactgctaaagacagaggtcaccaaccctgctgtgctcaggaaactgtgcatcgaagccaagatatccaatacgaccacagattctcggtgtccaactcaaggagaggcaacccttgtggaagaacaagacgctaactttgtctgccgccgaacattcgttgatagaggctggggtaatgggtgtggactgtttggcaaaggcagcttgattacttgcgccaagttcaagtgcgtgaccaaactcgaggggaagatcgtacagtacgaaaacctgaaatattccgtgattgtcacagtgcacaccggagaccagcatcaagttggtaatgagtcaactgaacacggcacgatcgcgacaatcacaccccaggcccctagtactgagattcagttaaccgactacggggcactgacactcgattgtagcccaaggaccggacttgactttaacgaaatggtgctgttgactatgaaggagaaatcttggctagtccataagcagtggttcctggatctcccgctgccctggacatccggcgcttcaacgagccaagagacctggaatcggcaggaccttctggtgacttttaaaacagcccacgctaagaagcaggaagtagttgtgttgggtagtcaagagggggccatgcacaccgcactcacaggcgccactgaaatacagacctctggaacgaccacaatcttcgctggccatctgaaatgccgtttaaagatggataaactgactctaaaggggatgtcctatgtcatgtgtaccggctcgttcaaactcgagaaggaagtggcggagacacagcacggtactgtcctggtgcagattaagtacgagggcaccgacgcaccttgcaaaatcccattttcgacgcaagatgaaaagggggttacacagaacggacgccttataaccgccaatcccattgtgactgacaaagagaagcctgtaaacatcgaagctgagccacccttcggcgagtcttatatcgtcattggtgccggggaaaaagcattgaagctgtcctggtttaagaaaggctcaagtatcggaaagatgttcgaggccacagctagaggcgccaggcggatggcaattctcggggataccgcgtgggactttggaagcataggtggcgtgttcacttccgttgggaaactggtgcatcagatctttggaaccgcttacggcgtccttttctctggtgtgagctggacaatgaagattgggatcggcgtactgttgacgtggctcggactaaattcacgaagtacctccttaagcatgacttgtatcgccgtgggcctggttacactatacctcggggtcatggtgcaggcagattctggatgcgtgattaactggaaaggccgcgaactgaagtgtggttcagggatatttgtcaccaatgaggttcacacatggactgaacaatataagttccaggccgacagtccgaaaagacttagcgctgccatcggaaaggcatgggaggagggcgtgtgcggtattaggtccgctacccggttggaaaacatcatgtggaaacagatttctaacgagctgaatcatatcctcctggaaaacgacatgaagttaacggtggtagtcggcgatgtggccgggatactggcgcagggcaagaagatgatccgccctcaacccatggagtacaaatattcgtggaagatttggggcaaggccaaaatcattggggctgacgttcagaatacaacctttatcatagatggaccaaacactcctgaatgtcccgacgatcagagagcatggaatatttgggaggtggaggactacggcttcggtatctttaccacaaacatttggcttaagttgagggatagctatactcaggtctgcgaccaccgtctcatgtccgccgctatcaaagattcaaaggccgtgcacgcagacatggggtactggatagaaagtgagaaaaatgaaacctggaagctggcgcgggcctctttcatcgaggttaagacatgtatttggccaaaaagccatacgctatggtccaacggagtgctggaatcagagatgatcattcccaagatctatggcggtcctataagccaacacaattaccgaccaggctacttcacccagactgctgggccgtggcatctcggaaaactggagcttgattttgacttgtgcgaaggcacaaccgtagtcgtggatgagcactgcgggaacagaggaccctctctgaggactacaaccgtgacgggcaagattatccacgaatggtgttgccgctcctgtactttacctccactccggttcaaaggtgaggacgggtgctggtatggaatggagatcagacccgtcaaggaaaaggaggaaaatctggttaaaagtatggtgagcgccggctctggtgaggtagactccttttcacttggcctgttgtgtattagtatcatgattgaagaggtgatgaggagccgctggtcgcgaaagatgctcatgaccgggacactggcagtcttctttctactgataatgggacagctcacctggaacgatctgatccggctttgcattatggtgggcgctaatgcctccgaccgtatggggatgggaactacatacttggcactgatggccaccttcaaaatgagacctatgtttgctgttggcttactcttcaggcgcctgacatctcgggaggtgcttctgctaactatcggtctcagcctggtcgcgtcagtggaattgccaaacagtctggaggaattaggggatggactcgccatgggcattatgatcctgaaacttctgaccgactttcaatcccatcagttgtgggcaacgctcctgtctctaacattcataagaaccacttttagcctgcactatgcttggaaaaccatggccatggttctttccatcgtgtcactcttccccctgtgtttgagcacaacaagtcagaagaccacgtggctgccggtcttactcggctctctggggtgcaagcctcttacaatgtttctgattgccgagaataaaatctggggaaggaagtcctggccattgaacgaaggtattatggctgtaggcatcgtgagcatactcctgtcgtcactactgaaaaacgatgttccccttgcagggcctctcattgccggaggcatgctgatcgcgtgttacgtgatctctggtagttccgctgacttgagcttagagaaggccgcagaggtctcttgggaagaggaagccgagcatagcggggcttcccacaatattctggtggaagtacaggatgacggaaccatgaaaataaaggatgaggagcgagacgatactctcacaatcctgcttaaagcaaccctgttggccgtgtcaggcgtctatcccctaagtattccagcgactctgttcgtttggtacttctggcaaaagaagaaacagcgcagcggcgtgctctgggacacaccttctcccccagaagtggagcgggctgtcctggatgacgggatctatagaattatgcagaggggacttttaggtcgttcccaggtgggcgttggggtatttcaagaaaacgtgttccataccatgtggcacgtcacgcgcggagccgtgctgatgtaccagggcaagcggctcgagccgtcatgggcaagtgttaaaaaggacttgatcagctacggtgggggatggagactgcagggctcctggaatactggcgaggaagtgcaggtcatagccgtggagcctgggaaaaaccccaagaatgtacaaaccgctccaggaacatttaagacctctgaaggtgaggtcggcgccatcgcactcgatttcaaacccgggacatcgggaagccctattgtgaacagggaaggcaagatcgttggtctgtatgggaatggagtggtcactacctcaggcacgtacgtgtccgctattgcccaggcgaaagccagtcaggagggcccacttcccgagatcgaagacgaggtttttcgaaagcggaacctgacaataatggatttgcaccctgggtctggaaaaactcgcagatatctaccggcaattgtgagggaagctatcaagcggcgactgagaaccctcatcttagccccaacacgcgtcgtggctagcgagatggcagaagccctgaagggtatgcccattaggtaccaaaccactgccgtaaaatccgagcataccggcaaggagatcgtggaccttatgtgccacgctacattcacgatgcgtctgctctcacctgttcgggtcccaaattataacatgataattatggatgaagcgcattttactgacccctctagcatcgcagccagagggtacattagtaccagggtgggaatgggcgaggctgccgcaatcttcatgacagccacccctccgggttccgtggaggcttttccccagagcaatgcggtcatacaggatgaggaacgcgacattccagagcgatcttggaactcagggtatgagtggatcactgatttccctggaaaaacagtatggtttgtgccctccatcaagagtggcaatgacattgccaactgtttgaggaaaaatggcaagcgggttatccagctgagcaggaagaccttcgatacggaataccagaaaactaagaacaacgactgggactacgtggtcacaaccgatatttcggagatgggggcaaatttccgcgctgaccgtgtgatagatccaagacggtgcctcaaacctgttatcctgaaggacggacccgaaagggtgattcttgccggtccaatgccggtcaccgtggcatctgccgctcagcgccgaggcagaatcgggcggaaccacaataaagagggagatcagtatatctacatgggccagcctctaaacaatgacgaggatcatgcccactggactgaagcgaagatgctgttggacaacattaatacacccgagggtataatcccagcattatttgaacccgagagggaaaagtccgccgctattgatggggagtatcgcctgagaggcgaggccaggaaaaccttcgtagaactcatgcggcgtggagacctgcctgtgtggcttagctacaaggttgcttcagagggctttcaatatagtgatcgccgatggtgcttcgacggggaaagaaacaatcaggtcctggaggaaaacatggatgtggagatctggacaaaagagggagaaaggaagaaactccggccacgctggttggacgcaagaacttactctgaccccctggccctaagggagtttaaggagttcgctgccggtcggcgatccgtgagcggcgatctgattctcgagatcgggaaacttcctcagcacctgacgcagagagcacaaaatgcgttagacaacttggtcatgctgcataattcagaacagggaggccgcgcctataggcacgctatggaggagctcccggataccatagaaacactgatgcttctggccctcatcgcagttttgactggtggggtgaccctgtttttcttaagtggccggggactaggcaagacaagcattgggctgctctgtgtaatggcttcctctgtgcttctgtggatggccagcgtcgagccacattggatcgcagcctccattatcttggaatttttcctgatggtgctcctgatacccgagcctgaccgtcagagaacaccccaggataaccaacttgcttacgttgtgattggactcctgtttatgatcttgactgtcgcggccaatgagatgggtctgttagaaacgaccaagaaagacctaggcattgggcacgtagcagtggagaaccaccatcacgctgccatgctggatgttgacctccatccagcctcagcatggacactttacgctgtggccactaccatcataacacctatgatgaggcacaccatcgaaaacactacagcgaatatttctctgacggctatcgccaaccaggcagccattttgatgggactggataagggctggcccatcagtaaaatggacataggtgtcccactcctggctcttgggtgctatagccaggtgaatcctttaaccctgactgcagccgtcctcatgttggtggcgcattacgctattatcggcccgggactgcaagccaaggcaacacgcgaggcccagaaacggaccgctgccggcatcatgaagaaccccaccgttgatgggattgtggcaatcgacctagatccagtagtgtatgacgctaagttcgaaaaacagctgggacagataatgctccttattctgtgtacaagccaaatcttgctgatgcgaactacgtgggccctctgcgagtccattaccctggcgacaggccctttaactaccctttgggagggttctcccgggaagttttggaatacaaccatcgccgtctcaatggcaaacatattcagaggaagctacctggctggcgccggtctcgcattctccctaatgaaaagtctgggcgggggaaggcgcggcactggggctcagggagaaacgttgggcgagaagtggaaacggcagctgaatcagctctctaagagcgaatttaacacatataagagatcaggtatcatggaggttgaccgttccgaagccaaagaggggcttaagaggggagagaccactaaacacgccgtgagtcggggcaccgcgaagctgcgctggttcgtcgaacgaaatttggtgaaaccagagggtaaggtaattgatctgggctgtgggagaggaggctggagctactattgcgctgggctcaagaaagtgacagaagttaagggatacactaaaggcggtcctgggcacgaggaacccatcccgatggcaacctacggatggaacttagtgaagctgcattctggcaaagacgtctttttcattccacctgagaagtgtgatacacttctgtgcgacatcggcgagtcctcacccaatccaacgattgaagaggggaggaccctacgggtgctcaaaatggtcgaaccctggctgcgcggaaaccaattttgtatcaagatattgaatccttatatgccgagcgtggttgagactctggagcagatgcagagaaagcacggtggcatgctcgtaaggaaccccctttcgcgaaattctacacatgaaatgtactgggtgagttgcgggaccggaaacattgtctccgccgtgaatatgactagccggatgctgttaaaccgtttcacaatggctcacagaaaaccaacctatgagcgcgatgttgacctgggcgccggtacgaggcacgtggcagtcgaacctgaggtggccaacttggatatcatcgggcagcggattgaaaatataaagcatgagcacaaatcaacctggcattacgacgaggataacccctataagacatgggcttaccacggatcctatgaagtaaaaccttctggcagcgcgagttccatggtgaatggcgttgtcaagctcctgactaagccatgggacgtgatccccatggtgacccaaattgccatgacagatactaccccttttgggcagcagagagtcttcaaagagaaggttgacacacgcaccccaaaagcaaagaggggaactgctcaaatcatggaagtgacggccaaatggctatggggttttcttagccgaaacaagaagccccggatttgtacaagagaggagttcaccaggaaagtacgctctaatgcagccatcggcgctgtgtttgtcgacgagaaccagtggaactcagccaaggaggcggtggaagatgagcgtttctgggacctggttcatcgggaaagagagctccacaaacaggggaagtgcgcaacttgcgtgtacaacatgatgggaaaaagggaaaagaagctgggcgagtttggtaaagccaaggggagtcgcgctatatggtacatgtggttgggagcccgattcctggagttcgaagcactcggctttatgaatgaggatcactggttctcccgggaaaacagcctttctggcgtcgagggggagggactgcataaattaggttatatcctgagagacatttcgaagatcccgggcgggaatatgtacgctgatgacaccgccggatgggatacaaggattacggaagacgatttgcagaacgaggctaaaatcaccgacataatggaacctgagcacgccctcctggcaaagtcaatttttaaactaacttatcaaaataaggtggtacgcgttcagagaccagcgaagaacggcacagtgatggatgtcatcagccggagggaccagcgtggttccggacaggtgggaacctacggccttaatactttcacaaacatggaagcccaactgatccgacagatggagagtgagggcatattttctcccagcgaactcgagacccctaacctggctgggcgcgtgttggattggttagaaaaacatggagtcgagagactgaagcggatggccatatccggtgacgactgtgttgtgaaaccaatcgatgacaggttcgcaacagctctcactgcccttaatgatatgggcaaggtacgcaaagacattccccagtgggaaccgtcaaaggggtggaacgattggcagcaagtgcctttttgcagtcaccacttccatcagctgatcatgaaggacggaagagagattgtcgtgccctgtcggaatcaggatgagctagttggcagggcacgagtgtctcagggtgccgggtggagcctgcgtgaaaccgcgtgcctcggaaaatcctatgctcaaatgtggcagttgatgtactttcacagacgcgacctgcggcttgccgcaaacgccatctgttcagctgtcccagtggattgggtacctacgagcaggaccacatggtctatacatgcccaccatcagtggatgactaccgaggacatgctgtccgtttggaatagagtgtggatcgaagagaacccctggatggaagataagacacacgtcagtagctggggcgacgtgccatatctcggcaaacgcgaggaccaatggtgcgggtcgttaattggactgactgcacgggctacctgggccacgaatatccaggttgcgattaaccaggtgaggcgattgctgggtaatgagaactacctcgattacatgacatccatgaagagattcaaaaatgaatctgaccccgagggcgctctttggtga

SEQ ID NO: 14025 - RNA, 9879 nt, synthetic construct
  misc_feature 1..9879: note = derived and/or modified CDS sequence (opt3) from DENV-1__EU482481__SS-prME
  source 1..9879: mol_type = other RNA
agcgtgaccatgctgctcatgcttatgcccaccgccctggctttccacttgactacgagaggaggggaacctcatatgatcgtaaccaagcaggaaaggggaaaatccttactgtttaagacatctgccggtgttaacatgtgcactttaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaaaatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataatcaccgaccaggctatttcacacagaccgcggggccgtggcacctcggaaaactggagcttgattttgacttgtgcgaaggcactacagtggtggtcgatgagcattgcgggaacagaggaccctccctgaggaccacgactgttaccggcaagatcattcacgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatacctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcatcagctctgggcgaccctgctaagcctgacttttattaaaaccacactttccctccactatgcctggaagactatggcaatggtcctgtcaatcgtcagcttgttccccctgtgtttaagtaccacgtctcagaagacaacctggctcccggtgctgcttggctccctggggtgcaaacctttgactatgtttctcattacagagaataagatctggggaagaaaaagctggccactgaacgaaggtataatggctgttggcgtggtctcgatcctactgtcatctcttctcaagaacgatgtgcccctggccgggcctttgattgccggaggcatgttaatcgcttgttacgtaattagtggttccagcgcagacctgtctctcgagaaagccgcggaggtgagctgggaagaggaagctgagcattccggggcctcacacaatatcctggtcgaagttcaggatgacggaaccatgaagataaaagatgaggagagggacgatactcttacaattctgttgaaggcaaccctactggccgtgagtggcgtgtatcccctcagcatcccagctacgctgttcgtctggtacttttggcaaaagaaaaagcagcgatctggcgtgctttgggacactccttcacccccagaagttgagcgcgcagtattagatgacgggatctatcggattatgcagagaggactgctcggtaggagccaggtgggcgtcggggtgttccaagaaaacgttttccacaccatgtggcatgtgacacgtggagccgtcttgatgtaccagggcaaacgcctggagccgagttgggcgagcgtgaagaaagacctcatatcctatggtgggggatggcggctgcagggctcttggaataccggcgaggaagtacaggtcatcgctgtggagcctgggaagaaccccaagaatgttcaaacagccccaggaacttttaaaacccccgaaggtgaggtgggcgcaattgcccttgatttcaagcctgggacgtcgggaagcccaatcgtcaacagagaaggcaaaattgtgggtctgtacgggaatggagttgtgacaacttcaggcacctacgtctccgctatcgcccaggcaaaggctagtcaggagggccccttgcctgagatagaagacgaggtgtttaggaaacgaaacctaacaatcatggatctgcacccggggtctggaaagacccggcgctatctcccagccattgtaagagaagcgatcaagaggaaattacggactctgattcttgcccccacccgagtggttgcaagcgagatggctgaagccctgaagggtatgcctatcagataccaaacaacggctgtcaaatccgagcatactggcaaggagatagtggacctcatgtgccacgcaaccttcacaatgcgcttgctgtcaccagtgagggtccccaattataacatgattatcatggatgaagcccattttaccgacccttctagcatcgccgctcgtgggtacattagtactcgggtaggaatgggcgaggcggcagccatcttcatgacagctaccccgcccggttccgtggaagcctttccacagagcaatgcagttatacaggatgaggaaagagacattcctgagaggtcttggaactcagggtatgagtggatcacggatttccccggaaaaactgtgtggtttgtcccatccattaagagtggcaatgacatcgccaactgtctccgcaagaatggcaaacgagtgatacagctgagcagaaagacattcgataccgaataccagaaaaccaagaacaacgactgggactatgttgtgactacagatatttcggagatgggggctaattttcgggcggacagggtcatcgatcctcgccgttgccttaaacccgtgatcctaaaggacggaccagaaagagtaattctggccggtccgatgcctgtgaccgttgcatctgctgcccagcggaggggccgcatcgggcgaaaccacaataaggagggagatcagtacatttacatgggccagcccttgaacaatgacgaggatcacgcacattggacagaagccaaaatgttactggacaacataaatactccagagggtatcattcccgctctcttcgaacctgagagagaaaagtccgccgcgatcgatggggagtatcggctgaggggcgaggcacgcaaaacgttcgtcgaacttatgagaaggggagacctgccagtgtggctcagctacaaggtggcctcagagggctttcaatatagtgatcggcgttggtgcttcgacggggaacgcaacaatcaggtcttggaggaaaacatggatgttgagatctggaccaaagagggagaacgaaagaaactgagacccaggtggctagacgctcggacatactctgaccctctggccctccgcgagtttaaggagttcgctgcaggtagaaggtccgtgagcggcgatcttatttcagagatagggaagctgccgcagcacttaactcagcgggcccaaaatgctttggacaacctggtaatgctccataatagtgaacagggaggccgagcctatagacacgcaatggaggagctgccagataccatcgaaacacttatgctgctcgcgttgattgccgtgctgaccggtggggtcactttatttttcctaagcggccgcggactgggcaaaacgtccatcgggctcctttgtgtgatggcttctagcgttctgttgtggatggcctccgtggagccccactggattgcagcttcaatcatactggaatttttcctcatggtcctgcttatccctgagcccgacaggcagcggaccccacaggataaccaactcgcctacgtagtgattggactgttgtttatgatcctgacagttgcagccaatgagatgggtttactagaaactaccaagaaagacctgggcattgggcatgtggctgtcgagaaccaccatcacgcgacaatgctcgatgtggaccttcatcctgcctctgcatggaccctgtatgctgtcgccactacaatcataacgcccatgatgcgtcacaccattgaaaacactacagccaatatcagtttgaccgcaattgctaaccaggccgcgatcctgatgggactcgataagggctggccaatatcgaaaatggacatcggtgtgcctctgcttgctttagggtgctacagccaggttaatccgctgaccctcacagccgcagtgttgatgctggtagcccactacgctattatcggccccggactacaagcaaaggccactagagaggcgcagaagaggacggctgccggcattatgaaaaacccaaccgtggatgggatcatagcaattgacctggatcctgtcgtttatgacgccaagttcgaaaaacagctcggacagatcatgcttctgatcttgtgtacatcccaaattctgctcatgcgcactacctgggctctgtgcgagtctatcacattagccaccggcccccttactacgctgtgggagggttcaccagggaagttttggaatacaaccatagcagtgagcatggctaacattttccggggatcctacctcgccggcgcgggtctagcctttagtctgatgaaatctttgggcgggggacgaagaggcactggggcacagggagaaaccctgggcgagaagtggaagaggcagctcaatcagcttagcaaatcagagttcaacatctataagcgctccggtattatggaggtcgaccggagtgaagctaaagaggggctgaagagaggagagacaactcgtcatgccgtgagcaggggcaccgcaaaattgcggtggttcgtagaacgcaatctggtgaagcctgagggtaaggttatcgatctcggctgtgggcgaggaggctggtcttactattgcgctgggctaaagaaggtgacagaagtcaaaggatacacgaagggcggtcccgggcacgaggaaccgataccaatggccacctatggatggaacctggtgaaacttcattccggcaaggacgtctttttcactcctcccgagaaatgtgatacactgctatgcgacatcggcgagtcaagcccaaatcccaccattgaagaggggagaactctcagggtgctgaagatggttgaaccttggttgcggggaaaccaattttgtatcaagattctgaatccgtacatgccctcggtagtggagacactcgagcagatgcagcgcaaacacggtggcatgcttgtcagaaacccactgtctaggaatagtacccacgaaatgtactgggtgtcctgcgggacgggaaacatcgttagcgccgtgaatatgacctcacgaatgttactgaaccggttcacaatggcgcatcgtaagcctacttatgagagagatgtcgacttgggcgctggtacccgccacgtggcagtagaacccgaggtggccaacctcgatattatcgggcagaggatagaaaatattaaacatgagcacaagtccacatggcattacgacgaggataacccttataaaacttgggcttaccacggatcttatgaagttaagccaagcggcagtgcctccagcatggtcaatggcgtggtgaagctgctaaccaaaccctgggacgtcatccctatggttacacaaatcgcaatgaccgatactacgccatttgggcagcagcgggtgttcaaggagaaagtagacacaagaacccccaaggccaaacgcggaactgctcaaattatggaagtgaccgcgaggtggctttggggttttctgtctcgaaacaagaagccgcggatatgtacaagagaggagttcacgaggaaagtccgctcaaatgccgcaatcggcgctgtgtttgttgacgagaaccagtggaatagtgccaaggaggcagtggaagatgagcgtttctgggacctcgtccagaaagaacgggagctgcacaagcaggggaaatgcgcaacctgcgtgtacaacatgatgggaaagagagaaaagaaattgggcgagtttggtaaggctaaagggtccagggccatttggtatatgtggctgggagcgcgcttcctcgagtttgaagcacttggcttcatgaatgaggatcattggttcagccgagaaaactctctgtcgggcgtagagggggagggattacacaagctgggttacatcttgcgggacatttcaaaaatccctggcgggaatatgtacgccgatgacactgctggatgggatacaagaataaccgaagacgatctccaaaacgaggccaagatcactgacattatggaaccagagcatgcactgctagctacaagcatctttaaacttacctatcagaataaggttgtgagggtccagcgccccgccaagaacggcacagtgatggatgtgatttccagacgggaccagaggggtagtgggcaagtcggaacttacggcctgaataccttcacgaacatggaagctcagctcatccgtcagatggagtctgagggcatatttctgcctagcgaattggagaccccaaacttagccgaacgagttctggattggctcgagaaatatggggtggaacgccttaagagaatggcaatttccggagacgactgtgtagtgaaacccatcgatgaccggttcgcgacagccctgactgctctaaatgatatgggtaaggtcaggaaagacatcccgcagtgggagccttcaaagggctggaacgattggcaacaggtgcccttttgcagtcaccacttccatcagctgattatgaaggacgggcgcgagatagttgtgccatgtagaaatcaggatgaactcgtcggacgggccagggtgtctcaaggcgcaggttggagcttgcgagagaccgcttgcctggggaaatcctacgcccagatgtggcagcttatgtattttcaccgtagagacctgcgcctcgcagccaacgcgatctgttcagctgtacctgttgattgggtgcccacaagccggactacctggtctattcatgcccaccatcaatggatgacgacagaagacatgttatccgtctggaatagggtgtggatcgaggaaaacccatggatggaggataagacccacgttagtagctggggagacgtgccctacctgggcaaaagagaggaccagtggtgcggctcgttgattgggctgactgcacgcgccacatgggcttccaatatccaggtcgccataaaccaggtgcggaggctcatcggaaatgaaaactatcttgattacatgacctctatgaagcgattcaaaaatgagggtgaccctgaaggcgcactgtggtga

SEQ ID NO: 14026 - RNA, 9879 nt, synthetic construct
  misc_feature 1..9879: note = derived and/or modified CDS sequence (opt3) from DENV-1__EU482482__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatggttctctcaattgtgagcctgttccccttgtgtctgagtacgacatctcagaagaccacttggttaccggtcctcctgggctcccttgggtgcaagcctctgacaatgtttttgatcgctgagaataaaatatggggaaggcgaagctggccactcaacgaaggtatcatggccgtaggcattgtgtcgatcctgctatcatctctgcttaagaacgatgttcccctcgccgggcctctgattgctggaggcatgttgatcgcatgttacgtgataagtggttccagcgccgacttatctctggagaaagcggctgaggtcagctgggaagaggaagccgagcattccggggcatcacacaatattctcgtggaagtacaggatgacggaaccatgaagatcaaagatgaggagcgcgacgatactctgacaatccttctgaaggccaccttgctagctgtgagtggcgtctatcccctgagcattccagcaacactcttcgtttggtacttctggcagaagaagaagcagcggtctggcgtgctgtgggacactccttcacccccagaagtggagagagccgtccttgatgacgggatatataggatcatgcagcgtggattactgggtcgcagccaggtgggcgttggggtatttcaagaaaacgtgttccataccatgtggcacgtcacacggggagcggtgctcatgtaccagggcaaaagattggagccgagttgggctagcgttaagaaagacctgatttcctacggtgggggatggaggctccagggctcttggaataccggcgaggaagtgcaggtcatcgccgtggagcctgggaagaaccccaaaaatgtacaaacagcaccaggaacttttaagacccccgaaggtgaggtcggcgccattgctctggatttcaagcctgggacgtcgggaagcccaatcgtgaaccgagaaggcaaaatagttggtctttatgggaatggagtggtcacaacttcaggcacctacgtgtccgccatcgcacaggctaaggccagtcaggagggccccctgcctgagattgaagacgaggtttttcggaaacgcaacttgacaatcatggatctacacccggggtctggaaagaccagaaggtatctgccagcgattgtgcgggaagccatcaaacgaaagctcagaactttaatactggcacccacccgcgtcgtggctagcgagatggccgaagctcttaagggtatgcctattaggtaccaaacaacggcagtaaaatccgagcatactggcaaggagatcgtggacctgatgtgccacgccaccttcacaatgcgtctcttgtcaccagttcgggtccccaattataacatgatcattatggatgaagcccattttaccgacccttctagcatcgctgcgagagggtacataagtactagggtgggaatgggcgaggcagccgctattttcatgacagccaccccgcccggttccgtggaagcatttccacagagcaatgccgtcatccaggatgaggaacgcgacattcctgagcgatcttggaactcagggtatgagtggatcacggatttccccggaaaaactgtatggtttgtgccatccataaagagtggcaatgacattgctaactgtctgaggaaaaatggcaagcgggttatccagctcagcaggaagacattcgataccgaataccagaaaaccaagaacaacgactgggactacgtggtcactacagatatctcggagatgggggcgaatttccgcgccgaccgtgtgattgatcctagacggtgcctgaaacccgttatccttaaggacggaccagaaagggtgattctagcaggtccgatgcctgtcaccgtggcttctgccgcacagcgccgaggcagaatagggcggaaccacaataaagagggagatcagtatatctacatgggccagcccctgaacaatgacgaggatcatgcccactggacagaagctaagatgttgttagacaacattaatactccagagggtatcatccccgccctgtttgaacctgagagggaaaagtccgcggcaattgatggggagtatcgcctcagaggcgaggccaggaaaacgttcgtagaactgatgcggcgtggagaccttccagtgtggctgagctacaaggttgcttcagagggctttcaatatagtgatcgccgatggtgcttcgacggggaaagaaacaatcaggtcctcgaggaaaacatggatgtggagatatggaccaaagagggagaaaggaagaaattgcggccccgctggctggacgccagaacatactctgaccctctagctctgagggagtttaaggagttcgcagccggtcggcgatccgtgagcggcgatctcatccttgagattgggaaactgccgcagcacttaactcagagagctcaaaatgccttggacaacctggtcatgctccataattcagaacagggaggccgcgcatataggcacgcgatggaggagctgccagataccatcgaaacacttatgctgctcgccttgattgctgttctgaccggtggggtgactttatttttcctaagtggccggggactgggcaagacgagcatcgggctcctttgtgtaatggcctcctctgtgctgttgtggatggcaagcgtcgagccccattggatagctgcctccatcattctggaatttttcctcatggtgctgcttatccctgagcccgaccgtcagagaaccccacaggataaccaactcgcatacgttgtgattggactgttgtttatgatcctgacagtcgccgctaatgagatgggtttactagaaactaccaagaaagacctgggcatagggcacgtagcggtggagaaccaccatcacgccgcaatgctcgatgttgaccttcatcctgcttcagcctggacactgtacgccgtggcaaccactattatcacacccatgatgaggcacacgattgaaaacaccactgctaatatctctttgacagccatagcgaaccaggctgccatcctgatgggactcgataagggctggccaattagtaaaatggacatcggtgtccctctgcttgcattagggtgctatagccaggtgaatccgctgaccctcaccgccgctgtcttgatgctggtggcacattacgccattatcggccccggactacaagcgaaggctacacgcgaggcccagaaacggactgcagccggcataatgaagaacccaacggttgatgggattgtggctatcgacctggatcctgtagtgtatgacgccaagttcgaaaaacagctcggacagatcatgcttctgattttgtgtaccagccaaatcctgctcatgcgaacaacttgggcactgtgcgagtccataaccttagctacaggcccccttaccactctgtgggagggttctccagggaagttttggaatacgacaattgccgtctcaatggcgaacatcttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtattatggaggttgaccgttccgaagcaaaagaggggctgaagaggggagagacaactaaacacgctgtgagtcggggcaccgccaagttgcgctggttcgtcgaacgaaatctggtgaaacctgagggtaaggtaatcgatctcggctgtgggagaggaggctggagctactattgcgccgggttaaagaaagtgacagaagttaagggatacacgaaaggcggtcccgggcacgaggaaccgataccaatggcgacctacggatggaacctggtgaaacttcattctggcaaagacgtctttttcatccctcccgagaagtgtgatactctgctatgcgacattggcgagtcctcaccaaatcccacaatcgaagaggggaggaccctccgggtgctgaaaatggtcgaaccttggttgcgcggaaaccaattttgtattaagatcctgaatccgtatatgcccagcgtggttgagactctcgagcagatgcagagaaagcacggtggcatgcttgtaaggaacccactgtcgcgaaattctacacatgaaatgtactgggtgagttgcgggaccggaaacattgtctccgctgtgaatatgacgagccggatgttactgaaccgtttcaccatggcacacagaaaacctacatatgagcgcgatgttgacttgggcgccggtactaggcacgtggctgtcgaacccgaggtggccaacctcgatatcatagggcagcggattgaaaatatcaagcatgagcacaaatcaacctggcattacgacgaggataacccttataagacatgggcataccacggatcctatgaagtaaaaccatctggcagcgccagttccatggtgaatggcgttgtcaagctgctaactaagccctgggacgtgatccctatggtgacccaaattgctatgacagataccactccatttgggcagcagagagtcttcaaagagaaggttgacacgcgcacacccaaagcgaagaggggaaccgcccaaataatggaagtgactgcaaaatggctttggggttttctgagccgaaacaagaagccgcggatctgtaccagagaggagttcacaaggaaagtacgctctaatgctgccattggcgcagtgtttgtcgacgagaaccagtggaactcagccaaggaggctgtggaagatgagcgtttctgggacctcgttcatcgggaaagagagctgcacaaacaggggaagtgcgccacgtgcgtgtacaacatgatgggaaaaagggaaaagaagttgggcgagtttggtaaagcgaaggggagtcgcgcaatctggtacatgtggctgggagcccgattcctcgagttcgaagctcttggctttatgaatgaggatcactggttctcccgggaaaacagcctgtctggcgtcgagggggagggattacataaactgggttatattttgagagacatctcgaagatacctggcgggaatatgtacgccgatgacaccgcaggatgggatactaggatcacagaagacgatctccagaacgaggctcgcattaccgacatcatggaaccagagcacgccctgctagctaaatcaatttttaaacttacttatcaaaataaagtggtaagagttcagcggcccgccaagaacggcacagtgatggatgtcatcagcaggcgtgaccagcgaggttccggacaggtgggaacctacggcctgaatacattcactaacatggaagcacaactcatacgccagatggagagtgagggcatattttctcctagcgaactggagaccccaaacttggcgaagagagtgttagattggctggaaaaatatggggtcgagcggctcaagaggatggccatctccggagacgactgtgttgtgaaacccatcgatgaccgcttcgctacggcccttaccgcactgaatgatatgggtaaggtaagaaaagacattccgcagtgggaaccttcaaagggctggaacgattggcagcaagtgcccttttgcagtcatcacttccaccagctaataatgaaggacgggcgggagatcgtcgtgccatgtaggaatcaggatgagctggttggacgagctcgtgtgtctcagggcgccggttggagcctcagagaaacagcatgcttggggaaatcctacgcccaaatgtggcagctgatgtattttcatcgccgggaccttaggctggcggctaacgccatttgttcagcagtccctgtggattggatccccactagcagaaccacatggtctattcacgcccatcaccagtggatgactaccgaggacatgctctccgtatggaatcgcgtttggatcgaagagaacccatggatggaagataagacgcatataagtagctggggagacgtgccctacttaggcaaacgggaggaccaatggtgcggctcgctgatcgggttgacagctagggccacctgggcaactaatattcaggtcgctatcaaccaggtgcgaagactgattggaaatgagaactacctcgattatatgacatccatgaagcggttcaaaaatgaatctgaccctgagggtgccctttggtga

SEQ ID NO: 14027 - RNA, 9879 nt, synthetic construct
  misc_feature 1..9879: note = derived and/or modified CDS sequence (opt3) from DENV-1__EU482485__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgggagagccgtgctggatgacggaatatataggatcatgcagcgtggtcttttaggccgcagccaggttggggtaggagtgtttcaagagaacgtcttccataccatgtggcacgtgacacggggcgcggttctgatgtaccagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtatggaaatggcgtcgtgacaacttcaggcacctacgtttccgccatcgcacaggctaaggccagtcaggaagggccccttcctgagattgaggacgaagtgtttcggaaacgcaacctgacaatcatggatttgcacccgggatctggtaagaccagaaggtatctaccagcgattgtccgggaggccatcaaacgaaagctgagaactctcatattagcacccacccgcgtggtagctagcgaaatggccgaggctctgaagggcatgcctattaggtaccaaacaacggcagtgaaatccgaacatactgggaaggagatcgttgaccttatgtgccacgccaccttcacaatgcgtctgctctcaccagtccgggtgcccaattataacatgatcattatggatgaggcccattttaccgacccttctagcatcgctgcgagaggatacataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatatgagtggatcacggatttccccggcaaaactgtgtggtttgttccatccataaagagtggcaatgacattgctaactgtttgaggaaaaatgggaagcgggtgatccagctgagcaggaagacattcgataccgagtaccagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtatatctacatgggtcagcccctaaacaatgacgaggatcatgcccactggacagaggctaagatgctgttggacaacattaatactccagaagggatcatccccgccttatttgagcctgaaagggagaagtccgcggcaattgatggcgaatatcgcctgagaggagaggccaggaaaacgttcgtggagctcatgcggcgtggcgacctgccagtttggcttagctacaaggtcgcttcagaagggtttcaatatagtgatcgccgatggtgcttcgacggagagagaaacaatcaggtgctggaagagaacatggatgtggaaatatggaccaaagagggtgagaggaagaaactccggccccgctggttggacgccagaacatactctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatataggcacgcgatggaggaactcccagataccatcgagacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggaaccccattggatagctgcctccatcattttggagtttttcctgatggttctcctgatccctgaacccgaccgtcagagaaccccacaggataaccaacttgcatacgtggtcattggtctcctgtttatgatcttgacagtagccgctaatgagatgggcctgttagagactaccaagaaagacctagggataggacacgtggcggttgaaaaccaccatcacgccgcaatgctggatgtggacctccatcctgcttcagcctggacactttacgccgtcgcaaccactattatcacacccatgatgaggcacacgattgagaacaccactgctaatatctctctgacagccatagcgaaccaggctgccatcttgatgggcctggataagggttggccaattagtaaaatggacatcggggtgcctctcctggcacttggctgctattcgcaggtcaatccgttaaccctgaccgccgctgtgctcatgttggttgcacattacgccattatcggacccggcctgcaagcgaaggctacacgcgaagcccagaaacggactgcagccgggataatgaagaacccaacggtggatggaattgtagctatcgacctagatcctgtggtctatgacgccaagttcgagaaacagctgggccagatcatgctccttattctgtgtaccagccaaatcttgctgatgcgaacaacttgggcactctgcgaatccataaccctggctacaggtcccttaaccactctttgggaggggtctccaggaaagttttggaatacgacaattgccgtttcaatggcgaacatcttcagaggcagctacctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctataagagatcagggattatggaagtggaccgttccgaggcaaaagaaggacttaagaggggcgagacaactaaacacgctgtcagtcggggtaccgccaagctgcgctggttcgtggagcgaaatttggtaaaacctgaaggcaaggtgatcgatctggggtgtggaagaggcgggtggagctactattgcgccggactcaagaaagttacagaggtgaagggctacacgaaaggtgggcccggacacgaggagccgataccaatggcgacctacggctggaacttagtcaagctgcattctggcaaagacgtgtttttcatccctcccgaaaagtgtgatactcttctgtgcgacattggggagtcctcaccaaatcccacaatcgaggaaggaaggaccctacgggtcctcaaaatggtggagccttggctgcgcggtaaccaattttgtattaagatcttgaatccgtatatgcccagcgttgtagaaactctggagcagatgcagagaaagcacggcgggatgctcgtgaggaacccactttcgcgaaattctacacatgagatgtactgggtcagttgcggaaccggcaacattgtgtccgctgttaatatgacgagccggatgctgttaaaccgtttcaccatggcacacagaaaacctacatatgaacgcgatgtggacctgggtgccgggactaggcacgtcgctgtggagcccgaagtagccaacttggatatcataggacagcggattgagaatatcaagcatgaacacaaatcaacctggcattacgacgaggataacccttataagacatgggcataccacggctcctatgaggtgaaaccatctggcagcgccagttccatggttaatggggtcgtgaagctcctgactaagccctgggacgtgatccctatggtcacccaaattgctatgacagataccactccatttggacagcagagagttttcaaagaaaaggtggacacgcgcacacccaaagcgaagaggggtaccgcccaaataatggaggtaactgcaaaatggctatggggctttcttagccgaaacaagaagccgcggatctgtaccagagaagagttcacaaggaaagtgcgctctaatgctgccattggggcagtctttgtggacgaaaaccagtggaactcagccaaggaggctgttgaggatgaacgtttctgggacctggtgcatcgggagagagaactccacaaacagggaaagtgcgccacgtgcgtctacaacatgatgggcaaaagggagaagaagctgggtgaatttgggaaagcgaagggaagtcgcgcaatctggtacatgtggttgggcgcccgattcctggagttcgaggctctcggctttatgaatgaagatcactggttctcccgggagaacagcctttctggggtggaaggagagggtctgcataaattaggctatattctgagagacatctcgaatatacctgggggaaacatgtacgccgatgacaccgcaggctgggatactaggatcacagaggacgatttgcagaatgaagctcgcattaccgacatcatggagccagaacacgccctcctggctaagtcaatttttaaactaacttatcaaaacaaggtagttagagtgcagcggcccaccaaaaatggtaccgtcatggatgtgatcagcaggcgtgaccagcgagggtccggacaggtgggcacatacggccttaacactttcaccaacatggaggcccaactgatacgccagatggaaagtgaggggatattttctcctagcgagctcgaaacgccaaatctggcagagagagtcttggattggttagaaaagtatggagttgagcggctgaagaggatggcgatctccggtgacgactgtgtggtaaaacccgtggatgaccgcttcgccaccgctctcacagcccttaacgatatgggcaaggtcagaaaagacatcccgcagtgggaaccttcaaaggggtggaatgattggcagcaagtgcccttttgcagtcatcacttccaccagctgattatgaaagacggacgggagatagttgtgccatgtaggaaccaggatgagctagtcggccgagcacgtgtgtctcagggtgctgggtggagcctgagagaaactgcctgcctcggaaagtcctacgcacaaatgtggcagttgatgtattttcatcgccgggacctgaggcttgccgcgaatgctatctgttcagccgtacctgttgattggattcccaccagcagaacaacttggtctatccacgcacatcaccagtggatgaccacggaggacatgctgtccgtgtggaaccgcgtctggattgaagagaatccatggatggaagataagacacatatcagtagctggggcgacgtgccctacctcggcaaacgggaggaccaatggtgcgggtcgttaataggactgaccgccagggctacttgggccacaaacatccaggttgcaattaatcaggtgcgaagattgatcggtaacgagaattacctggattatatgacctccatgaagcggttcaaaaacgaatctgaccctgagggcgctctctggtga

SEQ ID NO: 14028 - RNA, 9879 nt, synthetic construct
  misc_feature 1..9879: note = derived and/or modified CDS sequence (opt3) from DENV-1__EU482486__SS-prME
  source 1..9879: mol_type = other RNA
agcgtgacaatgctgctcatgcttatgcccacagcactggctttccacttgactacgagaggaggggaacctcatatgatcgtctccaagcaggaaaggggaaaatctttactgtttaagacatcagccggtgttaacatgtgcacactgattgccatggacctcggcgaactgtgtgaagatactatgacctacaaatgcccacggataacagaagtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaaactttgcattgaagccaaaatctctaatacgaccacagatagcagatgtccaactcaaggagaggctaccctggttgaagaacaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggactgttcaaacttgagaaggaagtggccgagactcagcacggtaccgttttggtgcagataaaatacgagggcacggacgctccttgcaagatcccattctcgacacaagatgaaaaaggggtaacccagaacggacgtctgattactgcgaatcccatcgtcacagacaaggagaaacctgtgaacatagaagcagagccaccctttggcgagtcttatattgttatcggtgccggggaaaaggctctcaagctgtcctggttcaaaaagggctcaagtatcggaaaaatgtttgaggccaccgcacgcggcgccagaaggatggctattcttggggatactgcctgggacttcggaagcatcggtggcgtgtttacctccgtcgggaagctggtgcatcagattttcggaacagcatacggcgtattgttttctggtgtgagctggacgatgaaaatagggatcggcgttctcctgacctggttaggactaaattcacggagtacttccctaagcatgacatgtattgcggtcggcctcgtgaccctgtaccttggggtgatggtccaggctgattctggatgcgttatcaactggaagggccgagaattgaagtgtggttcagggatcttcgtgacaaatgaggtgcacacttggaccgaacaatataaatttcaggccgacagtccgaagcgcctgagcgcagccattggaaaggcttgggaggagggcgtatgcggtataagatccgccacgaggctcgaaaacatcatgtggcggcagatttctaacgagctgaatcatatcttactggaaaacgacatgaagttcacagtcgtggttggcgatgtggtcgggattcttgcacagggcaagaagatgatccgccctcaacccatggagcacaaatactcgtggaaaagctggggcaaggctaagataatcggggccgacgtgcagaataccacttttattatcgatggaccaaacacccctgaatgtcccgacgatcagagagcgtggaatatttgggaggttgaggactatggcttcggtatctttacaactaacatatggttgaagctcagggattcctacacccaggtgtgcgaccaccgtctgatgtcagccgctattaaagatagtaaggcagtacatgccgacatggggtattggatcgaatctgagaaaaatgaaacatggaagctagctcgggccagcttcattgaggtcaagacgtgtatctggccaaaatcccacaccctgtggtcaaacggagtgctcgaaagcgagatgataatccccaagatttacggcggtcctatctctcaacataattatcgaccaggctacttcactcagacagcagggccgtggcacctgggaaaacttgagttggattttgacctgtgcgaaggcaccactgtggtcgttgatgagcactgcgggaacagaggaccctccttaaggacaaccacggtgactggcaagattatccatgaatggtgttgccgcagttgtaccctccctccactgcggttcaaaggtgaggacgggtgctggtacggaatggagataagacccgtaaaggaaaaggaggaaaatcttgtgaaaagcatggtctctgcgggctccggtgaggtggactcatttagtctgggcttgctctgtattagcatcatgatcgaagaggttatgaggtcgcgctggtcccgaaagatgctgatgacagggaccctagccgtgttctttctgctcattatgggacagctgacttggaacgatcttatccggtcttgcattatggtcggcgctaatgccagcgaccgtatggggatgggaacaacctatttggcactgatggctacattcaaaatgagacctatgtttgccgtgggcttactcttcaggcgcctgacttcacgggaggttcttctgctaaccataggtctcagtctggtggcatccgtcgaattgccaaactctctggaggaattaggggatggactcgccatgggcatcatgattctgaaacttctgacggactttcaaagctaccagttgtgggctacactcctgtccctaaccttcatcaaaactaccttttcactgcactatgcgtggaagacaatggccatggtacttagcattgtgagtctcctgcccttgtgtctgtctactacctcccagaagacgacatggttaccggttctcctgggcagccttgggtgcaaacctctgaccatgttcttgatcgcagagaataagatatggggaagaaaatcgtggccactcaacgaaggtatcatggctgtgggcattgtctcaatcctgctatctagtctgcttaagaacgatgtgcccctcgccgggcctctgattgccggaggcatgttgatcgcttgttacgtaatatccggtagctctgcagacttaagcctggagaaagccgcggaggtgtcctgggaagaggaagctgagcattcaggggccagtcacaatattctcgtcgaagttcaggatgacggaactatgaagatcaaagatgaggagagggacgatacactgaccatccttctgaaggcaactttgctagccgtgagcggcgtgtatcccctgtctattccagctacactctttgtctggtacttctggcaaaagaaaaagcagcgatccggcgtgctgtgggacaccccttcacccccagaagttgagcgcgcagtacttgatgacgggatatatcggatcatgcagagaggattactgggtaggagtcaggtgggcgtcggggtgttccaagaaaacgtttttcatacgatgtggcacgtgactcgtggagccgtcctcatgtaccagggcaaacgcttggagccgagctgggcgtccgtgaagaaagacctgatttcttacggtgggggatggcggctccagggctcgtggaataccggcgaggaagtacaggtcatcgctgtggagcctgggaagaaccccaagaatgttcaaacagccccaggaaccttcaaaacacccgaaggtgaggtgggcgcaattgccctggattttaagcctgggactagcggatcaccaatcgtcaacagagaaggcaaaatagtgggtctttatgggaatggagttgtgaccacgtccggcacatacgtcagtgctatcgcccaggcaaaggcttctcaggagggccccctgcctgagattgaagacgaggtgttcaggaaacgaaacttgactatcatggatctacacccggggagcggaaagacccggcgctatctgccagccattgtaagagaagcgatcaagaggaaactccggacattaatactggcccccacccgagtggttgcatccgagatggctgaagcccttaagggtatgcctattagataccaaactaccgctgtcaaatcagagcatacaggccgcgagatcgtggacctgatgtgccacgcaacgtttactatgaggctcttgtctccagtgcgtgtccccaattataacatgatcattatggatgaagcccatttcaccgaccctagcagtatcgccgctcgggggtacatatccacaagagtaggaatgggcgaggcggcagccatttttatgaccgctactccgcccggtagcgtggaagccttcccacagtctaatgcagttatccaggatgaggaaagggacattcctgagcgctcatggaactccgggtatgagtggatcacagattttcccggaaagaccgtgtggttcgtcccaagtataaaaagcggcaatgacattgccaactgtctgcgaaagaatggcaagagagtgatccagctctcgcggaaaacgtttgatactgaataccaaaagaccaagaacaacgactgggactacgttgtgaccaccgatatctctgagatgggggctaatttcagggcggaccgcgtcattgatcctcgtagatgcctgaagcccgtgatccttaaagacggaccagaacgggtaattctagccggtccgatgcctgtgactgttgcatccgctgcccagaggcgcggccgaatagggagaaaccacaataaggagggagatcagtatatctacatgggccagcccctgaacaatgacgaggatcatgcacactggacagaagccaagatgttgttagacaacattaataccccagagggtatcatccccgctctgttcgaacctgagcgggaaaagagcgccgcgattgatggggagtataggctccgcggcgaggcaagaaagacatttgtcgagctgatgaggcggggagaccttccagtgtggctgtcatacaaagtggccagtgagggcttccaatattctgatcgtcgctggtgctttgacggggaacgaaacaatcaggtcctcgaggaaaacatggatgttgagatatggactaaggagggagaaaggaaaaagttgaggccccggtggctggacgctcgcacgtactccgaccctctagccctgagagagttcaaagaatttgctgcaggtaggcggagcgtgtcaggcgatctcatccttgagattgggaagctgccgcagcacttaacccagcgagcccaaaatgctttggacaacctggtaatgctccataatagtgaacagggaggcagagcctatcgccacgcaatggaggagctgccagatacaatcgaaactcttatgctgctcgcgttgattgccgtgctgaccggtggggtcacattattctttctaagcggcaggggactgggcaagacctccatcgggctcctttgtgtgatggcttctagcgccctgttgtggatggcatccgttgagccccattggatagctgcctcaatcattctggagttctttctcatggtgctgcttatccctgagcccgaccggcagcgtactccacaggataaccaactcgcatacgtcgtaattggactgttgttcatgatcctgacggtggccgctaatgagatgggtttactagaaaccaccaaaaaggacctgggcatagggcacgttgcggtggagaaccaccatcacgccactatgctcgatgtcgaccttcatcctgcatctgcttggaccctgtacgccgtggccacaaccattatcactcccatgatgagacacacaattgaaaacacgaccgcaaatatcagtttgactgctatagccaaccaggcggctatcctgatgggactcgataaaggctggccaatttcgaagatggacatcggtgtccctctgcttgccttagggtgctatagccaggtgaatccgctgacactcaccgcagccgttttgatgctggtggctcattacgcaattatcggccccggactacaagccaaagcgaccagggaggctcagaagcgcacagccgcaggcataatgaagaacccaactgtagatgggattgtggccatcgacctggatcctgtcgtttatgacgctaaatttgaaaagcagctcggacagatcatgcttctgattttgtgtacgtcccaaatcctgctcatgcggaccacatgggccctgtgcgagtctataactttagcaaccggcccccttacaaccctgtgggagggttcaccagggaaattctggaatactacgattgctgtgagcatggccaacatctttcgaggatcctacctcgcgggcgccggtctagcattcagtctgatgaagtctttgggcgggggaagaaggggcacaggggctcagggagaaaccctgggcgagaaatggaagcgccagctcaatcagcttagcaagtcagagttcaacacttataaacggtccggtattatggaggtcgacagaagtgaagccaaggaggggctgcgtaggggagagaccacaaaacacgcagtgagccggggcactgctaagttgcgctggtttgtagaacgaaatctggtgaaacctgagggtaaggttatcgatctcggctgtgggagaggaggctggtcttactattgcgccgggttaaagaaagtgaccgaagtcaagggatacacaaaaggcggtcccgggcacgaggaaccgataccaatggccacgtacggatggaacctggtgaaacttcattccggcaaagacgtcttctttatccctcccgagaagtgtgataccctgctatgcgacattggcgagtcaagcccaaatcccactatcgaagaggggaggacactccgggtgctgaaaatggttgaaccttggttgcgcggaaaccaattctgtattaagatcctgaatccgtatatgccctcggtagtggagaccctcgagcagatgcagagaaagcacggtggcatgcttgtcaggaacccactgtctcgaaatagtactcatgaaatgtactgggtgtcctgcgggacaggaaacattgttagcgcggtgaatatgacctcacggatgttactgaaccgttttacgatggctcacagaaaacctacctatgagcgcgatgtcgacttgggcgcaggtacaaggcacgtggccgtagaacccgaggtggctaacctcgatatcatagggcagcggattgaaaatatcaagcatgagcacaaatccacttggcattacgacgaggataacccttataagacctgggcctaccacggatcttatgaagttaaaccaagcggcagtgcatccagcatggtcaatggcgtggtgaagctgctaacaaagccctgggacgtcatccctatggttactcaaattgccatgaccgatacaaccccattcgggcagcagagagtgtttaaagagaaggtagacactcgcacgcccaaagctaagaggggaacagcgcaaataatggaagtgaccgcccgatggctttggggtttcctgtctcggaacaaaaagccgagaatctgtactagggaggaatttacccgcaaggtccgttcaaatgcagctattggcgccgtgttcgttgacgagaaccagtggaatagtgcaaaagaggccgtggaagatgagcggttttgggacctcgtccatagagaaagggagctgcacaagcaggggaaatgcgctacatgcgtgtacaacatgatgggaaagcgcgagaaaaagttgggcgagttcggtaaggccaaagggtcccgagcgatctggtacatgtggctgggagcacggtttctcgagttcgaagcccttggcttcatgaatgaggatcactggtttagcagagaaaactctctgtcgggcgtagagggggagggattacataagctgggttatattttgagggacatctcaaaaatacctggcgggaatatgtacgctgatgacacggccggatgggatacccgcatcactgaagacgatctccagaacgaggcaaagattacagacatcatggaaccagagcacgctctgctagccaccagcattttcaaacttacttatcaaaataaggttgtgagagtccagcggcccgctaggaacggcacagtgatggatgtgatctcccgtcgagaccagcgcggtagtgggcaggtcggaacctacggcctgaatacatttactaacatggaagcccaactcataagacagatggagtctgagggcattttcagcccttccgaactggagaccccaaacttggcagaacgggttttagattggctggagaaacatggggtggaaaggctcaagcgcatggcgatctcaggagacgactgtgtagtgaagcccatcgatgacagatttgccacggctcttagtgccctgaatgatatgggtaaagtccggaaggacattccgcagtgggagccttctaaaggctggaacgattggcagcaagtgcccttctgcagccaccactttcatcagctaataatgaaggacgggagggagatcgttgtgccatgtcgaaatcaggatgaactggtcggacgtgcaagagtgtcccagggcgctggttggtcactccgcgagaccgcctgcttggggaaaagctatgcacaaatgtggcagctgatgtacttccaccggagggaccttagactggccgcgaacgctatttgttctgccgtacctgttgattgggtgcccacatcccgcactacctggagtatccatgcacaccatcagtggatgacaactgaagacatgctcagcgtctggaatcgggtgtggattgaggaaaacccatggatggaggataagacccacatctcgtcctggggagacgttccctatttaggcaagagggaggaccaatggtgcggctctctgatagggttgacggcccgagctacatgggccaccaatatccaggtggcaattaaccaggtcagacggctgatcggaaatgaaaactacctcgattacatgacttcaatgaaaaggtttaagaatgacagcgatcctgagggtgctctttggtga

SEQ ID NO: 14029 - RNA, 9879 nt, synthetic construct
  misc_feature 1..9879: note = derived and/or modified CDS sequence (opt3) from DENV-1__EU482487__SS-prME
  source 1..9879: mol_type = other RNA
tccgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcccacacgcaggtctgcgaccaccgtctcatgtcagctgcaatcaaagatagtaaggccgtgcatgctgacatggggtattggattgaatctgccaaaaatgagacctggaagctggcacgggcgagcttcatcgaagttaagacttgtatatggccaaaatcccacacactatggtcaaacggagtgctggagagcgaaatgatcattcccaagatctacggcggtcctatttctcaacataattatcgaccaggctacttcacccagactgccgggccgtggcacctcggaaaactggagcttgattttgacttgtgcgagggcacaaccgtagtcgtggatgaacactgcgggaacagaggaccctccctgaggacgactaccgtgacaggcaagatcatacatgagtggtgttgccgcagttgtaccttacctccactccggttcagaggtgaagacgggtgctggtacggaatggagattaggcccgtcaaagagaaggaagagaatctggttaagagcatggtgtctgctggctccggtgaagtagactcatttagtcttggcctgttgtgtatcagcatcatgattgaggaagtgatgcgctcgcgatggtcccggaaaatgctcatgactgggacactggccgtcttctttctactgatcatgggacagctcacctggaacgatctgattcgtctttgcataatggtgggcgcaaatgcttctgacagaatggggatgggaacaacttatttggccctgatggcaaccttcaagatgaggcctatgtttgccgttggcttactcttccgccggctgacgagcagagaggtgcttctgctaacaatcggtctctcactggtcgctagtgtggagttgccaaactccctggaagagttaggggatggactcgcgatgggcattatgatcctgaaacttctgaccgactttcaatctcaccagttgtgggccactctcctgagcctaaccttcattaagacaactttttccctgcattacgcatggaaaaccatggctatggttctttcaatcgtgagcctcttccccctgtgtttgagtacgacatctcagaagaccacttggctgccggtcttactcggctccctggggtgcaagcctcttacaatgtttctgatagccgaaaataaaatctggggaaggcgaagctggccattgaacgagggtattatggccgtaggcatcgtgtcgattctcctgtcatctctactgaagaacgatgttccccttgctgggcctctcatcgcaggaggcatgctgatagcctgttatgtgattagtggttccagcgcggacttgtctttagaaaaagctgccgaggtcagctgggaggaagaggcagaacactccggggcctcacataatatcctggtggaggtacaggatgacggaaccatgaagatcaaagatgaggaacgcgacgatactctcacaattctgcttaaggctaccctgttggcagtgagtggcgtctaccccctaagcataccagccacgctgttcgtttggtatttctggcagaaaaagaagcagcggtctggcgtgctctgggacactccttcacccccagaggtggaaagagcggtcctggatgacgggatctacaggattatgcagcgtggacttttaggtcgcagccaggtgggcgttggggtatttcaagagaacgtgttccacaccatgtggcacgtcacacggggagctgtgctgatgtatcagggcaaaagactcgaaccgagttgggccagcgttaagaaagacttgatctcctacggtgggggatggaggctgcagggctcttggaataccggcgaggaggtgcaggtcattgcagtggaacctgggaagaaccccaaaaatgtacaaacagccccaggaacttttaagacccccgagggtgaagtcggcgctatcgccctcgatttcaagcctgggacgtcgggaagcccaatagtgaaccgagagggcaaaatcgttggtctgtacgggaatggagtggtcacaacttcaggcacctatgtgtccgcaattgctcaggccaaggcgagtcaggaaggcccccttcctgagatcgaggacgaagtttttcggaaacgcaacctgacaattatggatttgcatccggggtctggaaagaccagaaggtacctaccagccatcgtgcgggaggcaataaaacgaaagctgagaactctcattttagctcccacccgcgtcgtggccagcgaaatggctgaggcactgaagggtatgcctatcaggtatcaaacaacggccgtaaaatccgaacacactggcaaggagatcgtggaccttatgtgccatgccaccttcacaatgcgtctgctctcaccagttcgggtccccaattacaacatgattatcatggatgaggctcactttaccgacccttctagcatagcggcaagagggtatattagtactagggtgggaatgggcgaagccgctgccatcttcatgacagcaaccccgcccggttccgtggaggcctttccacagagcaatgctgtcattcaggatgaggaacgcgacatccctgaacgatcttggaactcagggtacgagtggataacggatttccccggaaaaactgtatggtttgtgccatccattaagagtggcaatgacatcgcgaactgtttgaggaaaaatggcaagcgggttatccagctgagcaggaagacattcgataccgagtatcagaaaaccaagaacaacgactgggactacgtggtcactacagatatttcggaaatgggggccaatttccgcgcagaccgtgtgatcgatcctagacggtgcctcaaacccgttattctgaaggacggaccagagagggtgatacttgctggtccgatgcctgtcaccgtggcctctgcagcccagcgccgaggcagaatcgggcggaaccataataaagaaggagatcagtacatttatatgggccagcccctaaacaatgacgaggatcacgctcactggacagaggccaagatgctgttggacaacatcaatactccagaaggtatcattcccgcgttatttgagcctgaaagggagaagtccgcagccatagatggggaataccgcctgagaggcgaggctaggaaaacgttcgtagagctcatgcggcgtggagacctgccagtgtggcttagctataaggttgcctcagaaggctttcaatacagtgatcgccgatggtgcttcgacggggagagaaacaatcaggtcctggaagagaacatggatgtggaaatctggaccaaagagggagagaggaagaaactccggccccgctggttggacgctagaacatattctgaccctctggcactaagggaatttaaggagttcgccgctggtcggcgatccgtgagcggcgatctgattctcgaaatcgggaaacttccgcagcatctgactcagagagcccaaaatgcattagacaacttggtcatgctgcacaattcagagcagggaggccgcgcgtacaggcatgccatggaggaactcccagataccattgagacactgatgcttctggctctcatcgccgttttgaccggtggggtgactctgtttttcttaagtggccggggactaggcaagacgagcatagggctgctctgtgtaatggcatcctctgtgcttctgtggatggctagcgtcgaaccccactggatcgccgcatccattatcttggagtttttcctgatggtgctcctgattcctgaacccgaccgtcagagaaccccacaggataaccaacttgcctatgttgtgatcggactcctgtttatgatattgacagtcgctgcgaatgagatgggtctgttagagactaccaagaaagacctaggcattgggcacgccgcagtagaaaaccatcaccatgctgccatgctggatgtggacctccaccctgcctcagcatggacactttacgctgttgccaccactatcattacacccatgatgaggcatacgatcgagaacaccactgcgaatatatctctgacagctatcgccaaccaggcagccattttgatgggactggataagggctggccaatcagtaaaatggacattggtgtgcctctcctggctcttgggtgctactcgcaggtcaatccgttaaccctgaccgcagccgtgctcatgttggtcgcgcactatgctatcataggccccggactgcaagccaaggcaacacgcgaagcccagaaacggactgctgccggcattatgaagaacccaacggtggatgggatcgttgcaatcgacctagatcctgtggtatacgacgctaagttcgagaaacagctgggacagattatgctccttatcctgtgtaccagccaaatattgctgatgcgaacaacttgggccctctgcgaatccattaccctggcgacaggccccttaaccactctttgggagggttctccagggaagttttggaatacgacaatcgccgtgtcaatggcaaacattttcagaggaagctatctggctggcgccggtctcgcattctccctaatgaaaagtctgggcgggggaaggcgcggcaccggggctcagggagagactttgggcgaaaagtggaaacggcagctgaatcagctctctaagagcgagtttaacacctacaagagatcaggtatcatggaagtcgaccgttccgaggccaaagaagggcttaagaggggagagacaactaaacacgccgttagtcggggcaccgcgaagctgcgctggttcgtggagcgaaatttggtcaaacctgaaggtaaggtgatagatctgggctgtgggagaggaggctggagctattactgcgctgggctcaagaaagtaacagaggtgaagggatatacgaaaggcggtcccgggcatgaggagccgatcccaatggcaacctacggatggaacttagttaagctgcactctggcaaagacgtgtttttcattcctcccgaaaagtgtgatactcttctgtgcgacatcggcgagtcctcaccaaatcccacaattgaggaagggaggaccctacgggtcctcaaaatggtggagccttggctgcgcggaaaccaattttgtatcaagattttgaatccgtacatgcccagcgtcgtggaaactctggagcagatgcagagaaagcatggtggcatgctcgttaggaacccactttcgcgaaattctacacacgagatgtattgggtaagttgcgggaccggaaacatcgtgtccgccgtcaatatgacgagccggatgctgttaaaccgtttcaccatggctcacagaaaacctacatacgaacgcgatgtggacctgggcgccggtactaggcatgttgcagtggagcccgaagtcgccaacttggatataattgggcagcggatcgagaatatcaagcacgaacataaatcaacctggcactatgacgaggataacccttacaagacatgggcttatcatggatcctacgaggtgaaaccatctggcagcgcgagttccatggtaaatggcgtggttaagctcctgactaagccctgggacgtcattcctatggtgacccaaatagccatgacagataccactccatttgggcagcagagagtgttcaaagaaaaggtcgacacgcgcacacccaaagcaaagaggggaaccgctcaaatcatggaggttactgccaaatggctatggggttttcttagccgaaacaagaagccgcggatttgtaccagagaagagttcacaaggaaagtgcgctctaatgcagccatcggcgctgtatttgtggacgaaaaccagtggaactcagccaaggaggcggtcgaggatgaacgtttctgggacctggtgcaccgggagagagaactccacaaacaggggaagtgcgcaacgtgcgtttataacatgatgggaaaaagggagaagaagctgggcgaatttggtaaagccaaggggagtcgcgctatttggtacatgtggttgggagcccgattcctggagttcgaggcactcggctttatgaatgaagatcattggttctcccgggagaacagcctttctggcgtggaaggggagggactgcacaaattaggttacatcctgagagacatatcgaagatccctggcgggaatatgtatgctgatgacaccgccggatgggatactaggattacagaggacgatttgcagaacgaagctcgcatcaccgacattatggagccagaacatgccctcctggcaaaatcaatctttaagctaacttaccaaaataaagtcgtgagagtacagcggcccgcgaagaacggcacagttatggatgtgataagcaggcgtgaccagcgaggttccgggcaggtcggaacctatggccttaatacattcactaacatggaggcccaactgattcgccagatggaaagtgagggcatcttttctcctagcgagctcgaaaccccaaacctggctgagagagtgttggattggttaaagaaatacggggtggaacggctgaagaggatggccatctccggagacgactgtgtcgttaaacccattgatgaccgcttcgcaacggctctcaccgcccttaatgatatgggtaaggtgagaaaagacataccgcagtgggagccttcaaagggctggaacgattggcagcaagtacccttttgcagtcaccacttccatcagctgatcatgaaggacgggcgggaaattgtggtcccatgtaggaatcaggatgagctagtgggacgagcacgtgtttctcagggcgccggttggagcctgagagagacagcgtgcctcgggaaatcctatgctcaaatgtggcagttgatgtactttcaccgccgggacctgaggcttgccgcaaacgccatctgttcagctgtgcctgtcgattggattcccactagcagaaccacatggtctatccatgcccaccatcagtggatgactaccgaagacatgctgtccgtgtggaatcgcgtatggatagaggaaaacccatggatggaggataagacgcacatcagtagctggggagacgttccctatctcggcaaacgggaagaccaatggtgcggctcgttaattgggctgacagcaagggctacctgggccactaatatccaggtggcgattaaccaggtccgaagattgatcggaaatgagaactacctggattacatgacatccatgaagcggttcaaaaatgagggtgaccctgaaggcgctctctggtga

SEQ ID NO: 14030 - RNA, 9879 nt, synthetic construct
  misc_feature 1..9879: note = derived and/or modified CDS sequence (opt3) from DENV-1__EU482488__SS-prME
  source 1..9879: mol_type = other RNA
agcgtgaccatgctgctcatgcttatgcccacagcactggctttccacttgactacgagaggaggggaacctcatatgatcgtctccaagcaggaaagagggaaatctttactgtttaagacctcagccggtgttaatatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctagcaccgagatccagctgacagactacggggccctcacccttgattgttctccaaggactggactggacttcaacgaaatggtcttgctaacaatgaaggagaaatcctggctggtgcataagcagtggtttctcgatctgccgcttccctggacgtcaggcgcaagcaccagtcaagagacttggaatcggcaggacctgttggtaacattcaaaaccgctcacgccaagaagcaggaagttgtggtcctcggttctcaagagggggctatgcacacagccctgactggcgcaaccgaaatccagacgtccggaaccacaactatttttgccggccatttaaaatgccgtctgaagatggataaactaaccctcaaggggatgagctatgtgatgtgtacaggatcgttcaaactggagaaggaagtcgctgagactcagcacggtaccgtgcttgttcagataaagtacgagggcacggacgcgccttgcaaaatcccattctctacacaagatgaaaagggggtgacccagaacggacgcttgattactgcaaatcccatcgtaacagacaaagagaagcctgtcaacatagaagccgagccaccctttggcgagtcctatattgtgatcggtgctggggaaaaagccctgaagctctcatggttcaagaaaggcagtagcatcggaaagatgtttgaggcaaccgccagaggcgctaggcggatggccattctgggggatactgcatgggacttcggatccatcggtggcgtttttacctctgtggggaaacttgtccatcagattttcggaacagcgtacggcgtgctgtttagcggtgtatcatggacgatgaagatagggatcggcgtgttgctcacctggctgggattaaatagtcgatccactagcctgtctatgacatgtattgctgttggcctagtcaccctctacctgggggtgatggtgcaggccgattcaggatgcgtcatcaactggaaaggccgcgaacttaagtgtggtagtgggatcttcgttacaaatgaggtgcacacttggaccgaacaatataagtttcaggcagacagcccgaaaagattgtccgccgctattggaaaggcctgggaggagggcgtgtgcggtataaggtctgcaacgcggctggaaaacatcatgtggaaacagatttcgaacgagctcaatcatatcctgttagaaaacgacatgaagctgacagtagtcgtgggcgatgttgctgggattcttgcccagggcaagaaaatgatccgccctcaacccatggagtacaaatatagctggaagtcctggggcaaggcgaaaataatcggggccgacgtgcagaataccactttcattatcgatggaccaaacacccctgaatgtcccgacgatcagagagcttggaatatttgggaggtcgaggactacggctttggtatcttcacaactaacatatggttgaagctcagggattcatatacccaggtgtgcgaccaccgtctgatgagtgcagccattaaagattctaaggctgttcacgccgacatggggtactggatcgaaagcgagaaaaatgaaacatggaagctagcacgggcgtcctttattgaggtgaagacgtgtatctggccaaaatcacataccctgtggagcaacggagtactcgaatctgagatgataatccccaagatttatggcggtcctatctcccaacacaattaccgaccaggctacttcactcagacagccgggccgtggcatctgggaaaacttgagttggatttcgacctgtgcgaaggcaccactgtcgtggtggatgagcactgcgggaacagaggacccagtttaaggacaaccacggtcactggcaagattatccacgaatggtgttgccgcagctgtaccctccctccactgcggtttaaaggtgaggacgggtgctggtatggaatggagataagacccgttaaggaaaaggaggaaaatcttgtgaaatctatggtatccgctggctcaggtgaggtggacagtttcagcctgggcttgctctgtatttcgatcatgatcgaagaggtcatgaggtcccgctggtctcgaaagatgctgatgacagggaccctagccgtgtttttcctgctcattatgggacagctgacttggaacgatcttatccggttgtgcattatggttggcgcaaatgctagcgaccgtatggggatgggaacaacctacctggccttaatggcaacatttaaaatgagacctatgttcgccgtgggcctcctgtttaggcgccttacttcacgggaggtcctgctactcaccataggtctgagtttggtggcttccgttgaactgccaaactctttagaggaactcggggatggactggcgatgggcatcatgattcttaagctgttgacggacttccaaagccatcagctctgggccacactgctatccctgacctttatcagaactaccttctcacttcactatgcatggaaaacaatggctatggtgctcagcattgtcagtctgtttcccttgtgtctgtctactacctcccagaagacgacatggttaccggtactcctgggcagccttgggtgcaagcctctgaccatgttcttgatcgccgagaataaaatatggggaaggaagtcgtggccactcaacgaaggtatcatggccgtgggcattgtttcaatcctgctatctagtctgcttaaaaacgatgtgcccctcgctgggcctctgattgcaggaggcatgttgatcgcctgttacgtcatatccggtagctctgcggacttaagcctggagaaggctgccgaggtgtcctgggaagaggaagcagagcattcaggggccagtcacaatattctcgtagaagtgcaggatgacggaactatgaaaatcaaggatgaggagcgagacgatacactgaccatccttctgaaagctactttgctagcagtcagcggcgtttatcccctgtctattccagccacactctttgtgtggtacttctggcaaaagaagaaacagcgctccggcgtgctgtgggacaccccttcacccccagaagtcgagcgggcggtgcttgatgacgggatatatagaatcatgcagaggggattactgggtcgtagtcaggttggcgtaggggtgttccaagaaaacgtctttcatacgatgtggcacgtgactcgcggagctgttctcatgtaccagggcaagcggttggagccgagctgggcctccgtgaaaaaggacctgatttcttacggtgggggatggagactccagggctcgtggaataccggcgaggaagtccaggtgatcgcagtagagcctgggaaaaaccccaagaatgtccaaacagccccaggaaccttcaagacaagcgaaggtgaggtgggcgctattgccctggattttaaacccgggacttcaggatcccctatcgttaacagggaaggcaagatagtgggtctttatgggaatggagtcgtgaccacgagtggcacatacgtttctgcaatcgctcaggccaaagcgagccaggagggcccactgcccgagattgaagacgaggtgttccgaaagcggaacttgactatcatggatctacaccctgggtccggaaaaacccgcagatatctgccggccattgtcagggaagcaatcaagcggcgactcagaacattaatactggctccaacccgcgtggtagcctcagagatggctgaagcacttaagggtatgcccattaggtaccaaactaccgccgtgaaatctgagcatacaggcaaggagatcgttgacctgatgtgccacgccacgtttactatgcgtctcttgagccctgtccgggtgccaaattataacatgatcattatggatgaagctcatttcaccgaccccagttccatcgcggcaagagggtacataagcacaagggtgggaatgggcgaggccgctgccatttttatgaccgcaactcctccgggttctgtcgaagccttcccccagtcaaatgctgtaatccaggatgaggaacgcgacattccagagcgatcctggaacagtgggtatgagtggatcacagattttcctggaaaaaccgtgtggttcgttcccagcataaagtcgggcaatgacattgcgaactgtctgaggaaaaatggcaagcgggtgatccagctctctaggaagacgtttgatactgaataccagaaaacaaagaacaacgactgggactacgtcgtgaccaccgatatctccgagatgggggccaatttccgcgcagaccgtgttattgatccaagacggtgcctgaaacctgtgatccttaaggacggacccgaaagggtcattctagctggtccaatgccggtgactgtagccagcgcagcccagcgccgaggcagaatagggcggaaccacaataaagagggagatcagtatatctacatgggccagcctctgaacaatgacgaggatcatgctcactggacagaagccaagatgttgttagacaacattaatacccccgagggtatcatcccagcgctgttcgaacccgagagggaaaagtcagcagccattgatggggagtatcgcctcagaggcgaggctaggaaaacatttgtggaactgatgcggcgtggagaccttcctgtttggctgagttacaaggtcgcctctgagggcttccaatattccgatcgccgatggtgctttgacggggaaagaaacaatcaggtgctcgaggaaaacatggatgtggagatatggactaaagagggagaaaggaagaaattgcggccacgctggctggacgctagaacgtacagcgaccccctagcactgagggagttcaaggaatttgccgctggtcggcgatcagtcagtggcgatctcatccttgagattgggaaactgcctcagcacttaacccagagagcccaaaatgcattggacaacctggttatgctccataatagcgaacagggaggccgcgcgtataggcacgccatggaggagctgccggatacaatcgaaactcttatgctgctcgctttgattgccgtgctgaccggtggggtaacattattctttctatccggccggggactgggcaagacctctatcgggctcctttgtgtgatggcaagctccgtcctgttgtggatggcttcagtggagccacattggatagccgcatctatcattctggagttctttctcatggttctgcttatccccgagcctgaccgtcagagaactccccaggataaccaactcgcctacgtggtcattggactgttgttcatgatcctgacggtagctgcgaatgagatgggtttactagaaaccacaaagaaagacctgggcatagggcacgtggccgttgagaaccaccatcacgcagctatgctcgatgtggaccttcatccagccagtgcctggactctgtacgcagtcgctaccacaattatcacccctatgatgaggcacactattgaaaacacaacggccaatatctcgttgaccgcgatagctaaccaggccgcaatcctgatgggactcgataagggctggcccattagcaaaatggacatcggtgtgccactgcttgccttagggtgctattcccaggtcaatcctctgactctcacagctgcagtgttgatgctggttgcccattacgcgattatcggcccgggactacaagctaaggccacccgcgaggcacagaaacggaccgccgctggcataatgaagaaccccacagtggatgggattgtagccatcgacctggatccagtggtctatgacgcaaagtttgaaaaacagctcggacagatcatgcttctgattttgtgtacttctcaaatcctgctcatgcgaacgacctgggctctgtgcgagtcaataacattagccactggccctcttaccacactgtgggagggtagccccgggaagttctggaataccactattgcggtttccatggccaacatctttagaggaagttacctcgcaggcgctggtctagccttctctctgatgaagtcattgggcgggggaaggcgcggcacgggggcacagggagaaacactgggcgagaagtggaaacggcagctcaatcagcttagcaagtccgagttcaacacctataagagaagtggtattatggaggtggaccgtagcgaagctaaagaggggctgaagaggggagagactaccaaacacgccgtctctcggggcacagccaagttgcgctggtttgtggaacgaaatctggtaaaaccagagggtaaggtgatcgatctcggctgtgggagaggaggctggtcctactattgcgcggggttaaagaaagttactgaagtgaagggatacaccaaaggcggtcctgggcacgaggaacccataccgatggctacatacggatggaacctggtcaaacttcattcaggcaaagacgtgttctttatcccacctgagaagtgtgatacgctgctatgcgacattggcgagagctcgcccaatccaaccatcgaagaggggaggactctccgggtcctgaaaatggtggaaccctggttgcgcggaaaccaattctgtattaagatcctgaatccttatatgccgtctgttgtagagacactcgagcagatgcagagaaagcacggtggcatgcttgtgaggaaccccctgagtcgaaattccacccatgaaatgtactgggtcagctgcgggactggaaacattgtgtcagcagttaatatgacatcccggatgttactgaaccgttttaccatggcccacagaaaaccaacgtatgagcgcgatgtggacttgggcgctggtaccaggcacgtcgccgtggaacctgaggtagcaaacctcgatatcatagggcagcggattgaaaatatcaagcatgagcacaaatctacatggcattacgacgaggataacccctataagacttgggcctaccacggaagctatgaagtgaaacctagtggctccgctagctctatggttaatggcgtcgtgaagctgctaaccaagccatgggacgtgatccccatggtcacacaaattgcgatgactgataccacacctttcgggcagcagagagtttttaaagagaaggtggacacccgcactccaaaagccaagaggggaacggcacaaataatggaagtaacagctaaatggctttggggtttcctgtcacgaaacaagaagccccggatctgtaccagagaggaatttactaggaaagtgcgcagtaatgccgcaattggcgccgtcttcgtggacgagaaccagtggaactccgctaaggaggccgttgaagatgagcgtttttgggacctcgtgcatcgggaaagagagctgcacaaacaggggaagtgcgcgacctgcgtctacaacatgatgggaaaaagggaaaagaagttgggcgagttcggtaaagcaaaggggagccgcgccatctggtacatgtggctgggagctcgatttctcgagttcgaagcccttggcttcatgaatgaggatcactggttttctcgggaaaactcgctgtcaggcgtggagggggagggattacataaactgggttatattttgagagacatcagcaagataccgggcgggaatatgtacgcagatgacacagctggatgggatacgaggatcaccgaagacgatctccagaacgaggccaaaattactgacatcatggaacctgagcacgctctgctagccaagtccattttcaaacttacatatcaaaataaggtagttcgcgtgcagagaccagcaaagaacggcaccgtcatggatgtgatcagtcggagggaccagcgtggttctggacaggtgggaacttacggcctgaatacatttaccaacatggaagcgcaactcatacgacagatggagagcgagggcattttctccccctcagaactggagacacctaacttggccgggcgcgtcttagattggctggaaaaacatggagttgagagactcaagcggatggctatcagtggtgacgactgtgtggtaaaaccaatcgatgacaggtttgccactgcacttaccgctctgaatgatatgggcaaggtgcgcaaagacattccccagtgggaaccgtctaaggggtggaacgattggcagcaagtccctttctgcagccaccactttcatcagctaataatgaaggacggaagagagatcgtggttccctgtcggaatcaggatgagctggtgggcagggcccgagtctcccagggtgcagggtggtcactccgtgaaacggcctgcttgggaaaaagctatgcgcaaatgtggcagctgatgtacttccacagacgcgaccttcggctggctgccaacgcaatttgttctgccgtgccagtagattgggttcctacctccaggacaacttggagtatccatgctcaccatcagtggatgaccacagaggacatgctcagcgtgtggaatagagtctggattgaagagaacccctggatggaagataagactcacgtgtcgtcctgggaggacgttccatatttaggcaaacgcgaggaccaatggtgcggctctctgatcgggttgaccgcccgggcaacgtgggctacaaatatacaggtggccatcaaccaggtcaggcgactgctcggaaatgaaaactaccttgattacatgacctcaatgaagagatttaaaaatgagagcgaccccgaaggtgcgctgtggtga

SEQ ID NO: 14031 - RNA, 9879 nt, synthetic construct
  misc_feature 1..9879: note = derived and/or modified CDS sequence (opt3) from DENV-1__EU482489__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacactgattgctctgtttctcgcacatgccatcggcacctcgattacgcagaagggcatcatattcatcttactgatgcttgttactccatcaatggctatgcgctgcgtggggattggaagcagagattttgtcgagggtttgagtggcgccacatgggtggacgtagttctggagcacgggtcctgtgtgaccactatggcgaaggataaacccacactagacatcgaactcctgaagaccgaggtcacgaaccctgcagtgcttaggaaactgtgcattgaagccaagatctctaataccacaactgatagccggtgtccaacccaaggagaggctacattggtggaagaacaagacgccaacttcgtctgccgccgaacttttgttgatagaggctggggtaatgggtgtggactcttcggcaaaggctccctgataacctgcgcaaagtttaagtgcgtgacaaaattagaggggaagattgtacagtacgaaaacctgaaatattcagtgatcgtcaccgtgcacactggagaccagcatcaagttggtaatgagagtacggaacacggcacaaccgctactattacaccccaagcccctaccaccgagatccagctcactgactacggggcgcttacactggattgtagcccaaggacgggattggacttcaacgaaatggtgctactgaccatgaaggagaaatcttggctcgtccataagcagtggtttctggatcttccgctgccctggacttccggcgcctcaacaagccaagagacctggaatcggcaggacttgctcgtgacattcaaaactgcacacgctaagaagcaggaagtagttgtgctgggtagtcaagagggggccatgcacaccgctttaacgggcgccaccgaaatccagacatctggaactaccacaatttttgcaggccatctgaaatgccgtctaaagatggataaactcactctgaaggggatgtcctatgtcatgtgtaccggtagcttcaaacttgagaaggaattggccgagacgcagcacggaacagtgctggtccagataaagtacgagggcaccgacgctccttgcaaaatcccattctcgactcaagatgaaaagggggtgacacagaacggacgcctcattaccgcgaatcccatcgttactgacaaagagaagcctgtgaacatagaagcagagccaccctttggcgagtcttatattgtaatcggtgccggggaaaaagctctgaaactttcctggttcaagaaaggctcaagtatcggaaagatgtttgaggccaccgcaagaggcgccaggcggatggctattctgggggatacagcctgggacttcggaagcatcggtggcgtctttacgtccgtggggaaattggttcatcagattttcggaaccgcatacggcgtgctcttttctggtgtcagctggactatgaagatagggatcggcgtgctgttaacatggctgggactaaattcacgaagtacctccctcagcatgacatgtattgcggtaggcctggtgactctttacttgggggttatggtccaggctgattctggatgcgtgatcaactggaaaggccgcgaactgaagtgtggttcagggatcttcgtgaccaatgaggtccacacgtggacagaacaatataagtttcaggccgacagtccgaaaagactcagcgcagccattggaaaggcttgggaggagggcgtttgcggtataaggtccgccacccggctggaaaacatcatgtggaaacagatttctaacgagttaaatcatatcctgcttgaaaacgacatgaagttcactgtggtggtaggcgatgtcgcagggattttggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggttgaggactacggcttcggtatctttaccacaaacatatggctcaagctgagggattcctatacacaggtgtgcgaccaccgtctaatgtcagctgcaattaaagatagtaaggccgtccacgctgacatggggtactggatcgaatctgagaaaaatgaaacctggaagctggcccgggcatccttcattgaggtgaagacttgtatctggccaaaatcccatacactctggtcaaacggagttctggaaagcgagatgataatccccaagatttatggcggtcctatctctcaacacaattaccgaccaggctacttcacccagactgcggggccgtggcatcttggaaaattggagctggattttgacttatgcgaaggcacaaccgtggtagtcgatgagcactgcgggaacagaggaccctccctcaggacgactaccgtgacaggcaagattatccacgaatggtgttgccgcagttgtaccctgcctccacttcggttcagaggtgaggacgggtgctggtatggaatggagataaggcccgtgaaagaaaaggaggaaaatctggtcaagagcatggtttctgccggctccggtgaggtggactcatttagtttgggcctcctgtgtattagcatcatgatcgaagaggtaatgcgctcgcgatggtcccggaaaatgctaatgactgggacactggctgtgttctttctcctgattatgggacagcttacctggaacgatttgatccgtctgtgcattatggtcggcgccaatgcatctgacagaatggggatgggaacaacttacttagctctcatggccaccttcaagatgaggcctatgtttgcagtgggcctgcttttccgccggctgacgagcagagaggttctactcctgacaataggtttgtcactggtggccagtgtcgaattaccaaactccctcgaggaactgggggatggacttgctatgggcatcatgattctgaaattgctcaccgactttcaatctcatcagctgtgggcgactctactgagccttaccttcatcaagacaactttttccctccactatgcctggaaaaccatggcaatggtgctgtcaattgttagcttgttccccctgtgtttaagtacgacatctcagaagaccacttggctcccggtgctgcttggctccctggggtgcaagcctttgacaatgtttctcatcgctgagaataaaatatggggaaggcgaagctggccactgaacgaaggtatcatggccgtcggcattgtatcgatcctactgtcatctcttctcaagaacgatgtgcccctggccgggcctttgattgctggaggcatgttaatcgcatgttacgttataagtggttccagcgccgacctgtctctcgagaaagcggctgaggtgagctgggaagaggaagccgagcattccggggcatcacacaatattctggtcgaagtgcaggatgacggaaccatgaagatcaaagatgaggagcgcgacgatactcttacaatcctgttgaaggccaccctactggctgtaagtggcgtgtatcccctcagcattccagcaacgctgttcgtctggtacttctggcagaaaaagaagcagcggtctggcgttctttgggacactccttcacccccagaagtggagagagccgtgttagatgacgggatatataggatcatgcagcgtggactgctcggtcgcagccaggtcggcgtgggggtttttcaagaaaacgtattccataccatgtggcacgtgacacggggagcggtcttgatgtaccagggcaaaagactggagccgagttgggctagcgtgaagaaagacctcatttcctacggtgggggatggaggctgcagggctcttggaataccggcgaggaagttcaggtgatcgccgtcgagcctgggaagaaccccaaaaatgtgcaaacagcaccaggaacttttaagacccccgaaggtgaggtaggcgccattgctcttgatttcaagcctgggacgtcgggaagcccaatcgtcaaccgagaaggcaaaatagtgggtctgtatgggaatggagttgtgacaacttcaggcacctacgtctccgccatcgcacaggctaaggccagtcaggagggccccttgcctgagattgaagacgaggtgtttcggaaacgcaacctaacaatcatggatctgcacccggggtctggaaagaccagaaggtatctcccagcgattgttcgggaagccatcaaacgaaagttaagaactctgatacttgcacccacccgcgtggtcgctagcgagatggccgaagctctgaagggtatgcctattaggtaccaaacaacggcagtgaaatccgagcatactggcaaggagatcgtagacctcatgtgccacgccaccttcacaatgcgtttgctgtcaccagtgcgggttcccaattataacatgatcattatggatgaagcccattttaccgacccttctagcatcgctgcgagagggtacataagtactagggtcggaatgggcgaggcagccgctattttcatgacagccaccccgcccggttccgtggaagcatttccacagagcaatgccgtgatccaggatgaggaacgcgacattcctgagcgatcttggaactcagggtatgagtggatcacggatttccccggaaaaactgtctggtttgtaccatccataaagagtggcaatgacattgctaactgtctcaggaaaaatggcaagcgggtgatccagctgagcaggaagacattcgataccgaataccagaaaaccaagaacaacgactgggactacgttgtgactacagatatctcggagatgggggcgaatttccgcgccgaccgtgtcattgatcctagacggtgccttaaacccgtgatcctaaaggacggaccagaaagggttattctggcaggtccgatgcctgtgaccgtcgcttctgccgcacagcgccgaggcagaatagggcggaaccacaataaagagggagatcagtatatctacatgggccagcccttgaacaatgacgaggatcatgcccactggacagaagctaagatgttactggacaacattaatactccagagggtatcatccccgccctctttgaacctgagagggaaaagtccgcggcaattgatggggagtatcgcctgagaggcgaggccaggaaaacgttcgtggaacttatgcggcgtggagacctgccagtatggctcagctacaaggtggcttcagagggctttcaatatagtgatcgccgatggtgcttcgacggggaaagaaacaatcaggttttggaggaaaacatggatgtcgagatatggaccaaagagggagaaaggaagaaactgcggccccgctggctagacgccagaacatactctgaccctctggctctcagggagtttaaggagttcgcagccggtcggcgatccgtgagcggcgatcttatcctggagattgggaaattaccgcagcacttgactcagagagctcaaaatgccctggacaacctcgtgatgctgcataattcagaacagggaggccgcgcatataggcacgcgatggaggagcttccagataccatcgaaacactgatgctcttggccctgattgctgtcttaaccggtggggttactctatttttcctgagtggccggggactcggcaagacgagcatcgggcttctgtgtgtgatggcctcctctgtattgctgtggatggcaagcgtggagccccattggatagctgcctccatcattctcgaatttttcctgatggtccttctcatccctgagcccgaccgtcagagaaccccacaggataaccaactggcatacgtggttattggattgctgtttatgatcttaacagtggccgctaatgagatgggtctactggaaactaccaagaaagacctcggcatagggcacgtcgcggtagagaaccaccatcacgccgcaatgcttgatgtggacctgcatcctgcttcagcctggacattgtacgccgttgcaaccactattatcacacccatgatgaggcacacgattgaaaacaccactgctaatatctctctgacagccatagcgaaccaggctgccatcctcatgggactggataagggctggccaattagtaaaatggacatcggtgtgcctcttttagcactggggtgctattcgcaggtcaatccgctcaccttgaccgccgctgtgctgatgctagtcgcacattacgccattatcggccccggactgcaagcgaaggctacacgcgaggcccagaaacggactgcagccggcataatgaagaacccaacggtggatgggattgttgctatcgacctcgatcctgtggtatatgacgccaagttcgaaaaacagcttggacagatcatgctgttgattctgtgtaccagccaaatcctcctgatgcgaacaacttgggcattatgcgagtccataacccttgctacaggccccctgaccactctctgggagggttctccagggaagttttggaatacgacaattgccgtgtcaatggcgaacatcttcagaggaagctacctagccggcgcaggtctggctttctccttgatgaaaagtctgggcgggggaaggcgcggcaccggggcccagggagaaactctcggcgagaagtggaaacggcagcttaatcagctgtctaagagcgaatttaacacctataagagatcaggtattatggaggtcgaccgttccgaagcaaaagaggggttgaagaggggagagacaactaaacacgctgttagtcggggcaccgccaagctgcgctggttcgtggaacgaaatctcgtcaaacctgagggtaaggtgatcgatttaggctgtgggagaggaggctggagctactattgcgccgggctgaagaaagtaacagaagtgaagggatacacgaaaggcggtcccgggcacgaggaaccgataccaatggcgacctacggatggaaccttgttaagctgcattctggcaaagacgtgtttttcatccctcccgagaagtgtgatactctactctgcgacattggcgagtcctcaccaaatcccacaatcgaagaggggaggaccctgcgggtcttgaaaatggtggaaccttggctgcgcggaaaccaattttgtattaagatcctcaatccgtatatgcccagcgtcgtggagactcttgagcagatgcagagaaagcacggtggcatgctggttaggaacccattatcgcgaaattctacacatgaaatgtactgggtaagttgcgggaccggaaacattgtgtccgctgtcaatatgacgagccggatgctgttgaaccgtttcaccatggcacacagaaaacctacatatgagcgcgatgtggacctcggcgccggtactaggcacgttgctgtggaacccgaggtcgccaacctggatatcatagggcagcggattgaaaatatcaagcatgagcacaaatcaacctggcattacgacgaggataacccttataagacatgggcataccacggatcctatgaagtgaaaccatctggcagcgccagttccatggtaaatggcgtggttaagctacttactaagccctgggacgtcatccctatggtgacccaaattgctatgacagataccactccatttgggcagcagagagtgttcaaagagaaggtcgacacgcgcacacccaaagcgaagaggggaaccgcccaaataatggaagttactgcaaaatggctgtggggttttctcagccgaaacaagaagccgcggatctgtaccagagaggagttcacaaggaaagtgcgctctaatgctgccattggcgcagtatttgtggacgagaaccagtggaactcagccaaggaggctgtcgaagatgagcgtttctgggacctggtgcatcgggaaagagagttgcacaaacaggggaagtgcgccacgtgcgtttacaacatgatgggaaaaagggaaaagaagctgggcgagtttggtaaagcgaaggggagtcgcgcaatctggtacatgtggctcggagcccgattccttgagttcgaagctctgggctttatgaatgaggatcactggttctcccgggaaaacagcttatctggcgtggagggggagggactgcataaattgggttatattctcagagacatctcgaagatacctggcgggaatatgtacgccgatgacaccgcaggatgggatactaggatcacagaagacgatctgcagaacgaggctcgcattaccgacatcatggaaccagagcacgccctacttgctaaatcaatttttaagctgacttatcaaaataaagtcgtgagagtacagcggcccgccaagaacggcacagttatggatgtgatcagcaggcgtgaccagcgaggttccgggcaggtcggaacctacggcctcaatacattcactaacatggaagcacaactgatacgccagatggagagtgagggcatattttctcctagcgaattggagaccccaaacttagcggaaagagtgctggattggctcgagaagtatggggtggaacggcttaaaaggatggccatctccggagacgactgtgtcgttaagcccatcgatgaccgcttcgctacggccctgaccgcactaaatgatatgggtaaagtgagaaaggacattccgcagtgggagccttcaaaaggctggaacgattggcagcaagtacccttttgcagtcatcacttccaccagctgataatgaaggacgggcgggagatcgtggtcccatgtaggaatcaggatgaactcgtgggacgagctcgtgtttctcagggcgccggttggagcttgagagagacagcatgcctggggaagtcctacgcccaaatgtggcagcttatgtattttcatcgccgggacctgaggctcgcggctaacgccatttgttcagcagtgcctgtcgattggatccccactagcagaaccacatggtctattcacgcccatcaccagtggatgactaccgaagacatgttatccgtgtggaatcgcgtatggatcgaggaaaacccatggatggaggataaaacgcatataagtagctggggagacgttccctacctgggcaagcgggaggaccaatggtgcggctcgttgatcgggctgacagctagggccacctgggcaactaatattcaggtggctatcaaccaggtccgaagactcattggaaatgaaaactaccttgattatatgacatccatgaaacggttcaagaatgagtctgaccctgaaggtgccctgtggtga

SEQ ID NO: 14032 - RNA, 9879 nt, synthetic construct
  misc_feature 1..9879: note = derived and/or modified CDS sequence (opt3) from DENV-1__EU482490__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattaccatcggtgccggggaaaaagctctgaagctctcctggttcaagaaaggctcaagtatcggaaagatgtttgaggccacagcaagaggcgccaggcggatggctattctgggggatacggcctgggacttcggaagcatcggtggcgtgtttacctccgttgggaaacttgtgcatcagattttcggaactgcatacggcgtcctgttttctggtgtgagctggacaatgaagatagggatcggcgtattgctcacctggctgggattaaattcacgaagtacatccctgagcatgacttgtattgcggtgggcctagttaccctctacctgggggtcatggtgcaggctgattctggatgcgtgatcaactggaaaggccgcgaacttaagtgtggttcagggatcttcgtcacgaatgaggttcacacatggaccgaacaatataagtttcaggccgacagtccgaaaagattgagcgcagccattggaaaggcttgggaggagggcgtgtgcggtataaggtccgccactcggctggaaaacatcatgtggaaacagatttctaacgagctcaatcatatcctgttagaaaacgacatgaagttcaccgtggtagtcggcgatgtggcagggattctggctcagggcaaaaagatgatccgccctcaacccatggagtacaaatattcgtggaaaagctggggcaaggccaagataatcggggcggacgttcagaatacaacttttattatcgatggaccaaacacccctgaatgtcccgacgatcagagagcctggaatatttgggaggtggaggactacggcttcggtatctttacaacgaacatatggcttaagttgagggattcctatacccaggtctgcgaccaccgtctcatgtcagctgcaattaaagatagtaaggccgtgcacgctgacatggggtactggatcgaatctgagaaaaatgaaacttggaagctggcccgggcctccttcattgaggttaagacatgtatctggccaaaatcccataccctatggtcaaacggagtgctggaaagcgagatgataatccccaagatttatggcggtcctatctctcaacacaattaccgaccaggctacttcactcagacagcggggccgtggcatctcggaaaactggagcttgattttgacttgtgcgaaggcaccacggtagtcgtggatgagcactgcgggaacagaggaccctccctgaggactaccacagtgaccggcaagattatccacgaatggtgttgccgcagttgtactttacctccactccggttcagaggtgaggacgggtgctggtatggaatggagataaggcccgtcaaagaaaaggaggaaaatctggttaagagcatggtgtctgccggctccggtgaggtagactcatttagtcttggcctgttgtgtattagcatcatgatcgaagaggtgatgcgctcgcgatggtcccggaaaatgctcatgacagggaccctggctgtcttctttctactgattatgggacagctcacatggaacgatctgatccgtctttgcattatggtgggcgccaatgcatctgacagaatggggatgggaactacctacttggctctgatggccacgttcaagatgaggcctatgtttgcagttggcttactcttccgccggctgacaagcagagaggtgcttctgctaaccataggtctctcactggtcgccagtgtggaattgccaaactccctggaggaattaggggatggactcgctatgggcatcatgattctgaaacttctgactgactttcaatctcatcagttgtgggcgaccctcctgagcctaacattcatcaagactaccttttccctgcactatgcctggaaaacgatggcaatggttctttcaattgtgagcctcttccccctgtgtttgagtacaacctctcagaagactacatggctgccggtcttactcggctccctggggtgcaagcctcttaccatgtttctgatcgctgagaataaaatatggggaaggcgaagctggccattgaacgaaggtatcatggccgtaggcattgtgtcgatcctcctgtcatctctactgaagaacgatgttccccttgccgggcctctcattgctggaggcatgctgatcgcatgttacgtgataagtggttccagcgccgacttgtctttagagaaagcggctgaggtcagctgggaagaggaagccgagcattccggggcatcacacaatattctggtggaagtacaggatgacggaactatgaagatcaaagatgaggagcgcgacgatacactcaccatcctgcttaaggccacgctgttggctgtgagtggcgtctatcccctaagcattccagcaactctgttcgtttggtacttctggcagaaaaagaagcagcggtctggcgtgctctgggacaccccttcacccccagaagtggagagagccgtcctggatgacgggatatataggatcatgcagcgtggacttttaggtcgcagccaggtgggcgttggggtatttcaagaaaacgtgttccatacaatgtggcacgtcacccggggagcggtgctgatgtaccagggcaaaagactcgagccgagttgggctagcgttaagaaagacttgatttcctacggtgggggatggaggctgcagggctcttggaatacaggcgaggaagtgcaggtcatcgccgtggagcctgggaagaaccccaaaaatgtacaaactgcaccaggaacctttaagacgcccgaaggtgaggtcggcgccattgctctcgatttcaagcctgggacatcgggaagcccaatcgtgaaccgagaaggcaaaatagttggtctgtatgggaatggagtggtcactacctcaggcacatacgtgtccgccatcgcacaggctaaggccagtcaggagggcccccttcctgagattgaagacgaggtttttcggaaacgcaacctgaccatcatggatttgcacccggggtctggaaagactagaaggtatctaccagcgattgtgcgggaagccatcaaacgaaagctgagaaccctcatattagcacccacacgcgtcgtggctagcgagatggccgaagctctgaagggtatgcctattaggtaccaaacgactgcagtaaaatccgagcataccggcaaggagatcgtggaccttatgtgccacgccacattcaccatgcgtctgctctcaccagttcgggtccccaattataacatgatcattatggatgaagcccattttactgacccttctagcatcgctgcgagagggtacataagtacaagggtgggaatgggcgaggcagccgctattttcatgaccgccacgccgcccggttccgtggaagcatttccacagagcaatgccgtcatccaggatgaggaacgcgacattcctgagcgatcttggaactcagggtatgagtggatcactgatttccccggaaaaacagtatggtttgtgccatccataaagagtggcaatgacattgctaactgtttgaggaaaaatggcaagcgggttatccagctgagcaggaagaccttcgataccgaataccagaaaactaagaacaacgactgggactacgtggtcacaaccgatatctcggagatgggggcgaatttccgcgccgaccgtgtgattgatcctagacggtgcctcaaacccgttatcctgaaggacggaccagaaagggtgattcttgcaggtccgatgcctgtcacagtggcttctgccgcacagcgccgaggcagaatagggcggaaccacaataaagagggagatcagtatatctacatgggccagcccctaaacaatgacgaggatcatgcccactggactgaagctaagatgctgttggacaacattaatacgccagagggtatcatccccgccttatttgaacctgagagggaaaagtccgcggcaattgatggggagtatcgcctgagaggcgaggccaggaaaaccttcgtagaactcatgcggcgtggagacctgccagtgtggcttagctacaaggttgcttcagagggctttcaatatagtgatcgccgatggtgcttcgacggggaaagaaacaatcaggtcctggaggaaaacatggatgtggagatatggacaaaagagggagaaaggaagaaactccggccccgctggttggacgccagaacttactctgaccctctggctctaagggagtttaaggagttcgcagccggtcggcgatccgtgagcggcgatctgatcctcgagattgggaaacttccgcagcacctgacccagagagctcaaaatgccttagacaacttggtcatgctgcataattcagaacagggaggccgcgcatataggcacgcgatggaggagctcccagatacaatcgaaaccctgatgcttctggccctcattgctgttttgactggtggggtgacgctgtttttcttaagtggccggggactaggcaagaccagcatcgggctgctctgtgtaatggcctcctctgtgcttctgtggatggcaagcgtcgagccccattggatagctgcctccatcattttggaatttttcctgatggtgctcctgatccctgagcccgaccgtcagagaacaccacaggataaccaacttgcatacgttgtgattggactcctgtttatgatcttgactgtcgccgctaatgagatgggtctgttagaaaccacaaagaaagacctaggcatagggcacgtagcggtggagaaccaccatcacgccgcaatgctggatgttgacctccatcctgcttcagcctggaccctttacgccgtggcaactacaattatcacgcccatgatgaggcacaccattgaaaacactacagctaatatctctctgaccgccatagcgaaccaggctgccatcttgatgggactggataagggctggccaattagtaaaatggacatcggtgtccctctcctggcacttgggtgctatagccaggtgaatccgttaaccctgacagccgctgtcctcatgttggtggcacattacgccattatcggccccggactgcaagcgaaggctactcgcgaggcccagaaacggacggcagccggcataatgaagaacccaaccgttgatgggattgtggctatcgacctagatcctgtagtgtatgacgccaagttcgaaaaacagctgggacagatcatgctccttattctgtgtacaagccaaatcttgctgatgcgaactacctgggcactctgcgagtccataacactggctaccggccccttaactacgctttgggagggttctccagggaagttttggaatacaaccattgccgtctcaatggcgaacatcttcagaggaagctacctggccggcgcaggtctcgctttctccctaatgaaaagtctgggcgggggaaggcgcggcactggggcccagggagaaaccttgggcgagaagtggaaacggcagctgaatcagctctctaagagcgaatttaacacatataagagatcaggtattatggaggttgaccgttccgaagcaaaagaggggcttaagaggggagagactaccaaacacgctgtgagtcggggcacagccaagctgcgctggttcgtcgaacgaaatttggtgaaacctgagggtaaggtaatcgatctgggctgtgggagaggaggctggagctactattgcgccgggctcaagaaagtgacggaagttaagggatacaccaaaggcggtcccgggcacgaggaaccgataccaatggcgacttacggatggaacttagtgaagctgcattctggcaaagacgtctttttcatccctcccgagaagtgtgatacacttctgtgcgacattggcgagtcctcaccaaatcccaccatcgaagaggggaggactctacgggtgctcaaaatggtcgaaccttggctgcgcggaaaccaattttgtattaagatcttgaatccgtatatgcccagcgtggttgagacactggagcagatgcagagaaagcacggtggcatgctcgtaaggaacccactttcgcgaaattctacccatgaaatgtactgggtgagttgcgggacgggaaacattgtctccgctgtgaatatgaccagccggatgctgttaaaccgtttcacaatggcacacagaaaacctacttatgagcgcgatgttgacctgggcgccggtaccaggcacgtggctgtcgaacccgaggtggccaacttggatatcatagggcagcggattgaaaatatcaagcatgagcacaaatcaacatggcattacgacgaggataacccttataagacttgggcataccacggatcctatgaagtaaaaccatctggcagcgccagttccatggtgaatggcgttgtcaagctcctgaccaagccctgggacgtgatccctatggtgacacaaattgctatgaccgatactacgccatttgggcagcagagagtcttcaaagagaaggttgacacacgcacccccaaagcgaagaggggaactgcccaaataatggaagtgaccgcaaaatggctatggggttttcttagccgaaacaagaagccgcggatctgtacaagagaggagttcacgaggaaagtacgctctaatgctgccattggcgcagtgtttgtcgacgagaaccagtggaactcagccaaggaggctgtggaagatgagcgtttctgggacctggttcatcgggaaagagagctccacaaacaggggaagtgcgcaacctgcgtgtacaacatgatgggaaaaagggaaaagaagctgggcgagtttggtaaagcgaaggggagtcgcgcaatctggtacatgtggttgggagcccgattcctggagttcgaagctctcggctttatgaatgaggatcactggttctcccgggaaaacagcctttctggcgtcgagggggagggactgcataaattaggttatattctgagagacatctcgaagatacctggcgggaatatgtacgccgatgacactgcaggatgggatacaaggatcaccgaagacgatttgcagaacgaggctcgcattactgacatcatggaaccagagcacgccctcctggctaaatcaatttttaagctaacatatcaaaataaagtggtaagagttcagcggcccgccaagaacggcaccgtgatggatgtcatcagcaggcgtgaccagcgaggttccggacaggtgggaacatacggccttaatactttcaccaacatggaagcacaactgatacgccagatggagagtgagggcatattttctcctagcgaactcgagacgccaaacctggcggaaagagtgttggattggttagagaagtatggggtcgaacggctgaaaaggatggccatctccggagacgactgtgttgtgaagcccatcgatgaccgcttcgctaccgccctcacagcacttaatgatatgggtaaagtaagaaaggacattccgcagtgggagccttcaaaaggctggaacgattggcagcaagtgcccttttgcagtcatcacttccaccagctgataatgaaggacgggcgggagatcgtcgtgccatgtaggaatcaggatgagctagttggacgagctcgtgtgtctcagggcgccggttggagcctgagagagactgcatgcctcgggaagtcctacgcccaaatgtggcagttgatgtattttcatcgccgggacctgaggcttgcggctaacgccatttgttcagcagtccctgtggattggatccccaccagcagaacaacttggtctattcacgcccatcaccagtggatgaccacggaagacatgctgtccgtatggaatcgcgtttggatcgaggaaaacccatggatggaggataaaacacatataagtagctggggagacgtgccctacctcggcaagcgggaggaccaatggtgcggctcgttaatcgggctgaccgctagggccacttgggcaacaaatattcaggtcgctatcaaccaggtgcgaagattgattggaaatgaaaactacctggattatatgacctccatgaaacggttcaagaatgagtctgaccctgaaggtgccctctggtga

SEQ ID NO: 14033 - RNA, 9879 nt, synthetic construct
  misc_feature 1..9879: note = derived and/or modified CDS sequence (opt3) from DENV-1__EU482491__SS-prME
  source 1..9879: mol_type = other RNA
agcgtgaccatgctgctcatgcttatgcccactgcactggctttccacttgactacgcggggaggggaacctcatatgatcgtctccaagcaggaaagggggaaatctttactgtttaagacctcagccggtgttaatatgtgcaccctgattgccatggacctcggcgagttctgtgaagatactatgacctacaaatgcccacggattacagaagcggaaccggacgatgtggactgttggtgcaatgctaccgatacttgggtaacatatgggacctgtacgcaaatcggagaacaccgccgagacaagcgtagtgtggccctggcaccccatgtcggccttggtctggagactagaaccgaaacatggatgagctccgagggggcctggaaacagattcagagggtggaaacttgggctttgcggcaccctggatttaccgttatcgcactcttcctggcccatgctattggcacatctatcacccagaagggcataatctttattctgctcatgttagccacgccatcgatggcgatgcgctgcgtggggatcggatcaagagatttcgtcgagggtctgagcggcgcaacttgggtggacgtagttcttgagcacgggagttgtgtgacaaccatggccaaggataaacccactttggacattgaactgctaaagacagaggtcaccaaccctgctgtgctcaggaaactgtgcatcgaagccaagatatccaatacgaccacagattctcggtgtccaactcaaggagaggcaacccttgtggaagaacaggacgctaactttgtctgccgccgaacattcgttgatagaggctggggtaatgggtgtggactgtttggcaaaggcagcttgattacttgcgccaagttcaagtgcgtgaccaaactcgaggggaagatcgtacagtacgaaaacctgaaatattccgtgattgtcacagtgcacaccggagaccagcatcaagttggtaatgagtcaactgaacacggcacgatcgcgacaatcactccccaagcccctagtaccgagattcagttaaccgactacggggcactgacactcgattgtagcccaaggaccggacttgactttaacgaaatggtgctgttgactatgaaggagaaatcttggctagtccataagcagtggttcctggatctcccgctgccctggacatccggcgcttcaacgagccaagagacctggaatcggcaggaccttctggtgacttttaaaacagcccacgctaagaagcaggaagtagttgtgttgggtagtcaagagggggccatgcacaccgcactcacaggcgccactgaaatacagacctctggaacgaccacaatcttcgctggccatctgaaatgccgtttaaagatggataaactgactctacgcgggatgtcctatgtcatgtgtaccggctcgttcaagctcgagaaagaagtggcggagacacagcacggtactgtcctggtgcagattaagtacgagggcaccgacgcaccttgcaagatcccattttcgacgcaagatgaaaaaggggttacacagaacggaagacttataaccgccaatcccattgtgactgacaaggagaaacctgtaaacatcgaagctgagccacccttcggcgagtcttatatcgtcattggtgccggggaaaaggcattgaaactgtcctggtttaagaagggctcaagtatcggaaaaatgttcgaggccacagctaggggcgcccggcgaatggcaattctcggggataccgcgtgggactttggaagcataggtggcgtgttcacttccgttgggaagctggtgcatcagatctttggaaccgcttacggcgtccttttctctggtgtgagctggacaatgaaaattgggatcggcgtactgttgacgtggctcggactaaattcacgcagtacctccttaagcatgacttgtatcgccgtgggcctggttacactatacctcggggtcatggtgcaggcagattctggatgcgtgattaactggaagggcagagaactgaaatgtggttcagggatatttgtcaccaatgaggttcacacatggactgaacaatataagttccaggccgacagtccgaagaggcttagcgctgccatcggaaaagcatgggaggagggcgtgtgcggtattcggtccgctacccgcttggaaaacatcatgtggaagcagatttctaacgagctgaatcatatcctcctggaaaacgacatgaaattaacggtggtagtcggcgatgtggccgggatactggcgcagggaaagaaaatgatcagacctcaacccatggagtacaagtattcgtggaaaatttggggcaaggccaagatcattggggctgacgttcagaatacaacctttatcatagatggaccaaacactcctgaatgtcccgacgatcagagggcatggaatatttgggaggtggaggactacggcttcggtatctttaccacaaacatttggcttaaattgcgtgatagctatactcaggtctgcgaccaccggctcatgtccgccgctatcaaggattcaaaagccgtgcacgcagacatggggtactggatagaaagtgagaagaatgaaacctggaaactggcgcgagcctctttcatcgaggttaagacatgtatttggccaaagagccatacgctatggtccaacggagtgctggaatcagagatgatcattcccaaaatctatggcggtcctataagccaacacaattacagaccaggctacttcacccagactgctgggccgtggcatctcggaaagctggagcttgattttgacttgtgcgaaggcacaaccgtagtcgtggatgagcactgcgggaacaggggaccctctctgcgcactacaaccgtgacgggcaaaattatccacgaatggtgttgccggtcctgtactttacctccactcagattcaagggtgaggacgggtgctggtatggaatggagatcaggcccgtcaaagaaaaggaggaaaatctggttaagagtatggtgagcgccggctctggtgaggtagactccttttcacttggcctgttgtgtattagtatcatgattgaagaggtgatgcgcagccgatggtcgcggaaaatgctcatgaccgggacactggcagtcttctttctactgataatgggacagctcacctggaacgatctgatccgtctttgcattatggtgggcgctaatgcctccgacagaatggggatgggaactacatacttggcactgatggccaccttcaagatgaggcctatgtttgctgttggcttactcttccgccggctgacatctagagaggtgcttctgctaactatcggtctcagcctggtcgcgtcagtggaattgccaaacagtctggaggaattaggggatggactcgccatgggcattatgatcctgaaacttctgaccgactttcaatcccatcagttgtgggcaacgctcctgtctctaacattcataaggaccacttttagcctgcactatgcttggaagaccatggccatggttctttccatcgtgtcactcttccccctgtgtttgagcacaacaagtcagaaaaccacgtggctgccggtcttactcggctctctggggtgcaagcctcttacaatgtttctgattgccgagaataagatctggggacgaaaatcctggccattgaacgaaggtattatggctgtaggcatcgtgagcatactcctgtcgtcactactgaagaacgatgttccccttgcagggcctctcattgccggaggcatgctgatcgcgtgttacgtgatctctggtagttccgctgacttgagcttagagaaagccgcagaggtctcttgggaagaggaagccgagcatagcggggcttcccacaatattctggtggaagtacaggatgacggaaccatgaagataaaagatgaggagcgcgacgatactctcacaatcctgcttaaggcaaccctgttggccgtgtcaggcgtctatcccctaagtattccagcgactctgttcgtttggtacttctggcagaagaagaagcagcggagcggcgtgctctgggacacaccttctcccccagaagtggagagagctgtcctggatgacgggatctataggattatgcagcgtggacttttaggtcgctcccaggtgggcgttggggtatttcaagaaaacgtgttccataccatgtggcacgtcacgcggggagccgtgctgatgtaccagggcaaaagactcgagccgtcatgggcaagtgttaagaaagacttgatcagctacggtgggggatggaggctgcagggctcctggaatactggcgaggaagtgcaggtcatagccgtggagcctgggaagaaccccaaaaatgtacaaaccgctccaggaacatttaagacctctgaaggtgaggtcggcgccatcgcactcgatttcaagcccgggacatcgggaagccctattgtgaaccgagaaggcaaaatcgttggtctgtatgggaatggagtggtcactacctcaggcacgtacgtgtccgctattgcccaggcgaaggccagtcaggagggcccacttcccgagatcgaagacgaggtttttcggaaacgcaacctgacaataatggatttgcaccctgggtctggaaagactagaaggtatctaccggcaattgtgcgggaagctatcaaacgaagactgcgcaccctcatcttagccccaacaagggtcgtggctagcgagatggcagaagccctgaagggtatgcccattcgttaccaaaccactgccgtaaagtccgagcataccggcaaagagatcgtggaccttatgtgccacgctacattcacgatgcggctgctctcacctgttagagtcccaaattataacatgataattatggatgaagcgcattttactgacccctctagcatcgcagccagggggtacattagtacccgcgtgggaatgggcgaggctgccgcaatcttcatgacagccacccctccgggttccgtggaggcttttccccagagcaatgcggtcatacaggatgaggaacgagacattccagagagatcttggaactcagggtatgagtggatcactgatttccctggaaagacagtatggtttgtgccctccatcaaaagtggcaatgacattgccaactgtttgcggaagaatggcaaaagggttatccagctgagccgcaagaccttcgatacggaataccaaaagactaaaaacaacgactgggactacgtggtcacaaccgatatttcggagatgggggcaaatttccgtgctgacagagtgatagatccacggaggtgcctcaagcctgttatcctgaaagacggacccgaacgcgtgattcttgccggtccaatgccggtcaccgtggcatctgccgctcagcgaagaggccggatcgggaggaaccacaataaggagggagatcagtatatctacatgggccagcctctaaacaatgacgaggatcatgcccactggactgaagcgaaaatgctgttggacaacattaatacacccgagggtataatcccagcattatttgaacccgagcgcgaaaagtccgccgctattgatggggagtatagactgaggggcgaggcccggaagaccttcgtagaactcatgcgtcgcggagacctgcctgtgtggcttagctacaaagttgcttcagagggctttcaatatagtgatcgaagatggtgcttcgacggggaaaggaacaatcaggtcctggaggaaaacatggatgtggagatctggacaaaggagggagaacggaaaaagctccgcccaagatggttggacgcaaggacttactctgaccccctggccctacgggagtttaaagagttcgctgccggtcgaagatccgtgagcggcgatctgattctcgagatcgggaaacttcctcagcacctgacgcagcgcgcacaaaatgcgttagacaacttggtcatgctgcataattcagaacagggaggcagggcctatcggcacgctatggaggagctcccggataccatagaaacactgatgcttctggccctcatcgcagttttgactggtggggtgaccctgtttttcttaagtggccgtggactaggcaaaacaagcattgggctgctctgtgtaatggcttcctctgtgcttctgtggatggccagcgtcgagccacattggatcgcagcctccattatcttggaatttttcctgatggtgctcctgatacccgagcctgacagacagaggacaccccaggataaccaacttgcttacgttgtgattggactcctgtttatgatcttgactgtcgcggccaatgagatgggtctgttagaaacgaccaagaaggacctaggcattgggcacgtagcagtggagaaccaccatcacgctgccatgctggatgttgacctccatccagcctcagcatggacactttacgctgtggccactaccatcataacacctatgatgcgccacaccatcgaaaacactacagcgaatatttctctgacggctatcgccaaccaggcagccattttgatgggactggataaaggctggcccatcagtaagatggacataggtgtcccactcctggctcttgggtgctatagccaggtgaatcctttaaccctgactgcagccgtcctcatgttggtggcgcattacgctattatcggcccgggactgcaagccaaagcaacacgggaggcccagaagcgaaccgctgccggcatcatgaaaaaccccaccgttgatgggattgtggcaatcgacctagatccagtagtgtatgacgctaagttcgaaaagcagctgggacagataatgctccttattctgtgtacaagccaaatcttgctgatgagaactacgtgggccctctgcgagtccattaccctggcgacaggccctttaactaccctttgggagggttctcccgggaaattttggaatacaaccatcgccgtctcaatggcaaacatattcaggggaagctacctggctggcgccggtctcgcattctccctaatgaagagtctgggcgggggacgccggggcactggggctcagggagaaacgttgggcgagaaatggaagagacagctgaatcagctctctaaaagcgaatttaacacatataagcgttcaggtatcatggaggttgacaggtccgaagccaaggaggggcttaaacggggagagaccactaagcacgccgtgagtcgcggcaccgcgaaactgcgatggttcgtcgaaagaaatttggtgaagccagagggtaaagtaattgatctgggctgtgggaggggaggctggagctactattgcgctgggctcaagaaggtgacagaagttaaaggatacactaagggcggtcctgggcacgaggaacccatcccgatggcaacctacggatggaacttagtgaaactgcattctggcaaggacgtctttttcattccacctgagaaatgtgatacacttctgtgcgacatcggcgagtcctcacccaatccaacgattgaagaggggcggaccctacgcgtgctcaagatggtcgaaccctggctgagaggaaaccaattttgtatcaaaatattgaatccttatatgccgagcgtggttgagactctggagcagatgcagaggaagcacggtggcatgctcgtacgaaaccccctttcgagaaattctacacatgaaatgtactgggtgagttgcgggaccggaaacattgtctccgccgtgaatatgactagccgtatgctgttaaacagattcacaatggctcaccgcaagccaacctatgagagggatgttgacctgggcgccggtacgcggcacgtggcagtcgaacctgaggtggccaacttggatatcatcgggcagagaattgaaaatataaaacatgagcacaagtcaacctggcattacgacgaggataacccctataaaacatgggcttaccacggatcctatgaagtaaagccttctggcagcgcgagttccatggtgaatggcgttgtcaaactcctgactaagccatgggacgtgatccccatggtgacccaaattgccatgacagatactaccccttttgggcagcagcgcgtcttcaaggagaaagttgacacaaggaccccaaaggcaaaacgaggaactgctcaaatcatggaagtgacggccaagtggctatggggttttcttagccggaacaaaaagcccagaatttgtacaagggaggagttcacccgcaaggtacgttctaatgcagccatcggcgctgtgtttgtcgacgagaaccagtggaactcagccaaagaggcggtggaagatgagcggttctgggacctggttcatagagaaagggagctccacaagcaggggaaatgcgcaacttgcgtgtacaacatgatgggaaagcgcgagaaaaagctgggcgagtttggtaaggccaaagggagtcgagctatatggtacatgtggttgggagcccggttcctggagttcgaagcactcggctttatgaatgaggatcactggttctccagagaaaacagcctttctggcgtcgagggggagggactgcataagttaggttatatcctgagggacatttcgaaaatcccgggcgggaatatgtacgctgatgacaccgccggatgggatacacgcattacggaagacgatttgcagaacgaggctaagatcaccgacataatggaacctgagcacgccctcctggcaaaatcaatttttaagctaacttatcaaaataaagtggtaagagttcagcggccagcgaagaacggcacagtgatggatgtcatcagcaggcgtgaccagcgaggttccggacaggtgggaacctacggccttaatactttcacaaacatggaagcccaactgatccgccagatggagagtgagggcatattttctcccagcgaactcgagacccctaacctggctgggagagtgttggattggttagaaaagcatggagtcgagcggctgaaaaggatggccatatccggtgacgactgtgttgtgaagccaatcgatgaccgcttcgcaacagctctcactgcccttaatgatatgggcaaagtaagaaaggacattccccagtgggaaccgtcaaaagggtggaacgattggcagcaagtgcctttttgcagtcaccacttccatcagctgatcatgaaggacggacgggagattgtcgtgccctgtaggaatcaggatgagctagttggccgagcacgtgtgtctcagggtgccgggtggagcctgagagaaaccgcgtgcctcggaaagtcctatgctcaaatgtggcagttgatgtactttcaccgccgggacctgaggcttgccgcaaacgccatctgttcagctgtcccagtggattgggtacctacgagcagaaccacatggtctatacatgcccaccatcagtggatgactaccgaggacatgctgtccgtttggaatcgcgtgtggatcgaagagaacccctggatggaagataaaacacacgtcagtagctggggcgacgtgccatatctcggcaagcgggaggaccaatggtgcgggtcgttaattggactgactgcaagggctacctgggccacgaatatccaggttgcgattaaccaggtgcgaagattgctgggtaatgagaactacctcgattacatgacatccatgaaacggttcaagaatgaatctgaccccgagggcgctctttggtga

SEQ ID NO: 14034 - RNA, 9879 nt, synthetic construct
  misc_feature 1..9879: note = derived and/or modified CDS sequence (opt3) from DENV-1__EU482493__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggatcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagcacaaatactcgtggaaaagctggggcaaggccaagataatcggggcggacgttcagaataccacatttattatcgatggaccaaacactcctgaatgtcccgacgatcagagagcctggaatatttgggaggtggaggactatggcttcggtatctttaccacaaacatatggttgaagctcagggattcctacacgcaggtctgcgaccaccgtctgatgtcagctgcaattaaagatagtaaggccgtgcatgctgacatggggtattggatcgaatctgagaaaaatgaaacctggaagctagcccgggcatccttcattgaggttaagacttgtatctggccaaaatcccacacactgtggtcaaacggagtgctcgaaagcgagatgataatccccaagatttacggcggtcctatctctcaacataattatcgaccaggctacttcacccagactgcggggccgtggcacctgggaaaacttgagttggattttgacctgtgcgaaggcacaaccgtagtcgtggatgagcactgcgggaacagaggaccctccttaaggacgactaccgtgacaggcaagattatccatgaatggtgttgccgcagttgtaccctccctccactgcggttcagaggtgaggacgggtgctggtacggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattgtgggacagctgacctggaacgatcttatccgtttgtgcattatggttggcgccaatgcatctgacagaatggggatgggaacaacttatctggctttaatggccaccttcaagatgaggcctatgtttgcagtgggcctcctgttccgccggcttacgagcagagaggtcctgctactcacaataggtctgtcattggtggccagtgttgaactgccaaactccttagaggaactcggggatggactggctatgggcatcatgattcttaaactgttgaccgactttcaatctcaccagctctgggcgactctgctaagcctgaccttcatcaagacaactttttcccttcattacgcctggaaaaccatggcaatggtgctctcagtcgtaagcctgttccccttgtgtctgagtacgacatctcagaagaccacttggttaccggtgctcctgggctcccttgggtgcaagcctctgacaatgtttttgattgctgagaataaaatctggggaaggcgaagctggccactcaacgaaggtataatggccgttggcatcgtgtcgattctgctatcatctctgcttaagaacgatgtccccctcgccgggcctctgatcgctggaggcatgttgattgcatgttatgtgatcagtggttccagcgccgacttatctctggagaaagcggctgaggtaagctgggaagaggaagccgagcactccggggcatcacataatatactcgtggaagtccaggatgacggaaccatgaagattaaagatgaggagcgcgacgatactctgacaatccttctgaaggccaccttgctagctgttagtggcgtgtaccccctgagcatcccagcaacactcttcgtgtggtatttctggcagaagaagaagcagcggtctggcgtcctgtgggacactccttcacccccagaagtggagagagccgttcttgatgacgggatttacaggataatgcagcgtggattactgggtcgcagccaggtaggcgtgggggtctttcaagaaaacgtgttccacaccatgtggcacgttacacggggagcggtgctcatgtatcagggcaaaagattggagccgagttgggctagcgtcaagaaagacctgatctcctacggtgggggatggaggctccagggctcttggaataccggcgaggaagtgcaggtaattgccgtcgagcctgggaagaaccccaaaaatgtgcaaacagcaccaggaacttttaagacccccgaaggtgaggttggcgccatcgctctggatttcaagcctgggacgtcgggaagcccaattgtgaaccgagaaggcaaaatcgtcggtctttacgggaatggagtggttacaacttcaggcacctatgtgtccgccatagcacaggctaaggccagtcaggagggccccctgcctgagatcgaagacgaggtctttcggaaacgcaacttgacaattatggatctacatccggggtctggaaagaccagaaggtacctgccagcgatcgtgcgggaagccattaaacgaaagctcagaactttaatcctggcacccacccgcgtagtggctagcgagatggccgaagctcttaagggtatgcctataaggtatcaaacaacggcagttaaatccgagcacactggcaaggagattgtcgacctgatgtgccatgccaccttcacaatgcgtctcttgtcaccagtgcgggtgcccaattacaacatgatcatcatggatgaagcccactttaccgacccttctagcattgctgcgagagggtatatcagtactagggtcggaatgggcgaggcagccgctatattcatgacagccaccccgcccggttccgtagaagcatttccacagagcaatgccgtgattcaggatgaggaacgcgacatccctgagcgatcttggaactcagggtacgagtggattacggatttccccggaaaaactgtttggtttgtgccatccatcaagagtggcaatgacatagctaactgtctgaggaaaaatggcaagcgggtcattcagctcagcaggaagacattcgataccgaatatcagaaaaccaagaacaacgactgggactacgtggttactacagatatctcggagatgggggcgaatttccgcgccgaccgtgtgatcgatcctagacggtgcctgaaacccgtcattcttaaggacggaccagaaagggtgatcctagcaggtccgatgcctgtaaccgtggcttctgccgcacagcgccgaggcagaattgggcggaaccataataaagagggagatcagtacatatatatgggccagcccctgaacaatgacgaggatcacgcccactggacagaagctaagatgttgttagacaacatcaatactccagagggtattatccccgccctgtttgaacctgagagggaaaagtccgcggcaatcgatggggagtaccgcctcagaggcgaggccaggaaaacgttcgttgaactgatgcggcgtggagaccttccagtctggctgagctataaggtggcttcagagggctttcaatacagtgatcgccgatggtgcttcgacggggaaagaaacaatcaggtgctcgaggaaaacatggatgtcgagatttggaccaaagagggagaaaggaagaaattgcggccccgctggctggacgccagaacatattctgaccctctagctctgagggagtttaaggagttcgcagccggtcggcgatccgttagcggcgatctcatacttgagatcgggaaactgccgcagcatttaactcagagagctcaaaatgccttggacaacctggtgatgctccacaattcagaacagggaggccgcgcatacaggcatgcgatggaggagctgccagataccattgaaacacttatgctgctcgccttgatcgctgtactgaccggtggggtgactttatttttcctaagtggccggggactgggcaagacgagcattgggctcctttgtgtcatggcctcctctgtgctgttgtggatggcaagcgttgagccccactggatcgctgcctccataatcctggaatttttcctcatggtgctgcttattcctgagcccgaccgtcagagaaccccacaggataaccaactcgcatatgtcgtaatcggactgttgtttatgattctgacagtggccgctaatgagatgggtttactagaaactaccaagaaagacctgggcatcgggcacgttgcggtggagaaccatcaccatgccgcaatgctcgatgtcgaccttcaccctgcttcagcctggacactgtacgccgtggcaaccactataattacacccatgatgaggcatacgatcgaaaacaccactgctaatatttctttgacagccatcgcgaaccaggctgccatactgatgggactcgataagggctggccaatcagtaaaatggacattggtgtccctctgcttgcattagggtgctacagccaggtgaatccgctgaccctcaccgccgctgttttgatgctggtggcacactatgccatcattggccccggactacaagcgaaggctacacgcgaggcccagaaacggactgcagccggcatcatgaagaacccaacggtagatgggatagtggctattgacctggatcctgtcgtttacgacgccaagttcgaaaaacagctcggacagatcatgcttctgatcttgtgtaccagccaaattctgctcatgcgaacaacttgggcactgtgcgagtccatcaccttagctacaggcccccttaccactctgtgggagggttctccagggaagttttggaatacgacaatagccgtgtcaatggcgaacattttcagaggaagctatctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctacaagagatcaggtatcatggaggtcgaccgttccgaagcaaaagaggggctgaagaggggagagacaactaaacacgctgtgagtcggggcaccgccaagttgcgctggttcgtagaacgaaatctggtgaaacctgagggtaaggttattgatctcggctgtgggagaggaggctggagctattactgcgccgggttaaagaaagtgacagaagtcaagggatatacgaaaggcggtcccgggcatgaggaaccgatcccaatggcgacctacggatggaacctggtgaaacttcactctggcaaagacgtctttttcatacctcccgagaagtgtgatactctgctatgcgacatcggcgagtcctcaccaaatcccacaattgaagaggggaggaccctccgggtgctgaaaatggttgaaccttggttgcgcggaaaccaattttgtatcaagattctgaatccgtacatgcccagcgtagtggagactctcgagcagatgcagagaaagcatggtggcatgcttgtcaggaacccactgtcgcgaaattctacacacgaaatgtattgggtgagttgcgggaccggaaacatcgtttccgctgtgaatatgacgagccggatgttactgaaccgtttcaccatggcacacagaaaacctacatacgagcgcgatgtcgacttgggcgccggtactaggcatgtggctgtagaacccgaggtggccaacctcgatattatcgggcagcggatagaaaatattaagcacgagcataaatcaacctggcactatgacgaggataacccttacaagacatgggcatatcatggatcctacgaagttaaaccatctggcagcgccagttccatggtcaatggcgtggtgaagctgctaactaagccctgggacgtcatccctatggttacccaaatcgctatgacagataccactccatttgggcagcagagagtgttcaaagagaaggtagacacgcgcacacccaaagcgaagaggggaaccgcccaaattatggaagtgactgcaaaatggctttggggttttctgagccgaaacaagaagccgcggatatgtaccagagaggagttcacaaggaaagtccgctctaatgctgccatcggcgcagtgtttgttgacgagaaccagtggaactcagccaaggaggctgtggaagatgagcgtttctgggacctcgtccaccgggaaagagagctgcacaaacaggggaagtgcgccacgtgcgtgtataacatgatgggaaaaagggaaaagaagttgggcgagtttggtaaagcgaaggggagtcgcgcaatttggtacatgtggctgggagcccgattcctcgagttcgaagctcttggctttatgaatgaggatcattggttctcccgggaaaacagcctgtctggcgtagagggggagggattacacaaactgggttacatcttgagagacatttcgaagatccctggcgggaatatgtatgccgatgacaccgcaggatgggatactaggataacagaagacgatctccagaacgaggctcgcatcaccgacattatggaaccagagcatgccctgctagctaaatcaatctttaaacttacttaccaaaataaagttgtgagagtccagcggcccgccaagaacggcacagtgatggatgtgattagcaggcgtgaccagcgaggttccgggcaggtcggaacctatggcctgaatacattcactaacatggaagcacaactcatccgccagatggagagtgagggcatattttctcctagcgaactggagaccccaaacttggcggaaagagttttagattggctggagaagtacggggtggaacggctcaaaaggatggccatttccggagacgactgtgtagtgaagcccatcgatgaccgcttcgctacggcccttaccgcactgaatgatatgggtaaagtcagaaaggacatcccgcagtgggagccttcaaaaggctggaacgattggcagcaagtgcccttttgcagtcaccacttccatcagctaattatgaaggacgggcgggagatagttgtgccatgtaggaatcaggatgaactggtcggacgagctcgtgtgtctcagggcgccggttggagcctcagagagacagcatgcttggggaagtcctatgcccaaatgtggcagctgatgtactttcaccgccgggaccttaggctggcggctaacgccatctgttcagcagtacctgttgattggattcccactagcagaaccacatggtctatccatgcccaccatcagtggatgactaccgaagacatgctctccgtgtggaatcgcgtctggattgaggaaaacccatggatggaggataaaacgcacatcagtagctggggagacgtgccctatttaggcaagcgggaggaccaatggtgcggctcgctgatagggttgacagctagggccacctgggcaactaatatccaggttgctattaaccaggtgcgaagactgatcggaaatgaaaactacctcgattacatgacatccatgaaacggttcaagaatgagtctgaccctgaaggtgccctttggtga

SEQ ID NO: 14035 - RNA, 9879 nt, synthetic construct
  misc_feature 1..9879: note = derived and/or modified CDS sequence (opt3) from DENV-1__EU482494__SS-prME
  source 1..9879: mol_type = other RNA
tccgtgaccatgctgctcatgcttatgcccaccgcactggctttccacttgactacgcggggcggggaacctcatatgatcgtctccaagcaggaaaggggaaagtctttactgtttaagacctcagccggtgttaacatgtgcacactaattgccatggacctcggcgaactgtgtgaagatactataacctacaaatgcccacggatcacagaaaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagattcagagggtggaaacctgggccctccggcaccctggattcacagttatcgctctgtttctggcacatgccattggcacctcgatcacgcagaagggcataatcttcattctcttaatgctggctactccatcaatggccatgcgctgcgtggggatcggaagcagagattttgtcgagggtcttagtggcgcgacatgggtggacgtagttttggagcacgggtcctgtgtgaccactatggcaaaggataaacccacactggacattgaactactcaagaccgaggtcacgaaccctgccgtgctgaggaaactttgcatcgaagctaagatatctaataccacaactgatagccggtgtccaacccaaggagaggccacactggtggaagaacaggacgcaaacttcgtctgccgccgaacttttgttgatagaggctggggtaatgggtgtggattgttcggcaaaggctccctcattacctgcgctaagtttaagtgcgtgacaaaactggaggggaagatcgtacagtacgaaaacttaaaatattcagtgattgtcaccgtgcacactggagaccagcatcaagttggtaatgagagtacggaacacggcacaaccgccactatcacaccccaggcgcctacaaccgagatccagctgactgactacggggccctcacacttgattgtagcccaaggacgggactggacttcaacgaaatggtgttgctaaccatgaaggagaaatcttggctggtccataagcagtggtttctcgatctgccgcttccctggacttccggcgcatcaacaagccaagagacctggaatcggcaggacctgttggtgacattcaaaactgctcacgccaagaagcaggaagtagttgtgctcggtagtcaagagggggctatgcacaccgccctgacgggcgcaaccgaaattcagacatctggaactaccacaatatttgccggccatttaaaatgccgtctgaagatggataaactaactctccgcgggatgtcctatgtcatgtgtaccgggtcgttcaagctggagaaagaagtggctgagacgcagcacggtacagtccttgtgcagatcaagtacgagggcaccgacgcgccttgcaagattccattctcgactcaagatgaaaaaggggttacacagaacggaagattgatcaccgcaaatcccatagtgactgacaaggagaaacctgtaaacattgaagccgagccaccctttggcgagtcttatatcgtcatcggtgctggggaaaaggccctgaaactctcctggttcaagaagggctcaagtattggaaaaatgtttgaggcaaccgccaggggcgctcggcgaatggccatcctgggggatacagcatgggacttcggaagcattggtggcgtgtttacgtccgttgggaaacttgtgcatcagatattcggaaccgcgtacggcgtcctgttttctggtgtgagctggactatgaaaatcgggattggcgtattgctcacatggctgggattaaattcacgcagtacctccctgagcatgacatgtatcgctgtgggcctagttactctctacctgggggtcatggtgcaggccgattctggatgcgtgatcaactggaagggcagagaacttaaatgtggttcagggattttcgtcaccaatgaggttcacacgtggacagaacaatataagtttcaggcagacagtccgaagaggttgagcgccgctataggaaaagcctgggaggagggcgtgtgcggtatccggtccgcaacccgcctggaaaacattatgtggaagcagatctctaacgagctcaatcatattctgttagaaaacgacatgaaattcactgtggtagtcggcgatgtggctgggatcctggcccagggaaagaaaatgataagacctcaacccatggagcacaagtactcgtggaaaagctggggcaaggcgaagatcattggggccgacgttcagaataccacatttatcattgatggaccaaacactcctgaatgtcccgacgatcagagggcttggaatatctgggaggtggaggactatggcttcggtatatttaccacaaacatttggcttaaattgcgtgattcctacacgcaggtctgcgaccaccggctcatgtcagcagccatcaaggatagtaaagctgtgcatgccgacatggggtattggattgaatctgagaagaatgaaacctggaaactggcacgagcgagcttcatcgaggttaagacttgtatatggccaaagtcccacacactatggtcaaacggagtgctggaaagcgagatgatcattcccaaaatctacggcggtcctatttctcaacataattatagaccaggctacttcacccagactgccgggccgtggcacctcggaaagctggagcttgattttgacttgtgcgaaggcacaaccgtagtcgtggatgagcactgcgggaacaggggaccctccctgcgcacgactaccgtgacaggcaaaatcatacatgaatggtgttgccggagttgtaccttacctccactcagattcaggggtgaggacgggtgctggtacggaatggagattcgccccgtcaaggaaaaagaggaaaatctggttaagagcatggtgtctgctggctccggtgaggtagactcatttagtcttggcctgttgtgtatcagcatcatgattgaagaggtgatgcgatcgcggtggtcccgtaagatgctcatgactgggacactggccgtcttctttctactgatcatgggacagctcacctggaacgatctgattagactttgcataatggtgggcgcaaatgcttctgacaggatggggatgggaacaacttatttggccctgatggcaaccttcaaaatgcgccctatgtttgccgttggcttactcttccggagactgacgagcagggaggtgcttctgctaacaatcggtctctcactggtcgctagtgtggaattgccaaactccctggaggaattaggggatggactcgcgatgggcattatgatcctgaaacttctgaccgactttcaatctcaccagttgtgggccactctcctgagcctaaccttcattaaaacaactttttccctgcattacgcatggaagaccatggctatggttctttcaatcgtgagcctcttccccctgtgtttgagtacgacatctcagaaaaccacttggctgccggtcttactcggctccctggggtgcaagcctcttacaatgtttctgatagccgagaataagatctggggacgacgcagctggccattgaacgaaggtattatggccgtaggcatcgtgtcgattctcctgtcatctctactgaaaaacgatgttccccttgctgggcctctcatcgcaggaggcatgctgatagcctgttatgtgattagtggttccagcgcggacttgtctttagagaaggctgccgaggtcagctgggaagaggaagcagagcactccggggcctcacataatatcctggtggaagtacaggatgacggaaccatgaaaatcaaggatgaggagcgggacgatactctcacaattctgcttaaagctaccctgttggcagtgagtggcgtctaccccctaagcataccagccacgctgttcgtttggtatttctggcaaaagaaaaagcagagatctggcgtgctctgggacactccttcacccccagaagtggagagggcggtcctggatgacgggatctaccgtattatgcagcgcggacttttaggtcggagccaggtgggcgttggggtatttcaagaaaacgtgttccacaccatgtggcacgtcacaagaggagctgtgctgatgtatcagggcaagaggctcgagccgagttgggccagcgttaaaaaggacttgatctcctacggtgggggatggcgactgcagggctcttggaataccggcgaggaagtgcaggtcattgcagtggagcctgggaaaaaccccaagaatgtacaaacagccccaggaacttttaaaacccccgaaggtgaggtcggcgctatcgccctcgatttcaagcctgggacgtcgggaagcccaatagtgaaccgggaaggcaagatcgttggtctgtacgggaatggagtggtcacaacttcaggcacctatgtgtccgcaattgctcaggccaaagcgagtcaggagggcccccttcctgagatcgaagacgaggtttttcgcaagagaaacctgacaattatggatttgcatccggggtctggaaaaaccaggcggtacctaccagccatcgtgcgagaagcaataaagagaaaactgcgcactctcattttagctcccaccagggtcgtggccagcgagatggctgaagcactgaagggtatgcctatccgttatcaaacaacggccgtaaagtccgagcacactggcaaagagatcgtggaccttatgtgccatgccaccttcacaatgcggctgctctcaccagttagagtccccaattacaacatgattatcatggatgaagctcactttaccgacccttctagcatagcggcaagggggtatattagtactcgcgtgggaatgggcgaggccgctgccatcttcatgacagcaaccccgcccggttccgtggaagcctttccacagagcaatgctgtcattcaggatgaggaacgagacatccctgagagatcttggaactcagggtacgagtggataacggatttccccggaaagactgtatggtttgtgccatccattaaaagtggcaatgacatcgcgaactgtttgcggaagaatggcaaaagggttatccagctgagccgcaagacattcgataccgaatatcaaaagaccaaaaacaacgactgggactacgtggtcactacagatatttcggagatgggggccaatttccgtgcagacagagtgatcgatcctcggaggtgcctcaagcccgttattctgaaagacggaccagaacgcgtgatacttgctggtccgatgcctgtcaccgtggcctctgcagcccagcgaagaggccggatcgggaggaaccataataaggagggagatcagtacatttatatgggccagcccctaaacaatgacgaggatcacgctcactggacagaagccaaaatgctgttggacaacatcaatactccagagggtatcattcccgcgttatttgaacctgagcgcgaaaagtccgcagccatagatggggagtacagactgaggggcgaggctcggaagacgttcgtagaactcatgcgtcgcggagacctgccagtgtggcttagctataaagttgcctcagagggctttcaatacagtgatcgaagatggtgcttcgacggggaaaggaacaatcaggtcctggaggaaaacatggatgtggagatctggaccaaggagggagaacggaaaaagctccgccccagatggttggacgctaggacatattctgaccctctggcactacgggagtttaaagagttcgccgctggtcgaagatccgtgagcggcgatctgattctcgagatcgggaaacttccgcagcatctgactcagcgcgcccaaaatgcattagacaacttggtcatgctgcacaattcagaacagggaggcagggcgtaccggcatgccatggaggagctcccagataccattgaaacactgatgcttctggctctcatcgccgttttgaccggtggggtgactctgtttttcttaagtggccgtggactaggcaaaacgagcatagggctgctctgtgtaatggcatcctctgtgcttctgtggatggctagcgtcgagccccactggatcgccgcatccattatcttggaatttttcctgatggtgctcctgattcctgagcccgacagacagaggaccccacaggataaccaacttgcctatgttgtgatcggactcctgtttatgatattgacagtcgctgcgaatgagatgggtctgttagaaactaccaagaaggacctaggcattgggcacgtagccgtggagaaccatcaccatgcagctatgctggatgttgacctccaccctgcctcagcctggacactttacgcagtggctaccactatcattacacccatgatgcgccatacgatcgaaaacaccactgccaatatatctctgacagcgatcgctaaccaggccgcaattttgatgggactggataaaggctggccaatcagtaagatggacattggtgtccctctcctggcccttgggtgctacagccaggtgaatccgttaaccctgaccgctgcagtcctcatgttggtggcccactatgcgatcataggccccggactgcaagctaaagccacacgggaggcacagaagcgaactgccgctggcattatgaaaaacccaacggttgatgggatcgtggccatcgacctagatcctgtagtgtacgacgcaaagttcgaaaagcagctgggacagattatgctccttatcctgtgtaccagccaaatattgctgatgagaacaacttgggctctctgcgagtccattaccctggccacaggccccttaaccactctttgggagggttctccagggaaattttggaatacgacaatcgcggtctcaatggccaacattttcaggggaagctatctggcaggcgctggtctcgccttctccctaatgaagagtctgggcgggggacgccggggcaccggggcacagggagaaactttgggcgagaaatggaagagacagctgaatcagctctctaaaagcgaatttaacacctacaagcgttcaggtatcatggaggttgacaggtccgaagctaaggaggggcttaaacggggagagacaactaagcacgccgtgagtcgcggcaccgccaaactgcgatggttcgtcgaaagaaatttggtgaagcctgagggtaaagtaatagatctgggctgtgggaggggaggctggagctattactgcgcggggctcaagaaggtgacagaagttaaaggatatacgaagggcggtcccgggcatgaggaaccgatcccaatggctacctacggatggaacttagtgaaactgcactctggcaaggacgtctttttcattcctcccgagaaatgtgatactcttctgtgcgacatcggcgagtcctcaccaaatcccacaattgaagaggggcggaccctacgcgtgctcaagatggtcgaaccttggctgagaggaaaccaattttgtatcaaaattttgaatccgtacatgcccagcgtggttgagactctggagcagatgcagaggaagcatggtggcatgctcgtacgaaacccactttcgagaaattctacacacgaaatgtattgggtgagttgcgggaccggaaacatcgtctccgcagtgaatatgacgagccgtatgctgttaaacagattcaccatggcccaccgcaagcctacatacgagagggatgttgacctgggcgctggtactcggcatgtggccgtcgaacccgaggtggcaaacttggatataattgggcagagaatcgaaaatatcaaacacgagcataagtcaacctggcactatgacgaggataacccttacaaaacatgggcctatcatggatcctacgaagtaaagccatctggcagcgctagttccatggtgaatggcgttgtcaaactcctgactaagccctgggacgtgattcctatggtgacccaaatagcgatgacagataccactccatttgggcagcagcgcgtcttcaaggagaaagttgacacgaggacacccaaggccaaacgaggaaccgcacaaatcatggaagtgactgctaagtggctatggggttttcttagccggaacaaaaagccgagaatttgtaccagggaggagttcacacgcaaggtacgttctaatgccgcaatcggcgccgtgtttgtcgacgagaaccagtggaactcagctaaagaggccgtggaagatgagcggttctgggacctggttcacagagaaagggagctccacaagcaggggaaatgcgcgacgtgcgtgtataacatgatgggaaagcgcgagaagaagctgggcgagtttggtaaggcaaaagggagtcgagccatttggtacatgtggttgggagctcggttcctggagttcgaagccctcggctttatgaatgaggatcattggttctccagagaaaacagcctttctggcgtcgagggggagggactgcacaagttaggttacatcctgagggacatatcgaaaatccctggcgggaatatgtatgcagatgacaccgctggatgggatactcgcattacagaagacgatttgcagaacgaggccagaatcaccgacattatggaaccagagcatgctctcctggccaagtcaatctttaaactaacttaccaaaataaggtggtacgggttcagaggcccgccaagaatggcacagtgatggatgtcataagccgtcgagaccagcgcggttccggacaggtgggaacctatggccttaatacattcactaacatggaagcgcaactgattagacagatggagagtgagggcatcttttctcctagcgaactcgagaccccaaacctggccgaacgggtgttggattggttagagaagtacggggtcgaaaggctgaagcgcatggctatctccggagacgactgtgttgtgaaacccattgatgacagattcgccacggcactcaccgctcttaatgatatgggtaaggtacggaaagacataccgcagtgggagccttcaaagggctggaacgattggcagcaagtgcccttttgcagtcaccacttccatcagctgatcatgaaagacgggagggagattgtcgtgccatgtcgaaatcaggatgagctagttggacgtgccagagtgtctcagggcgcaggttggagcctgcgcgagacagcctgcctcgggaagtcctatgcgcaaatgtggcagttgatgtactttcaccggagggacctgagacttgctgccaacgcaatctgttcagccgtccctgtggattggattcccactagccgcaccacatggtctatccatgctcaccatcagtggatgactaccgaagacatgctgtccgtatggaatcgggtttggatagaggaaaacccatggatggaggataagacgcacatcagtagctggggagacgtgccctatctcggcaaaagggaggaccaatggtgcggctcgttaattgggctgacagcccgagcaacctgggctactaatatccaggtcgccattaaccaggtgagacggttgatcggaaatgaaaactacctggattacatgacatccatgaagaggttcaaaaatgagtctgaccctgaaggtgcgctctggtga

SEQ ID NO: 14036 - RNA, 9879 nt, synthetic construct
  misc_feature 1..9879: note = derived and/or modified CDS sequence (opt3) from DENV-1__EU482495__SS-prME
  source 1..9879: mol_type = other RNA
agcgtgacaatgctgctcatgcttatgcccacagcactggctttccacttgactacgagaggaggggaacctcatatgatcgtctccaagcaggaaagggggaaatctttactgtttaagacatcagccggtgttaacatgtgcacactgattgccatggacctcggcgaactgtgtgaagatactatgacctacaaatgcccacggataacagaagtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaaactttgcattgaagccaaaatctctaatacgaccacagatagcagatgtccaactcaaggagaggctaccctggttgaagaacaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggactgttcaaacttgagaaggaagtggccgagactcagcacggtaccgttttggtgcagataaaatacgagggcacggacgctccttgcaagatcccattctcgacacaagatgaaaaaggggtaacccagaacggacgtctgattactgcgaatcccatcgtcacagacaaggagaaacctgtgaacatagaagcagagccaccctttggcgagtcttatattgttatcggtgccggggaaaaggctctcaagctgtcctggttcaaaaagggctcaagtatcggaaaaatgtttgaggccaccgcacgcggcgccagaaggatggctattcttggggatactgcctgggacttcggaagcatcggtggcgtgtttacctccgtcgggaagctggtgcatcagattttcggaacagcatacggcgtattgttttctggtgtgagctggacgatgaaaatagggatcggcgttctcctgacctggttaggactaaattcacggagtacttccctaagcatgacatgtattgcggtcggcctcgtgaccctgtaccttggggtgatggtccaggctgattctggatgcgttatcaactggaagggccgagaattgaagtgtggttcagggatcttcgtgacaaatgaggtgcacacttggaccgaacaatataaatttcaggccgacagtccgaagcgcctgagcgcagccattggaaaggcttgggaggagggcgtatgcggtataagatccgccacgaggctcgaaaacatcatgtggcggcagatttctaacgagctgaatcatatcttactggaaaacgacatgaagttcacagtcgtggttggcgatgtggtcgggattcttgcacagggcaagaagatgatccgccctcaacccatggagcacaaatactcgtggaaaagctggggcaaggctaagataatcggggccgacgtgcagaataccacttttattatcgatggaccaaacacccctgaatgtcccgacgatcagagagcgtggaatatttgggaggttgaggactatggcttcggtatctttacaactaacatatggttgaagctcagggattcctacacccaggtgtgcgaccaccgtctgatgtcagccgctattaaagatagtaaggcagtacatgccgacatggggtattggatcgaatctgagaaaaatgaaacatggaagctagctcgggccagcttcattgaggtcaagacgtgtatctggccaaaatcccacaccctgtggtcaaacggagtgctcgaaagcgagatgataatccccaagatttacggcggtcctatctctcaacataattatcgaccaggctacttcactcagacagcagggccgtggcacctgggaaaacttgagttggattttgacctgtgcgaaggcaccactgtggtcgttgatgagcactgcgggaacagaggaccctccttaaggacaaccacggtgactggcaagattatccatgaatggtgttgccgcagttgtaccctccctccactgcggttcaaaggtgaggacgggtgctggtacggaatggagataagacccgtaaaggaaaaggaggaaaatcttgtgaaaagcatggtctctgcgggctccggtgaggtggactcatttagtctgggcttgctctgtattagcatcatgatcgaagaggttatgaggtcgcgctggtcccgaaagatgctgatgacagggaccctagccgtgttctttctgctcattatgggacagctgacttggaacgatcttatccggtcttgcattatggtcggcgctaatgccagcgaccgtatggggatgggaacaacctatttggcactgatggctacattcaaaatgagacctatgtttgccgtgggcttactcttcaggcgcctgacttcacgggaggttcttctgctaaccataggtctcagtctggtggcatccgtcgaattgccaaactctctggaggaattaggggatggactcgccatgggcatcatgattctgaaacttctgacggactttcaaagctaccagttgtgggctacactcctgtccctaaccttcatcaaaactaccttttcactgcactatgcgtggaagacaatggccatggtacttagcattgtgagtctcctgcccttgtgtctgtctactacctcccagaagacgacatggttaccggttctcctgggcagccttgggtgcaaacctctgaccatgttcttgatcgcagagaataagatatggggaagaaaatcgtggccactcaacgaaggtatcatggctgtgggcattgtctcaatcctgctatctagtctgcttaagaacgatgtgcccctcgccgggcctctgattgccggaggcatgttgatcgcttgttacgtaatatccggtagctctgcagacttaagcctggagaaagccgcggaggtgtcctgggaagaggaagctgagcattcaggggccagtcacaatattctcgtcgaagttcaggatgacggaactatgaagatcaaagatgaggagagggacgatacactgaccatccttctgaaggcaactttgctagccgtgagcggcgtgtatcccctgtctattccagctacactctttgtctggtacttctggcaaaagaaaaagcagcgatccggcgtgctgtgggacaccccttcacccccagaagttgagcgcgcagtacttgatgacgggatatatcggatcatgcagagaggattactgggtaggagtcaggtgggcgtcggggtgttccaagaaaacgtttttcatacgatgtggcacgtgactcgtggagccgtcctcatgtaccagggcaaacgcttggagccgagctgggcgtccgtgaagaaagacctgatttcttacggtgggggatggcggctccagggctcgtggaataccggcgaggaagtacaggtcatcgctgtggagcctgggaagaaccccaagaatgttcaaacagccccaggaaccttcaaaacacccgaaggtgaggtgggcgcaattgccctggattttaagcctgggactagcggatcaccaatcgtcaacagagaaggcaaaatagtgggtctttatgggaatggagttgtgaccacgtccggcacatacgtcagtgctatcgcccaggcaaaggcttctcaggagggccccctgcctgagattgaagacgaggtgttcaggaaacgaaacttgactatcatggatctacacccggggagcggaaagacccggcgctatctgccagccattgtaagagaagcgatcaagaggaaactccggacattaatactggcccccacccgagtggttgcatccgagatggctgaagcccttaagggtatgcctattagataccaaactaccgctgtcaaatcagagcatacaggccgcgagatcgtggacctgatgtgccacgcaacgtttactatgaggctcttgtctccagtgcgtgtccccaattataacatgatcattatggatgaagcccatttcaccgaccctagcagtatcgccgctcgggggtacatatccacaagagtaggaatgggcgaggcggcagccatttttatgaccgctactccgcccggtagcgtggaagccttcccacagtctaatgcagttatccaggatgaggaaagggacattcctgagcgctcatggaactccgggtatgagtggatcacagattttcccggaaagaccgtgtggttcgtcccaagtataaaaagcggcaatgacattgccaactgtctgcgaaagaatggcaagagagtgatccagctctcgcggaaaacgtttgatactgaataccaaaagaccaagaacaacgactgggactacgttgtgaccaccgatatctctgagatgggggctaatttcagggcggaccgcgtcattgatcctcgtagatgcctgaagcccgtgatccttaaagacggaccagaacgggtaattctagccggtccgatgcctgtgactgttgcatccgctgcccagaggcgcggccgaatagggagaaaccacaataaggagggagatcagtatatctacatgggccagcccctgaacaatgacgaggatcatgcacactggacagaagccaagatgttgttagacaacattaataccccagagggtatcatccccgctctgttcgaacctgagcgggaaaagagcgccgcgattgatggggagtataggctccgcggcgaggcaagaaagacatttgtcgagctgatgaggcggggagaccttccagtgtggctgtcatacaaagtggccagtgagggcttccaatattctgatcgtcgctggtgctttgacggggaacgaaacaatcaggtcctcgaggaaaacatggatgttgagatatggactaaggagggagaaaggaaaaagttgaggccccggtggctggacgctcgcacgtactccgaccctctagccctgagagagttcaaagaatttgctgcaggtaggcggagcgtgtcaggcgatctcatccttgagattgggaagctgccgcagcacttaacccagcgagcccaaaatgctttggacaacctggtaatgctccataatagtgaacagggaggcagagcctatcgccacgcaatggaggagctgccagatacaatcgaaactcttatgctgctcgcgttgattgccgtgctgaccggtggggtcacattattctttctaagcggcaggggactgggcaagacctccatcgggctcctttgtgtgatggcttctagcgccctgttgtggatggcatccgttgagccccattggatagctgcctcaatcattctggagttctttctcatggtgctgcttatccctgagcccgaccggcagcgtactccacaggataaccaactcgcatacgtcgtaattggactgttgttcatgatcctgacggtggccgctaatgagatgggtttactagaaaccaccaaaaaggacctgggcatagggcacgttgcggtggagaaccaccatcacgccactatgctcgatattgaccttcatcctgcatctgcttggaccctgtacgccgtcgccacaaccatcattactcccatgatgagacacacaatcgaaaacacgaccgcaaatataagtttgactgctatcgccaaccaggcggctattctgatgggactcgataaaggctggccaatctcgaagatggacattggtgtgcctctgcttgccttagggtgctatagccaggtcaatccgctgacactcaccgcagccgtgttgatgctggttgctcattacgcaatcataggccccggactacaagccaaagcgaccagggaggctcagaagcgcacagccgcaggcattatgaagaacccaactgtggatgggatcgtagccatcgacctggatcctgtggtctatgacgctaaatttgaaaagcagctcggacagattatgcttctgatcttgtgtacgtcccaaatactgctcatgcggaccacatgggccctgtgcgagtctattactttagcaaccggcccccttacaaccctgtgggagggttcaccagggaaattctggaatactacgatcgctgttagcatggccaacatttttcgaggatcctacctcgcgggcgccggtctagcattcagtctgatgaagtctttgggcgggggaagaaggggcacaggggctcagggagaaaccctgggcgagaaatggaagcgccagctcaatcagcttagcaagtcagagttcaacacttataaacggtccggtatcatggaggtggacagaagtgaagccaaggaggggctgcgtaggggagagaccacaaaacacgcagtcagccggggcactgctaagttgcgctggtttgtggaacgaaatctggtaaaacctgagggtaaggtgatagatctcggctgtgggagaggaggctggtcttactattgcgccgggttaaagaaagttaccgaagtgaagggatacacaaaaggcggtcccgggcacgaggaaccgatcccaatggccacgtacggatggaacctggtcaaacttcattccggcaaagacgtgttctttattcctcccgagaagtgtgataccctgctatgcgacatcggcgagtcaagcccaaatcccactattgaagaggggaggacactccgggtcctgaaaatggtggaaccttggttgcgcggaaaccaattctgtatcaagattctgaatccgtatatgccctcggttgtagagaccctcgagcagatgcagagaaagcacggtggcatgcttgtgaggaacccactgtctcgaaatagtactcatgaaatgtactgggtctcctgcgggacaggaaacatcgtgagcgcggttaatatgacctcacggatgttactgaaccgttttacgatggctcacagaaaacctacctatgagcgcgatgtggacttgggcgcaggtacaaggcacgtcgccgtggaacccgaggtagctaacctcgatataattgggcagcggatcgaaaatatcaagcatgagcacaaatccacttggcattacgacgaggataacccttataagacctgggcctaccacggatcttatgaagtgaaaccaagcggcagtgcatccagcatggttaatggcgtcgtgaagctgctaacaaagccctgggacgtgattcctatggtcactcaaatagccatgaccgatacaaccccattcgggcagcagagagtttttaaagagaaggtggacactcgcacgcccaaagctaagaggggaacagcgcaaatcatggaagtaaccgcccgatggctttggggtttcctgtctcggaacaaaaagccgagaatttgtactagggaggaatttacccgcaaggtgcgttcaaatgcagctatcggcgccgtcttcgtggacgagaaccagtggaatagtgcaaaagaggccgttgaagatgagcggttttgggacctcgtgcatagagaaagggagctgcacaagcaggggaaatgcgctacatgcgtctacaacatgatgggaaagcgcgagaaaaagttgggcgagttcggtaaggccaaagggtcccgagcgatttggtacatgtggctgggagcacggtttctcgagttcgaagcccttggcttcatgaatgaggatcactggtttagcagagaaaactctctgtcgggcgtggagggggagggattacataagctgggttatatcttgagggacatatcaaaaatccctggcgggaatatgtacgctgatgacacggccggatgggatacccgcattactgaagacgatctccagaacgaggcaaagatcacagacattatggaaccagagcacgctctgctagccaccagcatcttcaaacttacttatcaaaataaggtagttagagtgcagcggcccgctaggaacggcacagtcatggatgtgatatcccgtcgagaccagcgcggtagtggacaggtgggaacctacggcctgaatacatttactaacatggaagcccaactcattagacagatggagtctgagggcatcttcagcccttccgaactggagaccccaaacttggcagaacgggtcttagattggctggagaaacatggggttgaaaggctcaagcgcatggcgatctcaggagacgactgtgtggtaaagcccattgatgacagatttgccacggctcttagtgccctgaatgatatgggtaaagtgcggaaggacataccgcagtgggagccttctaaaggctggaacgattggcagcaagtccccttctgcagccaccactttcatcagctaatcatgaaggacgggagggagattgtggttccatgtcgaaatcaggatgaactggtgggacgtgcaagagtctcccagggcgctggttggtcactccgcgagaccgcctgcttggggaaaagctatgcacaaatgtggcagctgatgtacttccaccggagggaccttagactggccgcgaacgctatctgttctgccgtgcctgtagattgggttcccacatcccgcactacctggagtattcatgcacaccatcagtggatgacaactgaagacatgctcagcgtgtggaatcgggtctggatcgaggaaaacccatggatggaggataagacccacatatcgtcctggggagacgtgccctatttaggcaagagggaggaccaatggtgcggctctctgatcgggttgacggcccgagctacatgggccaccaatattcaggttgcaatcaaccaggtgagacggctgattggaaatgaaaactacctcgattacatgacttcaatgaaaaggtttaagaatgacagcgatcctgagggtgctctttggtga

SEQ ID NO: 14037 - RNA, 9879 nt, synthetic construct
  misc_feature 1..9879: note = derived and/or modified CDS sequence (opt3) from DENV-1__EU482496__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaacgatctgattcgtctttgcataatggtgggcgccaatgcatctgacagaatggggatgggaacaacttacttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcatcagttgtgggcgactctcctgagcctaaccttcattaagacaactttttccctgcactatgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttacgtgattagtggttccagcgccgacttgtctttagagaaagcggctgaggtcagctgggaagaggaagccgagcattccggggcatcacacaatatcctggtggaagtacaggatgacggaaccatgaagatcaaagatgaggagcgcgacgatactctcacaattctgcttaaggccaccctgttggctgtgagtggcgtctatcccctaagcataccagcaacgctgttcgtttggtacttctggcagaaaaagaagcagcggtctggcgtgctctgggacactccttcacccccagaagtggagagagccgtcctggatgacgggatctataggattatgcagcgtggacttttaggtcgcagccaggtgggcgttggggtatttcaagaaaacgtgttccataccatgtggcacgtcacacggggagcggtgctgatgtaccagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacagcaccaggaacttttaagacccccgaaggtgaggtcggcgccatcgctctcgatttcaagcctgggacgtcgggaagcccaatagtgaaccgagaaggcaaaatcgttggtctgtatgggaatggagtggtcacaacttcaggcacctacgtgtccgccattgcacaggctaaggccagtcaggagggcccccttcctgagatcgaagacgaggtttttcggaaacgcaacctgacaattatggatttgcacccggggtctggaaagaccagaaggtatctaccagcgatcgtgcgggaagccataaaacgaaagctgagaactctcattttagcacccacccgcgtcgtggctagcgagatggccgaagctctgaagggtatgcctatcaggtaccaaacaacggcagtaaaatccgagcatactggcaaggagatcgtggaccttatgtgccacgccaccttcacaatgcgtctgctctcaccagttcgggtccccaattataacatgattatcatggatgaagcccattttaccgacccttctagcatagctgcgagagggtacattagtactagggtgggaatgggcgaggcagccgctatcttcatgacagccaccccgcccggttccgtggaagcatttccacagagcaatgccgtcattcaggatgaggaacgcgacatccctgagcgatcttggaactcagggtatgagtggataacggatttccccggaaaaactgtatggtttgtgccatccattaagagtggcaatgacatcgctaactgtttgaggaaaaatggcaagcgggttatccagctgagcaggaagacattcgataccgaataccagaaaaccaagaacaacgactgggactacgtggtcactacagatatttcggagatgggggcgaatttccgcgccgaccgtgtgatcgatcctagacggtgcctcaaacccgttattctgaaggacggaccagaaagggtgatacttgcaggtccgatgcctgtcaccgtggcttctgccgcacagcgccgaggcagaatcgggcggaaccacaataaagagggagatcagtatatttacatgggccagcccctaaacaatgacgaggatcatgcccactggacagaagctaagatgctgttggacaacatcaatactccagagggtatcattcccgccttatttgaacctgagagggaaaagtccgcggcaatagatggggagtatcgcctgagaggcgaggccaggaaaacgttcgtagaactcatgcggcgtggagacctgccagtgtggcttagctacaaggttgcttcagagggctttcaatatagtgatcgccgatggtgcttcgacggggaaagaaacaatcaggtcctggaggaaaacatggatgtggagatctggaccaaagagggagaaaggaagaaactccggccccgctggttggacgccagaacatactctgaccctctggctctaagggagtttaaggagttcgcagccggtcggcgatccgtgagcggcgatctgattctcgagatcgggaaacttccgcagcacctgactcagagagctcaaaatgccttagacaacttggtcatgctgcataattcagaacagggaggccgcgcatataggcacgcgatggaggagctcccagataccattgaaacactgatgcttctggccctcatcgctgttttgaccggtggggtgactctgtttttcttaagtggccggggactaggcaagacgagcatagggctgctctgtgtaatggcctcctctgtgcttctgtggatggcaagcgtcgagccccattggatcgctgcctccattatcttggaatttttcctgatggtgctcctgattcctgagcccgaccgtcagagaaccccacaggataaccaacttgcatacgttgtgatcggactcctgtttatgatattgacagtcgccgctaatgagatgggtctgttagaaactaccaagaaagacctaggcattgggcacgtagcggtggagaaccaccatcacgccgcaatgctggatgttgacctccatcctgcttcagcctggacactttacgccgtggcaaccactatcattacacccatgatgaggcacacgatcgaaaacaccactgctaatatatctctgacagccatcgcgaaccaggctgccattttgatgggactggataagggctggccaatcagtaaaatggacattggtgtccctctcctggcacttgggtgctatagccaggtgaatccgttaaccctgaccgccgctgtcctcatgttggtggcacattacgccatcataggccccggactgcaagcgaaggctacacgcgaggcccagaaacggactgcagccggcattatgaagaacccaacggttgatgggatcgtggctatcgacctagatcctgtagtgtatgacgccaagttcgaaaaacagctgggacagattatgctccttatcctgtgtaccagccaaatattgctgatgcgaacaacttgggcactctgcgagtccattaccctggctacaggccccttaaccactctttgggagggttctccagggaagttttggaatacgacaatcgccgtctcaatggcgaacattttcagaggaagctacctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctataagagatcaggtatcatggaggttgaccgttccgaagcaaaagaggggcttaagaggggagagacaactaaacacgctgtgagtcggggcaccgccaagctgcgctggttcgtcgaacgaaatttggtgaaacctgagggtaaggtaatagatctgggctgtgggagaggaggctggagctactattgcgccgggctcaagaaagtgacagaagttaagggatacacgaaaggcggtcccgggcacgaggaaccgatcccaatggcgacctacggatggaacttagtgaagctgcattctggcaaagacgtctttttcattcctcccgagaagtgtgatactcttctgtgcgacatcggcgagtcctcaccaaatcccacaattgaagaggggaggaccctacgggtgctcaaaatggtcgaaccttggctgcgcggaaaccaattttgtatcaagattttgaatccgtatatgcccagcgtggttgagactctggagcagatgcagagaaagcacggtggcatgctcgtaaggaacccactttcgcgaaattctacacatgaaatgtactgggtgagttgcgggaccggaaacatcgtctccgctgtgaatatgacgagccggatgctgttaaaccgtttcaccatggcacacagaaaacctacatatgagcgcgatgttgacctgggcgccggtactaggcacgtggctgtcgaacccgaggtggccaacttggatataattgggcagcggatcgaaaatatcaagcatgagcacaaatcaacctggcattacgacgaggataacccttataagacatgggcataccacggatcctatgaagtaaaaccatctggcagcgccagttccatggtgaatggcgttgtcaagctcctgactaagccctgggacgtgattcctatggtgacccaaatagctatgacagataccactccatttgggcagcagagagtcttcaaagagaaggttgacacgcgcacacccaaagcgaagaggggaaccgcccaaatcatggaagtgactgcaaaatggctatggggttttcttagccgaaacaagaagccgcggatttgtaccagagaggagttcacaaggaaagtacgctctaatgctgccatcggcgcagtgtttgtcgacgagaaccagtggaactcagccaaggaggctgtggaagatgagcgtttctgggacctggttcatcgggaaagagagctccacaaacaggggaagtgcgccacgtgcgtgtacaacatgatgggaaaaagggaaaagaagctgggcgagtttggtaaagcgaaggggagtcgcgcaatttggtacatgtggttgggagcccgattcctggagttcgaagctctcggctttatgaatgaggatcactggttctcccgggaaaacagcctttctggcgtcgagggggagggactgcataaattaggttatatcctgagagacatatcgaagatccctggcgggaatatgtacgccgatgacaccgcaggatgggatactaggattacagaagacgatttgcagaacgaggctcgcatcaccgacattatggaaccagagcacgccctcctggctaaatcaatctttaagctaacttatcaaaataaagtggtaagagttcagcggcccgccaagaacggcacagtgatggatgtcataagcaggcgtgaccagcgaggttccggacaggtgggaacctacggccttaatacattcactaacatggaagcacaactgattcgccagatggagagtgagggcatcttttctcctagcgaactcgagaccccaaacctggcggaaagagtgttggattggttaaagaaatatggggtcgagcggctgaagaggatggccatctccggagacgactgtgttgtgaaacccattgatgaccgcttcgctacggccctcaccgcacttaatgatatgggtaaggtaagaaaagacataccgcagtgggaaccttcaaagggctggaacgattggcagcaagtgcccttttgcagtcatcacttccaccagctgatcatgaaggacgggcgggagattgtcgtgccatgtaggaatcaggatgagctagttggacgagctcgtgtgtctcagggcgccggttggagcctgagagaaacagcatgcctcgggaaatcctacgcccaaatgtggcagttgatgtattttcatcgccgggacctgaggcttgcggctaacgccatctgttcagcagtccctgtggattggattcccactagcagaaccacatggtctatccacgcccatcaccagtggatgactaccgaggacatgctgtccgtatggaatcgcgtttggatagaagagaacccatggatggaagataagacgcatatcagtagctggggagacgtgccctacctcggcaaacgggaggaccaatggtgcggctcgttaattgggctgacagctagggccacctgggcaactaatatccaggtcgctattaaccaggtgcgaagattgatcggaaatgagaactacctggattatatgacatccatgaagcggttcaaaaatgaatctgaccctgagggtgccctctggtga

SEQ ID NO: 14038 - RNA, 9879 nt, synthetic construct
  misc_feature 1..9879: note = derived and/or modified CDS sequence (opt3) from DENV-1__EU482497__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaaggtacctggaatcggcaggacctgttggtaacattcaaaactgcacacgctaagaagcaggaggttgtggtcctcgggagtcaagaaggcgccatgcacaccgctctgacgggagccaccgagatccagacatctggcactaccacaatttttgcagggcatttaaaatgccgtctgaagatggataaactaactctcaagggaatgtcctatgtgatgtgtaccggtagcttcaaactggaaaaggaggtcgccgaaacgcagcacggcacagtgcttgttcagataaagtacgaggggaccgacgctccttgcaaaatcccattctcgactcaagatgagaagggagtgacacagaacggccgcttgattaccgcgaatcccatcgtaactgacaaagaaaagcctgtcaacatagaggcagaaccaccctttggtgagtcttatattgtgatcggggccggcgagaaagctctgaagctctcctggttcaagaaaggatcaagtatcggcaagatgtttgaagccaccgcaagaggggccaggcggatggctattctgggagatacagcctgggacttcggtagcatcggcggggtttttacgtccgtgggaaaacttgtccatcagattttcggcaccgcatacggtgtgctgttttctggggtaagctggactatgaagataggcatcggagtgttgctcacatggctgggcttaaattcacgaagtacctccctgagcatgacatgtattgcggttgggctagtcactctctacctgggagtgatggtgcaggctgattctggctgcgtcatcaactggaaaggtcgcgagcttaagtgtgggtcaggaatcttcgttaccaatgaagtgcacacgtggacagagcaatataagtttcaggccgacagtccgaaaagattgagcgcagccattggcaaggcttgggaagagggtgtgtgcggcataaggtccgccacccggctggagaacatcatgtggaaacagatttctaacgaactcaatcatatcctgttagagaacgacatgaagttcactgtagtcgtgggggatgttgcaggcattctggctcagggcaaaaagatgatccgccctcaacccatggaatacaaatattcgtggaaaagctgggggaaggccaagataatcggagcggacgtgcagaataccacatttattatcgatggcccaaacactcctgagtgtcccgacgatcagagagcctggaatatttgggaagtcgaggactacggtttcgggatctttaccacaaacatatggcttaagttgagggattcctatacacaggtgtgcgaccaccgtctcatgtcagctgcaattaaagatagtaaggccgttcacgctgacatgggatactggatcgagtctgagaaaaatgagacctggaagctggcccgggcgagcttcattgaagtgaagacttgtatctggccaaaatcccatacactatggtcaaacggcgtactggagagcgaaatgataatccccaagatttatggtggccctatctctcaacacaattaccgaccagggtacttcacccagactgcaggaccgtggcatctcggcaaactggagcttgattttgacttgtgcgaggggacaaccgtcgtggtggatgaacactgcggaaacagaggcccctccctgaggacgactaccgtcacaggtaagattatccacgagtggtgttgccgcagttgtaccttacctccactccggttcagaggggaagacggatgctggtatggcatggagataaggcccgttaaagagaaggaagagaatctggtgaagtccatggtatctgccggttccggcgaagtggactcatttagtcttgggctgttgtgtattagcatcatgatcgaggaagtcatgcgctcgcgatggtcccggaaaatgctcatgactggaacactggctgtgttctttctactgattatgggccagctcacctggaacgatctgatccgtctttgcattatggttggggccaatgcatctgacagaatgggaatgggcacaacttacttggctctgatggccaccttcaagatgaggcctatgtttgcagtgggtttactcttccgccggctgacgagcagagaggtccttctgctaacaatagggctctcactggtggccagtgttgagttgccaaactccctggaagagttaggagatggcctcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcgggtccctgggatgcaagcctcttacaatgtttctgatcgctgaaaataaaatatggggtaggcgaagctggccattgaacgagggcatcatggccgtggggattgtttcgatcctcctgtcatctctactgaagaacgatgtgccccttgccggacctctcattgctggcggtatgctgatcgcatgttacgtcataagtgggtccagcgccgacttgtctttagaaaaagcggctgaggtgagctgggaggaagaggccgaacattccggagcatcacacaatattctggtagaggtgcaggatgacggcaccatgaagatcaaagatgaagaacgcgacgatactctcacaatcctgcttaaggccaccctgttggctgtcagtggcgtttatcccctaagcattccagcaacgctgttcgtgtggtacttctggcagaaaaagaagcagcggtctggggtgctctgggacactccttcacccccagaggtcgaaagagccgtgctggatgacggaatatataggatcatgcagcgtggtcttttaggccgcagccaggttggggtaggagtgtttcaagagaacgtcttccataccatgtggcacgtgacacggggcgcggttctgatgtaccagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtatggaaatggcgtcgtgacaacttcaggcacctacgtttccgccatcgcacaggctaaggccagtcaggaagggccccttcctgagattgaggacgaagtgtttcggaaacgcaacctgacaatcatggatttgcacccgggatctggtaagaccagaaggtatctaccagcgattgtccgggaggccatcaaacgaaagctgagaactctcatattagcacccacccgcgtggtagctagcgaaatggccgaggctctgaagggcatgcctattaggtaccaaacaacggcagtgaaatccgaacatactgggaaggagatcgttgaccttatgtgccacgccaccttcacaatgcgtctgctctcaccagtccgggtgcccaattataacatgatcattatggatgaggcccattttaccgacccttctagcatcgctgcgagaggatacataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatatgagtggatcacggatttccccggcaaaactgtgtggtttgttccatccataaagagtggcaatgacattgctaactgtttgaggaaaaatgggaagcgggtgatccagctgagcaggaagacattcgataccgagtaccagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtatatctacatgggtcagcccctaaacaatgacgaggatcatgcccactggacagaggctaagatgctgttggacaacattaatactccagaagggatcatccccgccttatttgagcctgaaagggagaagtccgcggcaattgatggcgaatatcgcctgagaggagaggccaggaaaacgttcgtggagctcatgcggcgtggcgacctgccagtttggcttagctacaaggtcgcttcagaagggtttcaatatagtgatcgccgatggtgcttcgacggagagagaaacaatcaggtgctggaagagaacatggatgtggaaatatggaccaaagagggtgagaggaagaaactccggccccgctggttggacgccagaacatactctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatataggcacgcgatggaggaactcccagataccatcgagacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggaaccccattggatagctgcctccatcattttggagtttttcctgatggttctcctgatccctgaacccgaccgtcagagaaccccacaggataaccaacttgcatacgtggtcattggtctcctgtttatgatcttgacagtagccgctaatgagatgggcctgttagagactaccaagaaagacctagggataggacacgtggcggttgaaaaccaccatcacgccgcaatgctggatgtggacctccatcctgcttcagcctggacactttacgccgtcgcaaccactattatcacacccatgatgaggcacacgattgagaacaccactgctaatatctctctgacagccatagcgaaccaggctgccatcttgatgggcctggataagggttggccaattagtaaaatggacatcggggtgcctctcctggcacttggctgctattcgcaggtcaatccgttaaccctgaccgccgctgtgctcatgttggttgcacattacgccattatcggacccggcctgcaagcgaaggctacacgcgaagcccagaaacggactgcagccgggataatgaagaacccaacggtggatggaattgtagctatcgacctagatcctgtggtctatgacgccaagttcgagaaacagctgggccagatcatgctccttattctgtgtaccagccaaatcttgctgatgcgaacaacttgggcactctgcgaatccataaccctggctacaggtcccttaaccactctttgggaggggtctccaggaaagttttggaatacgacaattgccgtttcaatggcgaacatcttcagaggcagctacctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctataagagatcagggattatggaagtggaccgttccgaggcaaaagaaggacttaagaggggcgagacaactaaacacgctgtcagtcggggtaccgccaagctgcgctggttcgtggagcgaaatttggtaaaacctgaaggcaaggtgatcgatctggggtgtggaagaggcgggtggagctactattgcgccggactcaagaaagttacagaggtgaagggctacacgaaaggtgggcccggacacgaggagccgataccaatggcgacctacggctggaacttagtcaagctgcattctggcaaagacgtgtttttcatccctcccgaaaagtgtgatactcttctgtgcgacattggggagtcctcaccaaatcccacaatcgaggaaggaaggaccctacgggtcctcaaaatggtggagccttggctgcgcggtaaccaattttgtattaagatcttgaatccgtatatgcccagcgttgtagaaactctggagcagatgcagagaaagcacggcgggatgctcgtgaggaacccactttcgcgaaattctacacatgagatgtactgggtcagttgcggaaccggcaacattgtgtccgctgttaatatgacgagccggatgctgttaaaccgtttcaccatggcacacagaaaacctacatatgaacgcgatgtggacctgggtgccgggactaggcacgtcgctgtggagcccgaagtagccaacttggatatcataggacagcggattgagaatatcaagcatgaacacaaatcaacctggcattacgacgaggataacccttataagacatgggcataccacggctcctatgaggtgaaaccatctggcagcgccagttccatggttaatggggtcgtgaagctcctgactaagccctgggacgtgatccctatggtcacccaaattgctatgacagataccactccatttggacagcagagagttttcaaagaaaaggtggacacgcgcacacccaaagcgaagaggggtaccgcccaaataatggaggtaactgcaaaatggctatggggctttcttagccgaaacaagaagccgcggatctgtaccagagaagagttcacaaggaaagtgcgctctaatgctgccattggggcagtctttgtggacgaaaaccagtggaactcagccaaggaggctgttgaggatgaacgtttctgggacctggtgcatcgggagagagaactccacaaacagggaaagtgcgccacgtgcgtctacaacatgatgggcaaaagggagaagaagctgggtgaatttgggaaagcgaagggaagtcgcgcaatctggtacatgtggttgggcgcccgattcctggagttcgaggctctcggctttatgaatgaagatcactggttctcccgggagaacagcctttctggggtggaaggagagggtctgcataaattaggctatattctgagagacatctcgaagatacctgggggaaatatgtacgccgatgacaccgcaggctgggatactaggatcacagaggacgatttgcagaacgaagctcgcattaccgacactatggagccagaacacgccctcctggctagatcaatctttaaactaacatatcaaaataaggtagttcgggtgcagaggcccgccaaaaacggtaccgtcatggatgtgattagccgtcgagaccagcgcgggtccggacaggtgggcacatacggccttaatactttcaccaacatggaggcacaactgatcagacagatggaaagtgaggggatattttctcctagcgagctcgaaacgccaaacctggcggagcgggtcttggattggttagaaaagtatggagttgagaggctgaagcgcatggccatttccggtgacgactgtgtggtaaaacccatcgatgacagattcgctaccgccctcacagcacttaatgatatgggcaaggtgcggaaagacatcccgcagtgggaaccttcaaaggggtggaacgattggcagcaagtccccttttgcagtcatcacttccaccagctgattatgaaagacggaagggagatagtggttccatgtcgaaatcaggatgagctagtgggccgtgctagagtctctcagggtgccgggtggagcctgcgcgaaactgcatgcctcggaaagtcctacgcccaaatgtggcagttgatgtattttcatcggagggacctgagacttgcggctaacgccatctgttcagcagtgcctgtagattggattcccaccagccgcacaacttggtctatccacgcccatcaccagtggatgaccacggaggacatgctgtccgtttggaatcgggtgtggattgaagagaacccatggatggaagataagacacatatcagtagctggggcgacgtcccctacctcggcaaaagggaggaccaatggtgcgggtcgttaataggactgaccgctcgagccacttgggcaacaaatatccaggtggctattaaccaggttagacggttgatcggtaatgagaactacctggattatatgacctccatgaagaggttcaaaaatgaatctgaccctgagggcgccctctggtga

SEQ ID NO: 14039 - RNA, 9879 nt, synthetic construct
  misc_feature 1..9879: note = derived and/or modified CDS sequence (opt3) from DENV-1__EU482499__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcccacacgcaggtctgcgaccaccgtctcatgtcagctgcaatcaaagatagtaaggccgtgcatgctgacatggggtattggattgaatctgagaaaaatgaaacctggaagctggcccgggcatccttcatcgaggttaagacttgtatatggccaaaatcccacacactatggtcaaacggagtgctggaaagcgagatgatcattcccaagatctacggcggtcctatttctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagatcatacatgaatggtgttgccgcagttgtaccttacctccactccggttcagaggtgaggacgggtgctggtacggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaacgatctgattcgtctttgcataatggtgggcgccaatgcatctgacagaatggggatgggaacaacttatttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcaccagttgtgggcgactctcctgagcctaaccttcattaagacaactttttccctgcattacgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttatgtgattagtggttccagcgccgacttgtctttagagaaagcggctgaggtcagctgggaagaggaagccgagcactccggggcatcacataatatcctggtggaagtacaggatgacggaaccatgaagatcaaagatgaggagcgcgacgatactctcacaattctgcttaaggccaccctgttggctgtgagtggcgtctaccccctaagcataccagcaacgctgttcgtttggtatttctggcagaaaaagaagcagcggtctggcgtgctctgggacactccttcacccccagaagtggagagagccgtcctggatgacgggatctacaggattatgcagcgtggacttttaggtcgcagccaggtgggcgttggggtatttcaagaaaacgtgttccacaccatgtggcacgtcacacggggagcggtgctgatgtatcagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacagcaccaggaacttttaagacccccgaaggtgaggtcggcgccatcgctctcgatttcaagcctgggacgtcgggaagcccaatagtgaaccgagaaggcaaaatcgttggtctgtacgggaatggagtggtcacaacttcaggcacctatgtgtccgccattgcacaggctaaggccagtcaggagggcccccttcctgagatcgaagacgaggtttttcggaaacgcaacctgacaattatggatttgcatccggggtctggaaagaccagaaggtacctaccagcgatcgtgcgggaagccataaaacgaaagctgagaactctcattttagcacccacccgcgtcgtggctagcgagatggccgaagctctgaagggtatgcctatcaggtatcaaacaacggcagtaaaatccgagcacactggcaaggagatcgtggaccttatgtgccatgccaccttcacaatgcgtctgctctcaccagttcgggtccccaattacaacatgattatcatggatgaagcccactttaccgacccttctagcatagctgcgagagggtatattagtactagggtgggaatgggcgaggcagccgctatcttcatgacagccaccccgcccggttccgtggaagcatttccacagagcaatgccgtcattcaggatgaggaacgcgacatccctgagcgatcttggaactcagggtacgagtggataacggatttccccggaaaaactgtatggtttgtgccatccattaagagtggcaatgacatcgctaactgtttgaggaaaaatggcaagcgggttatccagctgagcaggaagacattcgataccgaatatcagaaaaccaagaacaacgactgggactacgtggtcactacagatatttcggagatgggggcgaatttccgcgccgaccgtgtgatcgatcctagacggtgcctcaaacccgttattctgaaggacggaccagaaagggtgatacttgcaggtccgatgcctgtcaccgtggcttctgccgcacagcgccgaggcagaatcgggcggaaccataataaagagggagatcagtacatttatatgggccagcccctaaacaatgacgaggatcacgcccactggacagaagctaagatgctgttggacaacatcaatactccagagggtatcattcccgccttatttgaacctgagagggaaaagtccgcggcaatagatggggagtaccgcctgagaggcgaggccaggaaaacgttcgtagaactcatgcggcgtggagacctgccagtgtggcttagctataaggttgcttcagagggctttcaatacagtgatcgccgatggtgcttcgacggggaaagaaacaatcaggtcctggaggaaaacatggatgtggagatctggaccaaagagggagaaaggaagaaactccggccccgctggttggacgccagaacatattctgaccctctggctctaagggagtttaaggagttcgcagccggtcggcgatccgtgagcggcgatctgattctcgagatcgggaaacttccgcagcatctgactcagagagctcaaaatgccttagacaacttggtcatgctgcacaattcagaacagggaggccgcgcatacaggcatgcgatggaggagctcccagataccattgaaacactgatgcttctggccctcatcgctgttttgaccggtggggtgactctgtttttcttaagtggccggggactaggcaagacgagcatagggctgctctgtgtaatggcctcctctgtgcttctgtggatggcaagcgtcgagccccactggatcgctgcctccattatcttggaatttttcctgatggtgctcctgattcctgagcccgaccgtcagagaaccccacaggataaccaacttgcatatgttgtgatcggactcctgtttatgatattgacagtcgccgctaatgagatgggtctgttagaaactaccaagaaagacctaggcattgggcacgtagcggtggagaaccatcaccatgccgcaatgctggatgttgacctccaccctgcttcagcctggacactttacgccgtggcaaccactatcattacacccatgatgaggcatacgatcgaaaacaccactgctaatatatctctgacagccatcgcgaaccaggctgccattttgatgggactggataagggctggccaatcagtaaaatggacattggtgtccctctcctggcacttgggtgctacagccaggtgaatccgttaaccctgaccgccgctgtcctcatgttggtggcacactatgccatcataggccccggactgcaagcgaaggctacacgcgaggcccagaaacggactgcagccggcattatgaagaacccaacggttgatgggatcgtggctatcgacctagatcctgtagtgtacgacgccaagttcgaaaaacagctgggacagattatgctccttatcctgtgtaccagccaaatattgctgatgcgaacaacttgggcactctgcgagtccattaccctggctacaggccccttaaccactctttgggagggttctccagggaagttttggaatacgacaatcgccgtctcaatggcgaacattttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtatcatggaggttgaccgttccgaagcaaaagaggggcttaagaggggagagacaactaaacacgctgtgagtcggggcaccgccaagctgcgctggttcgtcgaacgaaatttggtgaaacctgagggtaaggtaatagatctgggctgtgggagaggaggctggagctattactgcgccgggctcaagaaagtgacagaagttaagggatatacgaaaggcggtcccgggcatgaggaaccgatcccaatggcgacctacggatggaacttagtgaagctgcactctggcaaagacgtctttttcattcctcccgagaagtgtgatactcttctgtgcgacatcggcgagtcctcaccaaatcccacaattgaagaggggaggaccctacgggtgctcaaaatggtcgaaccttggctgcgcggaaaccaattttgtatcaagattttgaatccgtacatgcccagcgtggttgagactctggagcagatgcagagaaagcatggtggcatgctcgtaaggaacccactttcgcgaaattctacacacgaaatgtattgggtgagttgcgggaccggaaacatcgtctccgctgtgaatatgacgagccggatgctgttaaaccgtttcaccatggcacacagaaaacctacatacgagcgcgatgttgacctgggcgccggtactaggcatgtggctgtcgaacccgaggtggccaacttggatataattgggcagcggatcgaaaatatcaagcacgagcataaatcaacctggcactatgacgaggataacccttacaagacatgggcatatcatggatcctacgaagtaaaaccatctggcagcgccagttccatggtgaatggcgttgtcaagctcctgactaagccctgggacgtgattcctatggtgacccaaatagctatgacagataccactccatttgggcagcagagagtcttcaaagagaaggttgacacgcgcacacccaaagcgaagaggggaaccgcccaaatcatggaagtgactgcaaaatggctatggggttttcttagccgaaacaagaagccgcggatttgtaccagagaggagttcacaaggaaagtacgctctaatgctgccatcggcgcagtgtttgtcgacgagaaccagtggaactcagccaaggaggctgtggaagatgagcgtttctgggacctggttcaccgggaaagagagctccacaaacaggggaagtgcgccacgtgcgtgtataacatgatgggaaaaagggaaaagaagctgggcgagtttggtaaagcgaaggggagtcgcgcaatttggtacatgtggttgggagcccgattcctggagttcgaagctctcggctttatgaatgaggatcattggttctcccgggaaaacagcctttctggcgtcgagggggagggactgcacaaattaggttacatcctgagagacatatcgaagatccctggcgggaatatgtatgccgatgacaccgcaggatgggatactaggattacagaagacgatttgcagaacgaggctcgcatcaccgacattatggaaccagagcatgccctcctggctaaatcaatctttaagctaacttaccaaaataaagtggtaagagttcagcggcccgccaagaacggcacagtgatggatgtcataagcaggcgtgaccagcgaggttccggacaggtgggaacctatggccttaatacattcactaacatggaagcacaactgattcgccagatggagagtgagggcatcttttctcctagcgaactcgagaccccaaacctggcggaaagagtgttggattggttaaagaaatacggggtcgagcggctgaagaggatggccatctccggagacgactgtgttgtgaaacccattgatgaccgcttcgctacggccctcaccgcacttaatgatatgggtaaggtaagaaaagacataccgcagtgggaaccttcaaagggctggaacgattggcagcaagtgcccttttgcagtcaccacttccatcagctgatcatgaaggacgggcgggagattgtcgtgccatgtaggaatcaggatgagctagttggacgagctcgtgtgtctcagggcgccggttggagcctgagagaaacagcatgcctcgggaaatcctatgcccaaatgtggcagttgatgtactttcaccgccgggacctgaggcttgcggctaacgccatctgttcagcagtccctgtggattggattcccactagcagaaccacatggtctatccatgcccaccatcagtggatgactaccgaggacatgctgtccgtatggaatcgcgtttggatagaagagaacccatggatggaagataagacgcacatcagtagctgggaggacgtgccctatctcggaaaacgggaggaccaatggtgcggctcgttaattggcctgacagctagggccacctgggcaactaatatccaggtcgctattaaccaggtgcgaagattgatcgggaatgaaaactacctggattacatgacatccatgaagcggttcaaaaatgagggagaccctgaaggtgccctctggtga

SEQ ID NO: 14040 - RNA, 9879 nt, synthetic construct
  misc_feature 1..9879: note = derived and/or modified CDS sequence (opt3) from DENV-1__EU482500__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggatcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcccacacgcaggtctgcgaccaccgtctcatgtcagctgcaatcaaagatagtaaggccgtgcatgctgacatggggtattggattgaatctgagaaaaatgaaacctggaagctggcccgggcatccttcatcgaggttaagacttgtatatggccaaaatcccacacactatggtcaaacggagtgctggaaagcgagatgatcattcccaagatctacggcggtcctatttctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagatcatacatgaatggtgttgccgcagttgtaccttacctccactccggttcagaggtgaggacgggtgctggtacggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaacgatctgattcgtctttgcataatggtgggcgccaatgcatctgacagaatggggatgggaacaacttatttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcaccagttgtgggcgactctcctgagcctaaccttcattaagacaactttttccctgcattacgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttatgtgattagtggttccagcgccgacttgtctttagagaaagcggctgaggtcagctgggaagaggaagccgagcactccggggcatcacataatatcctggtggaagtacaggatgacggaaccatgaagatcaaagatgaggagcgcgacgatactctcacaattctgcttaaggccaccctgttggctgtgagtggcgtctaccccctaagcataccagcaacgctgttcgtttggtatttctggcagaaaaagaagcagcggtctggcgtgctctgggacactccttcacccccagaagtggagagagccgtcctggatgacgggatctacaggattatgcagcgtggacttttaggtcgcagccaggtgggcgttggggtatttcaagaaaacgtgttccacaccatgtggcacgtcacacggggagcggtgctgatgtatcagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacagcaccaggaacttttaagacccccgaaggtgaggtcggcgccatcgctctcgatttcaagcctgggacgtcgggaagcccaatagtgaaccgagaaggcaaaatcgttggtctgtacgggaatggagtggtcacaacttcaggcacctatgtgtccgccattgcacaggctaaggccagtcaggagggcccccttcctgagatcgaagacgaggtttttcggaaacgcaacctgacaattatggatttgcatccggggtctggaaagaccagaaggtacctaccagcgatcgtgcgggaagccataaaacgaaagctgagaactctcattttagcacccacccgcgtcgtggctagcgagatggccgaagctctgaagggtatgcctatcaggtatcaaacaacggcagtaaaatccgagcacactggcaaggagatcgtggaccttatgtgccatgccaccttcacaatgcgtctgctctcaccagttcgggtccccaattacaacatgattatcatggatgaagcccactttaccgacccttctagcatagctgcgagagggtatattagtactagggtgggaatgggcgaggcagccgctatcttcatgacagccaccccgcccggttccgtggaagcatttccacagagcaatgccgtcattcaggatgaggaacgcgacatccctgagcgatcttggaactcagggtacgagtggataacggatttccccggaaaaactgtatggtttgtgccatccattaagagtggcaatgacatcgctaactgtttgaggaaaaatggcaagcgggttatccagctgagcaggaagacattcgataccgaatatcagaaaaccaagaacaacgactgggactacgtggtcactacagatatttcggagatgggggcgaatttccgcgccgaccgtgtgatcgatcctagacggtgcctcaaacccgttattctgaaggacggaccagaaagggtgatacttgcaggtccgatgcctgtcaccgtggcttctgccgcacagcgccgaggcagaatcgggcggaaccataataaagagggagatcagtacatttatatgggccagcccctaaacaatgacgaggatcacgcccactggacagaagctaagatgctgttggacaacatcaatactccagagggtatcattcccgccttatttgaacctgagagggaaaagtccgcggcaatagatggggagtaccgcctgagaggcgaggccaggaaaacgttcgtagaactcatgcggcgtggagacctgccagtgtggcttagctataaggttgcttcagagggctttcaatacagtgatcgccgatggtgcttcgacggggaaagaaacaatcaggtcctggaggaaaacatggatgtggagatctggaccaaagagggagaaaggaagaaactccggccccgctggttggacgccagaacatattctgaccctctggctctaagggagtttaaggagttcgcagccggtcggcgatccgtgagcggcgatctgattctcgagatcgggaaacttccgcagcatctgactcagagagctcaaaatgccttagacaacttggtcatgctgcacaattcagaacagggaggccgcgcatacaggcatgcgatggaggagctcccagataccattgaaacactgatgcttctggccctcatcgctgttttgaccggtggggtgactctgtttttcttaagtggccggggactaggcaagacgagcatagggctgctctgtgtaatggcctcctctgtgcttctgtggatggcaagcgtcgagccccactggatcgctgcctccattatcttggaatttttcctgatggtgctcctgattcctgagcccgaccgtcagagaaccccacaggataaccaacttgcatatgttgtgatcggactcctgtttatgatattgacagtcgccgctaatgagatgggtctgttagaaactaccaagaaagacctaggcattgggcacgtagcggtggagaaccatcaccatgccgcaatgctggatgttgacctccaccctgcttcagcctggacactttacgccgtggcaaccactatcattacacccatgatgaggcatacgatcgaaaacaccactgctaatatatctctgacagccatcgcgaaccaggctgccattttgatgggactggataagggctggccaatcagtaaaatggacattggtgtccctctcctggcacttgggtgctacagccaggtgaatccgttaaccctgaccgccgctgtcctcatgttggtggcacactatgccatcataggccccggactgcaagcgaaggctacacgcgaggcccagaaacggactgcagccggcattatgaagaacccaacggttgatgggatcgtggctatcgacctagatcctgtagtgtacgacgccaagttcgaaaaacagctgggacagattatgctccttatcctgtgtaccagccaaatattgctgatgcgaacaacttgggcactctgcgagtccattaccctggctacaggccccttaaccactctttgggagggttctccagggaagttttggaatacgacaatcgccgtctcaatggcgaacattttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtatcatggaggttgaccgttccgaagcaaaagaggggcttaagaggggagagacaactaaacacgctgtgagtcggggcaccgccaagctgcgctggttcgtcgaacgaaatttggtgaaacctgagggtaaggtaatagatctgggctgtgggagaggaggctggagctattactgcgccgggctcaagaaagtgacagaagttaagggatatacgaaaggcggtcccgggcatgaggaaccgatcccaatggcgacctacggatggaacttagtgaagctgcactctggcaaagacgtctttttcattcctcccgagaagtgtgatactcttctgtgcgacatcggcgagtcctcaccaaatcccacaattgaagaggggaggaccctacgggtgctcaaaatggtcgaaccttggctgcgcggaaaccaattttgtatcaagattttgaatccgtacatgcccagcgtggttgagactctggagcagatgcagagaaagcatggtggcatgctcgtaaggaacccactttcgcgaaattctacacacgaaatgtattgggtgagttgcgggaccggaaacatcgtctccgctgtgaatatgacgagccggatgctgttaaaccgtttcaccatggcacacagaaaacctacatacgagcgcgatgttgacctgggcgccggtactaggcatgtggctgtcgaacccgagatagccaacttggatattatcgggcagcggatcgaaaatattaagcacgagcataaatcaacctggcactatgacgaggataacccttacaagacatgggcatatcatggatcctacgaagtgaaaccatctggcagcgccagttccatggtaaatggcgtggttaagctcctgactaagccctgggacgtcatacctatggtgacccaaatcgctatgacagataccactccatttgggcagcagagagtgttcaaagagaaggtcgacacgcgcacacccaaagcgaagaggggaaccgcccaaattatggaagttactgcaaaatggctatggggttttcttagccgaaacaagaagccgcggatctgtaccagagaggagttcacaaggaaagtgcgctctaatgctgccattggcgcagtatttgtggacgagaaccagtggaactcagccaaggaggctgtcgaagatgagcgtttctgggacctggtgcaccgggaaagagagctccacaaacaggggaagtgcgccacgtgcgtttataacatgatgggaaaaagggaaaagaagctgggcgagtttggtaaagcgaaggggagtcgcgcaatctggtacatgtggttgggagcccgattcctggagttcgaagctctcggctttatgaatgaggatcattggttctcccgggaaaacagcctttctggcgtggagggggagggactgcacaaattaggttacatactgagagacatctcgaagattcctggcgggaatatgtatgccgatgacaccgcaggatgggatactaggatcacagaagacgatttgcagaacgaggctcgcattaccgacatcatggaagccgagcatgctctcctggccaaatcaatatttaagctaacttaccaaaataaagtcgtgagagtacagcggccagcaaagaacggcacagttatggatgtgattagcaggcgtgaccagcgaggttccgggcaggtcggaacctatggccttaatacattcactaacatggaagcgcaactgatccgccagatggagagtgagggcatcttttctcccagcgaactcgagacccctaacctggccgaaagagtgttggattggttagagaagtacggggtggaacggctgaaaaggatggctatttccggagacgactgtgtcgttaagccaatagatgaccgcttcgccacggcactcaccgctcttaatgatatgggtaaagtgagaaaggacatcccccagtgggagccgtcaaaaggctggaacgattggcagcaagtacctttttgcagtcaccacttccatcagctgattatgaaggacgggcgggagatcgtggtcccctgtaggaatcaggatgagctagtgggacgagcccgtgtttctcagggcgcaggttggagcctgagagagacagcctgcctcgggaagtcctatgcgcaaatgtggcagttgatgtactttcaccgccgggacctgaggcttgctgccaacgcaatttgttcagccgtgccagtcgattggatccctactagcagaaccacatggtctatacatgctcaccatcagtggatgactaccgaagacatgctgtccgtgtggaatcgcgtatggatcgaggaaaacccctggatggaggataaaacgcacattagtagctggggagacgttccatatctcggcaagcgggaggaccaatggtgcggctcgttaatcgggctgacagccagggcaacctgggctactaatattcaggtggccatcaaccaggtccgaagattgattggaaatgaaaactacctggattacatgacatccatgaaacggttcaagaatgagggtgaccccgaaggcgcgctctggtga

SEQ ID NO: 14041 - RNA, 9879 nt, synthetic construct
  misc_feature 1..9879: note = derived and/or modified CDS sequence (opt3) from DENV-1__EU482501__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgggagagccgtgctggatgacggaatatataggatcatgcagcgtggtcttttaggccgcagccaggttggggtaggagtgtttcaagagaacgtcttccataccatgtggcacgtgacacggggcgcggttctgatgtaccagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtatggaaatggcgtcgtgacaacttcaggcacctacgtttccgccatcgcacaggctaaggccagtcaggaagggccccttcctgagattgaggacgaagtgtttcggaaacgcaacctgacaatcatggatttgcacccgggatctggtaagaccagaaggtatctaccagcgattgtccgggaggccatcaaacgaaagctgagaactctcatattagcacccacccgcgtggtagctagcgaaatggccgaggctctgaagggcatgcctattaggtaccaaacaacggcagtgaaatccgaacatactgggaaggagatcgttgaccttatgtgccacgccaccttcacaatgcgtctgctctcaccagtccgggtgcccaattataacatgatcattatggatgaggcccattttaccgacccttctagcatcgctgcgagaggatacataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatatgagtggatcacggatttccccggcaaaactgtgtggtttgttccatccataaagagtggcaatgacattgctaactgtttgaggaaaaatgggaagcgggtgatccagctgagcaggaagacattcgataccgagtaccagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtatatctacatgggtcagcccctaaacaatgacgaggatcatgcccactggacagaggctaagatgctgttggacaacattaatactccagaagggatcatccccgccttatttgagcctgaaagggagaagtccgcggcaattgatggcgaatatcgcctgagaggagaggccaggaaaacgttcgtggagctcatgcggcgtggcgacctgccagtttggcttagctacaaggtcgcttcagaagggtttcaatatagtgatcgccgatggtgcttcgacggagagagaaacaatcaggtgctggaagagaacatggatgtggaaatatggaccaaagagggtgagaggaagaaactccggccccgctggttggacgccagaacatactctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatataggcacgcgatggaggaactcccagataccatcgagacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggaaccccattggatagctgcctccatcattttggagtttttcctgatggttctcctgatccctgaacccgaccgtcagagaaccccacaggataaccaacttgcatacgtggtcattggtctcctgtttatgatcttgacagtagccgctaatgagatgggcctgttagagactaccaagaaagacctagggataggacacgtggcggttgaaaaccaccatcacgccgcaatgctggatgtggacctccatcctgcttcagcctggacactttacgccgtcgcaaccactattatcacacccatgatgaggcacacgattgagaacaccactgctaatatctctctgacagccatagcgaaccaggctgccatcttgatgggcctggataagggttggccaattagtaaaatggacatcggggtgcctctcctggcacttggctgctattcgcaggtcaatccgttaaccctgaccgccgctgtgctcatgttggttgcacattacgccattatcggacccggcctgcaagcgaaggctacacgcgaagcccagaaacggactgcagccgggataatgaagaacccaacggtggatggaattgtagctatcgacctagatcctgtggtctatgacgccaagttcgagaaacagctgggccagatcatgctccttattctgtgtaccagccaaatcttgctgatgcgaacaacttgggcactctgcgaatccataaccctggctacaggtcccttaaccactctttgggaggggtctccaggaaagttttggaatacgacaattgccgtttcaatggcgaacatcttcagaggcagctacctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctataagagatcagggattatggaagtggaccgttccgaggcaaaagaaggacttaagaggggcgagacaactaaacacgctgtcagtcggggtaccgccaagctgcgctggttcgtggagcgaaatttggtaaaacctgaaggcaaggtgatcgatctggggtgtggaagaggcgggtggagctactattgcgccggactcaagaaagttacagaggtgaagggctacacgaaaggtgggcccggacacgaggagccgataccaatggcgacctacggctggaacttagtcaagctgcattctggcaaagacgtgtttttcatccctcccgaaaagtgtgatactcttctgtgcgacattggggagtcctcaccaaatcccacaatcgaggaaggaaggaccctacgggtcctcaaaatggtggagccttggctgcgcggtaaccaattttgtattaagatcttgaatccgtatatgcccagcgttgtagaaactctggagcagatgcagagaaagcacggcgggatgctcgtgaggaacccactttcgcgaaattctacacatgagatgtactgggtcagttgcggaaccggcaacattgtgtccgctgttaatatgacgagccggatgctgttaaaccgtttcaccatggcacacagaaaacctacatatgaacgcgatgtggacctgggtgccgggactaggcacgtcgctgtggagcccgaagtagccaacttggatatcataggacagcggattgagaatatcaagcatgaacacaaatcaacctggcattacgacgaggataacccttataagacatgggcataccacggctcctatgaggtgaaaccatctggcagcgccagttccatggttaatggggtcgtgaagctcctgactaagccctgggacgtgatccctatggtcacccaaattgctatgacagataccactccatttggacagcagagagttttcaaagaaaaggtggacacgcgcacacccaaagcgaagaggggtaccgcccaaataatggaggtaactgcaaaatggctatggggctttcttagccgaaacaagaagccgcggatctgtaccagagaagagttcacaaggaaagtgcgctctaatgctgccattggggcagtctttgtggacgaaaaccagtggaactcagccaaggaggctgttgaggatgaacgtttctgggacctggtgcatcgggagagagaactccacaaacagggaaagtgcgccacgtgcgtctacaacatgatgggcaaaagggagaagaagctgggtgaatttgggaaagcgaagggaagtcgcgcaatctggtacatgtggttgggcgcccgattcctggagttcgaggctctcggctttatgaatgaagatcactggttctcccgggagaacagcctttctggggtggaaggagagggtctgcataaattaggctatattctgagagacatctcgaagatacctgggggaaatatgtacgccgatgacaccgcaggctgggatactaggatcacagaggacgatttgcagaacgaagctcgcattaccgacatcatggagccagaacacgccctcctggctaaatcaatttttaagctaacttatcaaaataaagtagttagagtgcagcggcccgccaagaacggtacagtcatggatgtgatcagcaggcgtgaccagcgagggtccggacaggtgggcacctacggccttaatacattcactaacatggaggcacaactgatacgccagatggaaagtgaggggatattttctcctagcgagctcgaaaccccaaacctggcggagagagtcttggattggttagaaaagtatggagttgagcggctgaaaaggatggccatctccggtgacgactgtgtggtaaagcccatcgatgaccgcttcgctacggccctcaccgcacttaatgatatgggcaaagtgagaaaggacattccgcagtgggaaccttcaaaagggtggaacgattggcagcaagtccccttttgcagtcatcacttccaccagctgataatgaaggacggacgggagatcgtggttccatgtaggaatcaggatgagctagtgggccgagctcgtgtctctcagggtgccgggtggagcctgagagaaacagcatgcctcggaaagtcctacgcccaaatgtggcagttgatgtattttcatcgccgggacctgaggcttgcggctaacgccatttgttcagcagtgcctgtagattggatccccactagcagaaccacatggtctattcacgcccatcaccagtggatgactaccgaggacatgctgtccgtttggaatcgcgtgtggatcgaagagaacccatggatggaagataaaacgcatataagtagctggggcgacgtcccctacctcggcaagcgggaggaccaatggtgcgggtcgttaatcggactgacagctagggccacctgggcaactaatattcaggtggctatcaaccaggttcgaagattgattggtaatgagaactacctggattatatgacatccatgaaacggttcaagaatgaatctgaccctgagggcgccctctggtga

SEQ ID NO: 14042 - RNA, 9879 nt, synthetic construct
  misc_feature 1..9879: note = derived and/or modified CDS sequence (opt3) from DENV-1__EU482504__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaacatgtgcacactaattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggtgactctcctgagcctaaccttcatcaagacaactttttccctgcactatgcgtggaaaaccatggccatggtcctttcaattgtaagcctcttccccctgtgtttgagtacgacatctcagaagaccacttggctgccggtgttactcggctccctggggtgcaagcctcttacaatgtttctgatcgcagagaataaaatatggggaaggcgaagctggccattgaacgaaggtatcatggctgttggcattgtgtcgatcctcctgtcatctctactgaagaacgatgtcccccttgccgggcctctcattgccggaggcatgctgatcgcttgttacgtgataagtggttccagcgcagacttgtctttagagaaagccgcggaggtaagctgggaagaggaagctgagcattccggggcctcacacaatattctggtggaagtccaggatgacggaaccatgaagatcaaagatgaggagcgcgacgatactctcacaatcctgcttaaggcaaccctgttggccgttagtggcgtgtatcccctaagcattccagctacgctgttcgtgtggtacttctggcagaaaaagaagcagcggtctggcgtcctctgggacactccttcacccccagaagtggagagagcagttctggatgacgggatatataggatcatgcagcgtggacttttaggtcgcagccaggtaggcgtgggggtctttcaagaaaacgtgttccataccatgtggcacgttacacggggagccgtgctgatgtaccagggcaaaagactcgagccgagttgggcgagcgtcaagaaagacttgatttcctacggtgggggatggaggctgcagggctcttggaataccggcgaggaagtgcaggtaatcgctgtcgagcctgggaagaaccccaaaaatgtgcaaacagccccaggaacttttaagacccccgaaggtgaggttggcgcaattgccctcgatttcaagcctgggacgtcgggaagcccaatcgtgaaccgagaaggcaaaatagtcggtctgtatgggaatggagtggttacaacttcaggcacctacgtgtccgctatcgcccaggcaaaggctagtcaggagggcccccttcctgagattgaagacgaggtctttcggaaacgcaacctgacaatcatggatttgcacccggggtctggaaagaccagaaggtatctaccagccattgtgcgggaagcgatcaaacgaaagctgagaactctcatattagcccccacccgcgtagtggcaagcgagatggctgaagccctgaagggtatgcctattaggtaccaaacaacggctgttaaatccgagcatactggcaaggagatcgtcgaccttatgtgccacgcaaccttcacaatgcgtctgctctcaccagtgcgggtgcccaattataacatgatcattatggatgaagcccattttaccgacccttctagcatcgccgctagagggtacataagtactagggtcggaatgggcgaggcggcagccattttcatgacagctaccccgcccggttccgtagaagcctttccacagagcaatgcagtgatccaggatgaggaacgcgacattcctgagcgatcttggaactcagggtatgagtggatcacggatttccccggaaaaactgtttggtttgtgccatccataaagagtggcaatgacattgccaactgtttgaggaaaaatggcaagcgggtcatccagctgagcaggaagacattcgataccgaataccagaaaaccaagaacaacgactgggactacgtggttactacagatatctcggagatgggggctaatttccgcgcggaccgtgtgattgatcctagacggtgcctcaaacccgtcatcctgaaggacggaccagaaagggtgattcttgccggtccgatgcctgtaaccgtggcatctgctgcccagcgccgaggcagaatagggcggaaccacaataaagagggagatcagtatatctacatgggccagcccctaaacaatgacgaggatcatgcacactggacagaagccaagatgctgttggacaacattaatactccagagggtatcatccccgctttatttgaacctgagagggaaaagtccgccgcgattgatggggagtatcgcctgagaggcgaggcaaggaaaacgttcgttgaactcatgcggcgtggagacctgccagtctggcttagctacaaggtggcctcagagggctttcaatatagtgatcgccgatggtgcttcgacggggaaagaaacaatcaggtgctggaggaaaacatggatgtcgagatatggaccaaagagggagaaaggaagaaactccggccccgctggttggacgctagaacatactctgaccctctggccctaagggagtttaaggagttcgctgcaggtcggcgatccgttagcggcgatctgatctcagagattgggaaactcccgcagcaccttactcagagagcccaaaatgctctggacaacttagtgatgttgcataatagtgaacagggaggccgcgcctataggcacgcaatggaggagctgccagataccatcgaaacactcatgctgcttgcgctgattgccgtactcaccggtggggtgactttgtttttcctgagcggccggggattaggcaagacgtccatcgggctactgtgtgtcatggcttctagcgtgctcctttggatggcctccgttgagccccattggatagcagcttcaatcattctggaatttttcttgatggtgctgctcatccctgagcccgaccgtcagagaaccccacaggataaccaactggcctacgtcgtaattggacttctctttatgatcctgacagtggcagccaatgagatgggtttgctggaaactaccaagaaagacttaggcatagggcacgttgctgtggagaaccaccatcacgcggccatgctagatgtcgacctgcatcctgcatctgcttggacactctacgccgtggccaccactattatcacacccatgatgaggcacacgattgaaaacaccactgcaaatatcagtcttacagctatagccaaccaggcggctatcctgatgggattggataagggctggccaatttcgaaaatggacatcggtgtccctctgctcgccctggggtgctatagccaggtgaatccgcttaccttaaccgcagccgttctgatgctcgtggctcattacgcaattatcggccccggattgcaagccaaggcgacacgcgaggctcagaaacggactgccgcaggcataatgaagaacccaacggtagatgggattgtggccatcgacctggatcctgtcgtttatgacgctaagttcgaaaaacagctaggacagatcatgctgctcattctttgtacctcccaaatcctgttgatgcgaacaacttgggccctgtgcgagtctataaccctcgcaacaggccccctgaccactttatgggagggttcaccagggaagttttggaatacgacaattgctgtgagcatggccaacatcttcagaggatcctaccttgcgggcgccggtctggcattcagtctcatgaaatctctaggcgggggaaggcgcggcaccggggctcagggagaaactctgggcgagaagtggaaacggcagttgaatcagctgagcaagtcagaatttaacacctataagagatccggtattatggaggtcgaccgtagtgaagccaaagaggggctcaagaggggagagacaactaaacacgcagtgagccggggcaccgctaaacttcgctggttcgtagaacgaaatctggtgaaacctgagggtaaggttatcgatttgggctgtgggagaggaggctggtcttactattgcgccgggctgaagaaagtgacagaagtcaagggatacacgaaaggcggtcccgggcacgaggaaccgataccaatggccacctacggatggaacctcgtgaagttacattccggcaaagacgtctttttcatccctcccgagaagtgtgatactctgctttgcgacattggcgagtcaagcccaaatcccacaatcgaagaggggaggaccctgcgggtgctaaaaatggttgaaccttggctccgcggaaaccaattttgtattaagatcctgaatccgtatatgccctcggtagtggagactttggagcagatgcagagaaagcacggtggcatgctggtcaggaacccactctctcgaaatagtacacatgaaatgtactgggtgtcctgcgggaccggaaacattgttagcgcggtgaatatgacgtcacggatgcttctgaaccgtttcaccatggctcacagaaaacctacatatgagcgcgatgtcgacttaggcgcaggtactaggcacgtggccgtagaacccgaggtggctaacctggatatcatagggcagcggattgaaaatatcaagcatgagcacaaatccacctggcattacgacgaggataacccttataagacatgggcctaccacggatcttatgaagttaaaccaagcggcagtgcatccagcatggtcaatggcgtggtgaagttgctcactaagccctgggacgtcatccctatggttacccaaattgccatgacagataccactccatttgggcagcagagagtgttcaaagagaaggtagacacgcgcacacccaaagctaagaggggaaccgcgcaaataatggaagtgactgccaaatggctgtggggttttctatctcgaaacaagaagccgcggatctgtaccagagaggagttcacaaggaaagtccgctcaaatgcagctattggcgccgtgtttgttgacgagaaccagtggaatagtgcaaaggaggccgtggaagatgagcgtttctgggaccttgtccatcgggaaagagagctgcacaaacaggggaagtgcgctacgtgcgtgtacaacatgatgggaaaaagggaaaagaagctcggcgagtttggtaaagccaaggggtcccgcgcgatctggtacatgtggctgggagcacgattcttggagttcgaagccctgggctttatgaatgaggatcactggttcagccgggaaaactctctctcgggcgtagagggggagggacttcataaactgggttatattttaagagacatctcaaagatacctggcgggaatatgtacgctgatgacaccgccggatgggatactaggatcacagaagacgatctgcagaacgaggcacgcattaccgacatcatggaaccagagcacgctttgctcgccaaaagcatttttaagctgacttatcaaaataaagttgtgagagtccagcggcccgctaagaacggcacagtgatggatgtgatctccaggcgtgaccagcgaggtagtgggcaggtcggaacctacggcctaaatacattcactaacatggaagcccaacttatacgccagatggagtctgagggcatttttagcccttccgaactggagaccccaaacctcgcagaaagagttctggattggttggagaagtatgggatcgaacggttaaaaaggatggcgatctcaggagacgactgtgtggtaaagcccattgatgaccgcttcgccacggctctgaccgccctcaatgatatgggtaaagtgagaaaggacataccgcagtgggagcctagtaaaggctggaacgattggcagcaagtccccttttgctctcatcacttccaccagcttatcatgaaggacgggcgggagattgtggttccatgtaggaatcaggatgaactggtgggacgagcacgtgtcagccagggcgctggttggtccctaagagagacagcctgcctggggaagtcatacgcacaaatgtggcagctcatgtattttcatcgccgggacttgaggctggccgcgaacgctatctgtagcgccgtgcctgtagattggattcccacttctagaaccacatggtccatccacgcacatcaccagtggatgactaccgaagacatgcttagtgtttggaatcgcgtgtggatagaggaaaacccatggatggaggataaaacgcatatcagctcgtggggagacgtcccctacctgggcaagcgggaggaccaatggtgcggctccctcattgggttaacagccagggctacctgggccactaatatccaggtggcaattaaccaggttcgaagactgatcggaaatgaaaactacttggattatatgacatctatgaaacggttcaagaatgagtcagaccctgaaggtgctctgtggtga

SEQ ID NO: 14043 - RNA, 9879 nt, synthetic construct
  misc_feature 1..9879: note = derived and/or modified CDS sequence (opt3) from DENV-1__EU482505__SS-prME
  source 1..9879: mol_type = other RNA
agcgtgacaatgctgctaatgcttatgcccacagcactggctttccacttgactacgcgaggcggggaacctcatatgatcgtctccaagcaggaaaggggaaaatctttactgtttaagacctcagccggtgttaacatgtgcacactgattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaagcatggctagtgcataagcagtggttcctggatctcccgctgccctggacctccggcgcttcaactagccaagagacatggaatcggaaagaccttctggtaacctttaagacagcccacgctaagaaacaggaagttgtggtcttgggtagtcaggagggggccatgcacactgcactcaccggcgccacggaaatccaaacctctggaacaactaccatcttcgctggccatctgaagtgccgtttaaaaatggataagctgacactaaaagggatgtcctatgtgatgtgtactgggagcttcaagctcgagaaggaagtcgcggagacccagcacggtacggtgctggttcagattaaatacgagggcacagacgcaccttgcaagataccattttcgacccaggatgaaaaaggggtgactcaaaacggacgccttatcacagccaatcccattgtaaccgacaaggagaaacctgtcaacatcgaagctgagccacccttcggcgagtcttatatagtgattggtgccggggaaaaggcattgaagctgtcctggtttaaaaagggctcaagtatcggaaaaatgttcgaggccactgctagaggcgccaggcggatggcaatcctcggggataccgcgtgggactttggaagcattggtggcgttttcacatccgtggggaagctggtccatcagatctttggaacggcttacggcgtgcttttctctggtgtaagctggaccatgaaaattgggataggcgtgctgttgacttggctcggactaaattcacgaagtacatccttaagcatgacctgtatcgccgttggcctggtcacactatacctcggggtgatggtgcaggcagattctggatgcgtcattaactggaagggccgcgaactgaagtgtggttcagggatctttgttactaatgaggtgcacacctggacggaacagtataaattccaagccgacagtccgaagagacttagcgctgccatcggaaaagcatgggaggagggcgtgtgcggtattaggtccgctacacggttggaaaacataatgtggaagcagatctctaacgagctgaatcatattctcctggaaaacgacatgaaatttaccgtagtcgtgggcgatgttgccgggatcttagcgcagggaaagaaaatgattcgccctcagcccatggagcacaagtactcgtggaaaagctggggcaaagccaagatcataggggctgacgtgcaaaatgcaactttcatcattgatggaccaaacacccctgaatgtcccgacgatcagagagcctggaatatctgggaggtcgaggactatggctttggtattttcacaactaacatctggctgaaacttagggattcctacacccaggtgtgcgaccaccgtttgatgtcagctgccataaaggatagtaaagcagttcatgcggacatggggtattggattgaatctgagaagaatgaaacatggaagctcgcccgggctagcttcatcgaggtgaaaacgtgtatttggccaaagtcccacaccctgtggtcaaacggagtactagaaagcgagatgatcatacccaaaatctacggcggtcctatttctcagcataattatcgaccaggctactttactcaaacagccgggccgtggcacctgggaaagctcgagctggatttcgacctttgcgaaggcaccactgtcgtggtggatgagcactgcgggaacagaggaccctccttgaggacaaccacggtcactggcaaaatcattcatgaatggtgttgccgcagttgtaccctgcctccattacggtttaagggtgaggacgggtgctggtacggaatggagatcagacccgttaaggaaaaagaggaaaatctcgtgaagtccatggtatctgcaggctccggtgaggtggactcattcagtctgggccttctgtgtataagcattatgatcgaagaggtcatgaggtcgcgctggtcccgaaaaatgttgatgacagggaccctcgctgtgtttttcctgctaatcatgggacagctgacttggaacgatctcattcggctgtgcatcatggttggcgccaatgcatctgaccgtatggggatgggaacaacctatcttgccttgatggctacatttaagatgagacctatgttcgcggtgggcctgttatttaggcgcctcactagccgggaggtcctgcttctgaccattggtctatcactcgtggccagtgttgaactgccaaactccttggaggaactgggggatggattagcaatgggcataatgatcctcaaactgcttacggacttccagtctcaccaactgtgggctacattgctcagcctgacctttattaagactaccttctccctacattacgcctggaagacaatggccatggtgctgtcaatcgtcagcctttttcccctctgtctgagtactacctctcagaaaacgacatggttgccggtactgttaggctccctcgggtgcaagcctctgaccatgttccttattgctgagaataaaatctggggaagaaagagctggccactgaacgaaggtataatggcagtgggcatcgtttcgattttgctctcatctctgctcaagaacgatgtgcccctggccgggcctcttatcgcgggaggcatgctcattgcttgttatgtcatcagtggttccagcgccgacctgtctttggagaaggcagccgaggtgagctgggaagaggaagctgagcactccggggcatcacataatatattagtagaagtgcaggatgacggaactatgaaaattaaggatgaggagagggacgatacactgaccatcctcctgaaggccactcttctggcggtcagtggcgtttaccccttgagcatcccagctacactattcgtgtggtatttttggcagaaaaagaaacaacgatctggcgtgctgtgggacaccccttcacccccagaagtcgagcgcgccgtgctcgatgacgggatttaccggataatgcagagaggactgcttggtaggagccaggttggcgtaggggtgttccaggaaaacgtctttcacacgatgtggcacgtgactcgtggagcagttttaatgtatcaaggcaagcgcctggagccgagttgggccagcgtgaaaaaggacctcatctcctacggtgggggatggcggttgcagggctcttggaataccggcgaggaagtccaggtgattgctgtagagcctgggaagaaccccaaaaatgtccagacagccccaggaaccttcaagacatcggaaggtgaggtgggcgcaatcgctctggattttaaacccgggactagcggatcacctattgttaacagagaaggcaagatcgtgggtctctacgggaatggagtcgtgaccacgtccggcacatatgttagtgccatagcgcaagccaaagcatctcaggagggcccactgcccgagatcgaagacgaggtgttcaggaagcgaaaccttactattatggatctgcatcctgggagcggaaagacccggcgctacttgccggctatcgtcagagaagccattaaaaggaagctacggacactgatcctcgctccaacccgagtggtagcatccgagatggccgaagccttaaaaggtatgcccataagatatcagactaccgctgtgaagtcagagcacacaggcaaagagattgttgacctgatgtgccatgcgacgtttactatgcgccttctgtctcctgtcagggtgccaaattacaacatgatcatcatggatgaagcacacttcaccgaccccagcagtattgccgctcgtgggtatatctccacacgggtgggaatgggcgaggccgcagccatatttatgaccgctactcctccgggtagcgtcgaagcgttcccccaatctaatgccgtaattcaggatgaggaaagagacatcccagagaggtcatggaactccgggtacgagtggattacagattttcctggaaagaccgtgtggttcgttcccagtatcaagagcggcaatgacatagcaaactgtctccgcaaaaatggcaagcgagtgattcagttgtcgagaaaaacgttcgatactgaatatcagaagaccaaaaacaacgactgggactacgtcgtgaccaccgatatctctgagatgggggctaattttcgggccgacagggttatcgatccacgccgttgcctgaagcctgtgattctcaaggacggacccgaaagagtcatcctggcaggtccaatgccggtgactgtagcctccgctgcccaacggaggggccgcattgggcgaaaccataataaagagggagatcagtacatatatatgggccagcctcttaacaatgacgaggatcacgcgcactggacagaagcaaagatgctactggacaacatcaatacccccgagggtattatcccagccttgttcgaacccgagagagagaaaagcgctgccatcgatggggagtaccggttaaggggcgaggctcgcaagacatttgtggaactgatgagaaggggagacctccctgtttggctgtcatataaagtcgcaagtgagggcttccagtactctgatcggcgttggtgctttgacggggaacgcaacaatcaagtgcttgaggaaaacatggatgtggagatttggactaaggagggagaaagaaagaagctgagaccaaggtggctcgacgcccggacgtattccgaccccttggctctgcgcgagttcaaggaatttgccgcaggtagaaggagcgtctcaggcgatctaatactggagatcgggaaactccctcagcatcttacccagcgggcgcagaatgccctggacaacttagttatgttgcacaatagtgaacaaggaggccgagcttacagacatgccatggaggagctgccggatacaattgaaactctcatgctgcttgcactgatcgctgtgctcaccggtggggtaacattgttctttctgagcggccgcggattaggcaagacctccattgggctactgtgtgtgatggcctctagcgtcctcctttggatggcatccgtggagccacactggatcgccgcttcaataatcctggagttctttttgatggttctgctcattcccgagcctgacaggcagcggactccccaggataaccagctggcgtatgtggtcatcggacttctcttcatgattctgacggtagccgcaaatgagatgggtttgctggaaaccaccaaaaaggacttaggcatcgggcacgtggctgttgagaaccatcaccatgccgccatgctagatgtggacctgcacccagcatctgcttggactctctacgccgtcgcgaccacaataattacccctatgatgcgtcatactatcgaaaacacaacggctaatattagtcttaccgccatcgcaaaccaagccgctatactgatgggattggataaaggctggcccatctcgaagatggacattggtgtgccactgctcgcactggggtgctacagccaggtcaatcctcttactttaacagccgcggtgctgatgctcgttgctcactatgccatcattggcccgggattgcaggcaaaggccaccagagaggctcagaaaaggaccgccgcaggcatcatgaagaaccccacagtggatgggatagtagctattgacctggatccagtggtctacgacactaaatttgaaaagcagctaggacagatcatgctgctcatcctttgtacgtcccagattctgttgatgcgcaccacatgggccctgtgcgagtctatcactctcgcgaccggccctctgacaaccttatgggagggttcacccgggaaattctggaatactacgatagccgttagcatggcaaacattttccggggatcctatcttgctggcgccggtctggcatttagtctcatgaagtctctaggcgggggacgaagaggcacaggggctcaaggagaaaccctgggcgagaagtggaaaaggcagttgaatcagctgagcaagtcagagttcaacacttacaaacgctccggtatcatggaggtggaccggagtgaagccaaggaggggctcaaaagaggagagaccacaaagcacgccgtcagccgtggcactgcgaaacttaggtggtttgtggaacggaatctggtaaaaccagagggtaaggtgattgatttgggctgtgggcgcggaggctggtcttattactgcgctgggctgaaaaaggttaccgaagtgaaaggatatacaaagggcggtcctgggcatgaggaacccatcccgatggcaacgtacggatggaacctcgtcaaattacactccggcaaggacgtgttctttataccacctgagaagtgtgataccctgctttgcgacatcggcgagtcaagccccaatccaactattgaagaggggcgaacactgagagtcctaaaaatggtggaaccctggctcaggggaaaccagttctgtatcaagattctgaatccttacatgccgtcggttgtagagaccttggagcaaatgcagcggaaacatggtggcatgctggtgcgcaaccccctctctagaaatagtactcacgaaatgtattgggtctcctgcgggacaggaaacatcgtgagcgccgttaatatgacctcaaggatgcttctgaaccgatttacgatggctcaccggaagccaacctacgagcgtgatgtggacttaggcgccggtacaagacatgtcgcagtggaacctgaggtagccaacctggatattatcgggcagcgcatagaaaatattaaacacgagcataagtccacttggcactatgacgaggataacccctacaagacctgggcttatcatggatcttacgaagtgaaacctagcggcagtgcgtccagcatggttaatggcgtcgtgaagttgctcacaaaaccatgggacgtgatccccatggtcactcagatcgccatgaccgatacaacccctttcgggcaacagagggtttttaaggagaaagtggacactcggacgccaaaggcaaagagaggaacagctcagattatggaagtaaccgccaaatggctgtggggtttcctatctcgcaacaagaaacccaggatatgtactcgagaggaatttacccggaaggtgagatcaaatgcagccatcggcgctgtcttcgtggacgagaaccaatggaatagtgccaaagaggcggttgaagatgagaggttttgggaccttgtgcaccgcgaacgtgagctgcacaagcaggggaagtgcgcaacatgcgtctataacatgatgggaaaacgggaaaagaaactcggcgagttcggtaaggccaaagggtccagagctatttggtacatgtggctgggagccaggttcttggagtttgaagcactgggcttcatgaatgaggatcattggtttaaccgcgaaaatagcctctctggcgtggagggggagggacttcacaagctgggttacatcttacgagacatttcgaaaatcccgggcgggaacatgtatgctgatgacacggccggatgggatacccggataactgaagacgatctgcagaatgaggctaagatcacagacattatggaacctgagcatgccttgctcgcaaagtcaatcttcaaactgacctaccagaacaaggtagttagagtgcaaaggccagcgaaaaatggcactgtcatggatgtgattagccgcagagaccagcggggttccggacaggtgggaacatatggcctaaacacctttacaaacatggaagcccagcttatcaggcaaatggagagtgagggcatattctctcccagcgaactggagactcctaatctcgctgggcgtgtcctggattggttggaaaagcacggagttgagcgattaaaacgcatggccatttccggtgacgactgtgtggtaaagccaatcgatgacagatttgcaaccgctctgacggccctcaacgatatgggcaaggtgcggaaagacatcccccagtgggaaccgtcaaaggggtggaatgattggcagcaggtccctttctgcagtcaccattttcaccaacttattatgaaagacggaagggagatagtggttccctgtcgcaaccaggatgagctggtgggcagagcacgggtctctcagggtgccgggtggagcctaagggaaaccgcgtgcctgggaaagtcctacgctcagatgtggcaactcatgtatttccatcgacgtgacttgagactggccgcaaatgccatctgttcagctgtgccagtagattgggttcctacaagccgcactacctggtctattcacgcccatcaccagtggatgacaactgaggacatgctttccgtgtggaaccgggtctggatcgaagagaatccctggatggaagataaaacccacattagtagctggggcgacgtgccatacctgggcaagagggaggaccagtggtgcgggtcgctcatcggattaacggcaagagctacatgggccaccaacatacaagttgcgatcaatcaggtgcgccggctgattggtaacgagaattatttggattacatgacttccatgaagaggtttaaaaacgaaatcgaccccgagggcgctctgtggtga

SEQ ID NO: 14044 - RNA, 9879 nt, synthetic construct
  misc_feature 1..9879: note = derived and/or modified CDS sequence (opt3) from DENV-1__EU482506__SS-prME
  source 1..9879: mol_type = other RNA
agcgtgaccatgctgctcatgcttatgcccacggccctggctttccacttgactacgagaggaggggaacctcatatgatcgtctccaagcaggaaagagggaaatctttactgtttaagacctcagccggtgttaatatgtgcacgctaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcatcctcctgacatggttaggactgaatagccgatcaaccagtctatccatgacatgtatcgcggtaggcctcgtgactctgtaccttggggttatggtccaggctgatagcggatgcgtgattaactggaaaggccgcgaattgaagtgtggttctgggatattcgtgaccaatgaggtccacacgtggacagaacaatataagtttcaggccgactcaccgaaaagactgagtgcagccatcggaaaggcttgggaggagggcgtttgcggtattaggagcgccacccggctcgaaaacatcatgtggaaacagatttccaacgagctgaatcatatcttactggaaaacgacatgaagttcactgtggtggtaggcgatgtcgcagggatacttgctcagggcaagaagatgatccgccctcaacccatggagtacaaatattcttggaagtcgtggggcaaggccaaaattatcggggcggacgtgcagaataccacatttattatcgatggaccaaacactcctgaatgtcccgacgatcagagagcctggaatatatgggaggttgaggactacggcttcggtatttttaccacaaacatctggttgaagctcagggatagctatacacaggtgtgcgaccaccgtctgatgtccgctgcaattaaagattcaaaggccgtccacgctgacatggggtactggatcgaaagtgagaaaaatgaaacctggaagctagcccgggcatctttcatagaggtgaagacttgtatctggccaaaaagccatacactgtggtccaacggagttctcgaatcagagatgattatccccaagatttatggcggtcctatcagccaacacaattaccgaccaggctacttcacccagactgcggggccgtggcatctgggaaaacttgagttggattttgacctgtgcgaaggcacaaccgtggtagtcgatgagcactgcgggaacagaggaccctctttaaggacgactaccgtgacaggcaagataattcacgaatggtgttgccgctcctgtaccctccctccactgcggttcagaggtgaggacgggtgctggtatggaatggagatcaggcccgtgaaagaaaaggaggaaaatcttgtcaagagtatggttagcgccggctctggtgaggtggactccttttcactgggcttgctctgtatcagtattatcattgaagaggtaatgcgcagccgatggtcgcggaaaatgctgatgactgggacactagctgtgttctttctgctcataatgggacagctgacctggaacgatcttatccgtttgtgcattatggtcggcgccaatgcatccgacagaatggggatgggaacaacttacctggctttaatggccaccttcaagatgaggcctatgtttgcagtgggcctcctgttccgccggcttacgtctagagaggttctgctactcacaatcggtctgagcttggtggcctcagtcgaactgccaaacagtttagaggaactcggggatggactggctatgggcattatgatccttaaactgttgaccgactttcaatcccatcagctctgggcgactctgctatctctgaccttcataaagacaacttttagccttcactatgcctggaaaaccatggcaatggtgctctccatcgtttcactgttccccttgtgtctgagcacgacaagtcagaagaccacttggttaccggtgctcctgggctctcttgggtgcaagcctctgacaatgtttttgattgctgagaataaaatctggggaaggcgatcctggccactcaacgaaggtattatggccgtcggcatcgtaagcatactgctatcgtcactgcttaagaacgatgtgcccctcgccgggcctctgattgctggaggcatgttgatcgcatgttacgttatctctggtagttccgccgacttaagcctggagaaagcggctgaggtgtcttgggaagaggaagccgagcatagcggggcatcccacaatattctcgtcgaagtgcaggatgacggaaccatgaagataaaagatgaggagcgcgacgatactctgacaatccttctgaaggccaccttgctagctgtatcaggcgtgtatcccctgagtattccagcaacactcttcgtctggtacttctggcagaagaagaagcagcggagcggcgttctgtgggacactccttctcccccagaagtggagagagccgtgcttgatgacgggatctataggattatgcagcgtggattactgggtcgctcccaggtcggcgtgggggtttttcaagaaaacgtattccataccatgtggcacgtgacacggggagcggtcctcatgtaccagggcaaaagattggagccgtcatgggctagtgtgaagaaagacctgatcagctacggtgggggatggaggctccagggctcctggaataccggcgaggaagttcaggtgatagccgtcgagcctgggaagaaccccaaaaatgtgcaaacagcaccaggaacttttaagacccccgaaggtgaggtaggcgccatcgctctggatttcaagcctgggacgtctggatcgccaattgtcaaccgagaaggcaaaatcgtgggtctttatgggaatggagttgtgacaactagcggcacctacgtctcagccattgcacaggctaaggcctcccaggagggccccctgcctgagatcgaagacgaggtgtttcggaaacgcaacttgacaataatggatctacacccggggagtggaaagaccagaaggtatctgccagcgattgttcgggaagccatcaaacgaaagctcagaactttaatcctggcacccacccgcgtggtcgcttctgagatggccgaagctcttaagggtatgcctattaggtaccaaacaacggcagtgaaaagcgagcatactggcaaggagatcgtagacctgatgtgccacgccaccttcacaatgcgtctcttgtccccagtgcgggttcccaattataacatgataattatggatgaagcccattttaccgacccttcatctatcgctgcgagagggtacattagcactagggtcggaatgggcgaggcagccgctatcttcatgacagccaccccgcccggtagtgtggaagcatttccacagtccaatgccgtgatacaggatgaggaacgcgacattcctgagcgaagctggaactctgggtatgagtggatcacggatttccccggaaaaactgtctggtttgtaccatcaatcaagtccggcaatgacattgctaactgtctgaggaaaaatggcaagcgggtgatccagctcagtaggaagacattcgataccgaataccagaaaaccaagaacaacgactgggactacgttgtgactacagatattagcgagatgggggcgaatttccgcgccgaccgtgtcatagatcctagacggtgcctgaaacccgtgatccttaaggacggaccagaaagggttattctagcaggtccgatgcctgtgaccgtcgcttcggccgcacagcgccgaggcagaatcgggcggaaccacaataaagagggagatcagtatatctacatgggccagcccctgaacaatgacgaggatcatgcccactggacagaagctaagatgttgttagacaacattaatactccagagggtataatccccgccctgtttgaacctgagagggaaaagtctgcggcaattgatggggagtatcgcctcagaggcgaggccaggaaaacgttcgtggaactgatgcggcgtggagaccttccagtatggctgtcctacaaggtggctagcgagggctttcaatattcagatcgccgatggtgcttcgacggggaaagaaacaatcaggttctcgaggaaaacatggatgtcgagatctggaccaaagagggagaaaggaagaaattgcggccccgctggctggacgccagaacatacagtgaccctctagctctgagggagtttaaggagttcgcagccggtcggcgatctgtgtccggcgatctcattcttgagatcgggaaactgccgcagcacttaactcagagagctcaaaatgccttggacaacctggtgatgctccataatagcgaacagggaggccgcgcatataggcacgcgatggaggagctgccagataccatagaaacacttatgctgctcgccttgatcgctgtcctgaccggtggggttactttatttttcctatcaggccggggactgggcaagacgagtattgggctcctttgtgtgatggccagctccgtactgttgtggatggcatctgtggagccccattggatcgctgccagcattatcctggaatttttcctcatggtcctgcttatacctgagcccgaccgtcagagaaccccacaggataaccaactcgcatacgtggttattggactgttgtttatgatcctgacagtggccgctaatgagatgggtttactagaaactaccaagaaagacctgggcattgggcacgtcgcggtagagaaccaccatcacgccgcaatgctcgatgtggaccttcatcctgcttccgcctggacactgtacgccgttgcaaccactatcataacacccatgatgaggcacacgatcgaaaacaccactgctaatatttcattgacagccatcgcgaaccaggctgccattctgatgggactcgataagggctggccaatctctaaaatggacataggtgtgcctctgcttgcattagggtgctatagtcaggtcaatccgctgaccctcaccgccgctgtgttgatgctggtcgcacattacgccattatcggccccggactacaagcgaaggctacacgcgaggcccagaaacggactgcagccggcatcatgaagaacccaacggtggatgggattgttgctatcgacctggatcctgtggtatatgacgccaagttcgaaaaacagctcggacagataatgcttctgattttgtgtacctcgcaaatcctgctcatgcgaacaacttgggcactgtgcgagagcattaccttagctacaggcccccttaccactctgtgggagggttccccagggaagttttggaatacgacaatcgccgtgtctatggcgaacatattcagaggatcatacctcgccggcgcaggtctagctttcagcctgatgaaatccttgggcgggggaaggcgcggcaccggggcccagggagaaactctgggcgagaagtggaaacggcagctcaatcagcttagtaagtctgaatttaacacctataagagaagcggtatcatggaggtcgaccgttcagaagcaaaagaggggctgaagaggggagagacaactaaacacgctgtttcccggggcaccgccaagttgcgctggttcgtggaacgaaatctggtcaaacctgagggtaaggtgattgatctcggctgtgggagaggaggctggagttactattgcgccgggttaaagaaagtaacagaagtgaagggatacacgaaaggcggtcccgggcacgaggaaccgatcccaatggcgacctacggatggaacctggttaaacttcatagcggcaaagacgtgtttttcattcctcccgagaagtgtgatactctgctatgcgacatcggcgagtcttccccaaatcccacaattgaagaggggaggaccctccgggtcctgaaaatggtggaaccttggttgcgcggaaaccaattttgtatcaagatactgaatccgtatatgccctcagtcgtggagactctcgagcagatgcagagaaagcacggtggcatgcttgttaggaacccactgagccgaaattcgacacatgaaatgtactgggtatcttgcgggaccggaaacattgtgagtgctgtcaatatgacgtcccggatgttactgaaccgtttcaccatggcacacagaaaacctacatatgagcgcgatgtggacttgggcgccggtactaggcacgttgctgtggaacccgaggtcgccaacctcgatatcatcgggcagcggattgaaaatataaagcatgagcacaaaagcacctggcattacgacgaggataacccttataagacatgggcataccacggatcatatgaagtgaaaccatccggctctgccagcagtatggtaaatggcgtggttaagctgctaactaagccctgggacgtcatccctatggtgacccaaattgctatgacagataccactccatttgggcagcagagagtgttcaaagagaaggtcgacacgcgcacacccaaagcgaagaggggaaccgcccaaatcatggaagttactgcaaaatggctttggggttttctgtcccgaaacaagaagccgcggatttgtaccagagaggagttcacaaggaaagtgcgcagcaatgctgccatcggcgcagtatttgtggacgagaaccagtggaactctgccaaggaggctgtcgaagatgagcgtttctgggacctcgtgcatcgggaaagagagctgcacaaacaggggaagtgcgccacgtgcgtttacaacatgatgggaaaaagggaaaagaagttgggcgagtttggtaaagcgaaggggtcacgcgcaatatggtacatgtggctgggagcccgattcctcgagttcgaagctcttggctttatgaatgaggatcactggttcagtcgggaaaactccctgagcggcgtggagggggagggattacataaactgggttatatcttgagagacatttctaagatccctggcgggaatatgtacgccgatgacaccgcaggatgggatactaggattacagaagacgatctccagaacgaggctcgcatcaccgacataatggaaccagagcacgccctgctagctaaatcgatttttaaacttacttatcaaaataaagtcgtgagagtacagcggcccgccaagaacggcacagttatggatgtgatctcaaggcgtgaccagcgaggtagcgggcaggtcggaacctacggcctgaatacattcactaacatggaagcacaactcatccgccagatggagtccgagggcatttttagtccttctgaactggagaccccaaacttggcggaaagagtgttagattggctggagaagtatggggtggaacggctcaaaaggatggccataagcggagacgactgtgtcgttaagcccatcgatgaccgcttcgctacggcccttaccgcactgaatgatatgggtaaagtgagaaaggacattccgcagtgggagccttccaaaggctggaacgattggcagcaagtacccttttgctcacatcacttccaccagctaatcatgaaggacgggcgggagattgtggtcccatgtaggaatcaggatgaactggtgggacgagctcgtgttagtcagggcgccggttggtctctcagagagacagcatgcttgggaaagagctacgcccaaatgtggcagctgatgtattttcatcgccgggaccttaggctggcggctaacgccatctgttccgcagtgcctgtcgattggatacccacttcaagaaccacatggagcatccacgcccatcaccagtggatgactaccgaagacatgctctctgtgtggaatcgcgtatggattgaggaaaacccatggatggaggataaaacgcatatctccagttggggagacgttccctacttaggcaagcgggaggaccaatggtgcggcagcctgattgggttgacagctagggccacctgggcaactaatatccaggtggctattaaccaggtccgaagactgataggaaatgaaaactacctcgattatatgacatcgatgaaacggttcaagaatgagggtgaccctgaaggcgccctttggtga

SEQ ID NO: 14045 - RNA, 9879 nt, synthetic construct
  misc_feature 1..9879: note = derived and/or modified CDS sequence (opt3) from DENV-1__EU482509__SS-prME
  source 1..9879: mol_type = other RNA
agcgtgaccatgctgctcatgcttatgcccacggccctggctttccacttgactacgagaggaggggaacctcatatgatcgtctccaagcaggaaagagggaaatctttactgtttaagacctcagccggtgttaatatgtgcacgctaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgcagggaaactggttcatcagatattcggaaccgcgtacggcgtgttgttttccggtgtctcttggactatgaagatcgggattggcgtgctcctgacatggttaggactgaatagccgatcaaccagtctatccatgacatgtatcgctgtaggcctcgtgactctgtaccttggggttatggtccaggccgatagcggatgcgtgatcaactggaaaggccgcgaattgaagtgtggttctgggattttcgtgaccaatgaggtccacacgtggacagaacaatataagtttcaggcagactcaccgaaaagactgagtgccgctataggaaaggcctgggaggagggcgtttgcggtatcaggagcgcaacccggctcgaaaacattatgtggaaacagatctccaacgagctgaatcatattttactggaaaacgacatgaagttcactgtggtggtaggcgatgtcgctgggatccttgcccagggcaagaagatgatacgccctcaacccatggagtacaaatattcttggaagtcgtggggcaaggcgaaaatcattggggccgacgtgcagaataccacatttatcattgatggaccaaacactcctgaatgtcccgacgatcagagagcttggaatatctgggaggttgaggactacggcttcggtatatttaccacaaacatttggttgaagctcagggatagctatacacaggtgtgcgaccaccgtctgatgtccgcagccatcaaagattcaaaggctgtccacgccgacatggggtactggattgaaagtgagaaaaatgaaacctggaagctagcacgggcgtctttcatcgaggtgaagacttgtatatggccaaaaagccatacactgtggtccaacggagttctcgaatcagagatgatcgtgcccaagatttatggcggtcctatcagccaacacaattaccgaccaggctacttcacccagactgccgggccgtggcatctgggaaaacttgagttggattttgacctgtgcgaaggcacaaccgtagtcgtggatgagcactgcgggaacagaggaccctctttaaggacgactaccgtgacaggcaagattatccacgaatggtgttgccgctcctgtaccctccctccactgcggttcagaggtgaggacgggtgctggtatggaatggagataaggcccgtcaaagaaaaggaggaaaatcttgttaagagtatggtgagcgctggctctggtgaggtagactccttttcactgggcttgctctgtattagtatcatcattgaagaggtgatgcgcagccgatggtcgcggaaaatgctgatgactgggacactagccgtcttctttctgctcatcatgggacagctgacctggaacgatcttattcgtttgtgcataatggtgggcgcaaatgcttccgacagaatggggatgggaacaacttacctggccttaatggcaaccttcaagatgaggcctatgtttgccgttggcctcctgttccgccggcttacgtctagagaggtgctgctactcacaatcggtctgagcttggtcgcttcagtggaactgccaaacagtttagaggaactcggggatggactggcgatgggcattatgatccttaaactgttgaccgactttcaatcccatcagctctgggccactctgctatctctgaccttcattaagacaacttttagccttcactatgcatggaaaaccatggctatggttctctccatcgtgtcactgttccccttgtgtctgagcacgacaagtcagaagaccacttggttaccggtcctcctgggctctcttgggtgcaagcctctgacaatgtttttgatagccgagaataaaatctggggaaggcgatcctggccactcaacgaaggtattatggccgtaggcatcgtgagcattctgctatcgtcactgcttaagaacgatgttcccctcgctgggcctctgatcgcaggaggcatgttgatagcctgttacgtgatttctggtagttccgcggacttaagcctggagaaagctgccgaggtctcttgggaagaggaagcagagcatagcggggcctcccacaatatcctcgtggaagtacaggatgacggaaccatgaagatcaaagatgaggagcgcgacgatactctgacaattcttctgaaggctaccttgctagcagtgtcaggcgtctatcccctgagtataccagccacactcttcgtttggtacttctggcagaagaagaagcagcggagcggcgtgctgtgggacactccttctcccccagaagtggagagagcggtccttgatgacgggatctataggattatgcagcgtggattactgggtcgctcccaggtgggcgttggggtatttcaagaaaacgtgttccataccatgtggcacgtcacacggggagctgtgctcatgtaccagggcaaaagattggagccgtcatgggccagtgttaagaaagacctgatcagctacggtgggggatggaggctccagggctcctggaataccggcgaggaagtgcaggtcattgcagtggagcctgggaagaaccccaaaaatgtacaaacagccccaggaacttttaagacccccgaaggtgaggtcggcgctatcgccctggatttcaagcctgggacgtctggatcgccaatagtgaaccgagaaggcaaaatcgttggtctttatgggaatggagtggtcacaactagcggcacctacgtgtcagcaattgctcaggccaaggcgtcccaggagggccccctgcctgagatcgaagacgaggtttttcggaaacgcaacttgacaattatggatctacacccggggagtggaaagaccagaaggtatctgccagccatcgtgcgggaagcaataaaacgaaagctcagaactttaattctggctcccacccgcgtcgtggcctctgagatggctgaagcacttaagggtatgcctatcaggtaccaaacaacggccgtaaaaagcgagcatactggcaaggagatcgtggacctgatgtgccacgccaccttcacaatgcgtctcttgtccccagttcgggtccccaattataacatgattatcatggatgaagctcattttaccgacccttcatctatagcggcaagagggtacattagcactagggtgggaatgggcgaggccgctgccatcttcatgacagcaaccccgcccggtagtgtggaagcctttccacagtccaatgctgtcattcaggatgaggaacgcgacatccctgagcgaagctggaactctgggtatgagtggataacggatttccccggaaaaactgtatggtttgtgccatcaattaagtccggcaatgacatcgcgaactgtctgaggaaaaatggcaagcgggttatccagctcagtaggaagacattcgataccgaataccagaaaaccaagaacaacgactgggactacgtggtcactacagatattagcgagatgggggccaatttccgcgcagaccgtgtgatcgatcctagacggtgcctgaaacccgttattcttaaggacggaccagaaagggtgatactagctggtccgatgcctgtcaccgtggcctcggcagcccagcgccgaggcagaatcgggcggaaccacaataaagagggagatcagtatatttacatgggccagcccctgaacaatgacgaggatcatgctcactggacagaagccaagatgttgttagacaacatcaatactccagagggtatcattcccgcgctgtttgaacctgagagggaaaagtctgcagccatagatggggagtatcgcctcagaggcgaggctaggaaaacgttcgtagaactgatgcggcgtggagaccttccagtgtggctgtcctacaaggttgccagcgagggctttcaatattcagatcgccgatggtgcttcgacggggaaagaaacaatcaggtcctcgaggaaaacatggatgtggagatctggaccaaagagggagaaaggaagaaattgcggccccgctggctggacgctagaacatacagtgaccctctagcactgagggagtttaaggagttcgccgctggtcggcgatctgtgtccggcgatctcattcttgagatcgggaaactgccgcagcacttaactcagagagcccaaaatgcattggacaacctggtcatgctccataatagcgaacagggaggccgcgcgtataggcacgccatggaggagctgccagataccattgaaacacttatgctgctcgctttgatcgccgttctgaccggtggggtgactttatttttcctatcaggccggggactgggcaagacgagtatagggctcctttgtgtaatggcaagctccgtgctgttgtggatggcttctgtcgagccccattggatcgccgcaagcattatcctggaatttttcctcatggtgctgcttattcctgagcccgaccgtcagagaaccccacaggataaccaactcgcctacgttgtgatcggactgttgtttatgatactgacagtcgctgcgaatgagatgggtttactagaaactaccaagaaagacctgggcattgggcacgtagccgtggagaaccaccatcacgcagctatgctcgatgttgaccttcatcctgcctccgcctggacactgtacgcagtggctaccactatcattacacccatgatgaggcacacgatcgaaaacaccactgccaatatatcattgacagcgatcgctaaccaggccgcaattctgatgggactcgataagggctggccaatctctaaaatggacattggtgtccctctgcttgccttagggtgctatagtcaggtgaatccgctgaccctcaccgctgcagtcttgatgctggtggcccattacgcgatcataggccccggactacaagctaaggccacacgcgaggcacagaaacggactgccgctggcattatgaagaacccaacggttgatgggatcgtggccatcgacctggatcctgtagtgtatgacgcaaagttcgaaaaacagctcggacagattatgcttctgatcttgtgtacctcgcaaatactgctcatgcgaacaacttgggctctgtgcgagagcattaccttagccacaggcccccttaccactctgtgggagggttccccagggaagttttggaatacgacaatcgcggtctctatggccaacattttcagaggatcatacctcgcaggcgctggtctagccttcagcctgatgaaatccttgggcgggggaaggcgcggcaccggggcacagggagaaactctgggcgagaagtggaaacggcagctcaatcagcttagtaagtctgaatttaacacctataagagaagcggtatcatggaggttgaccgttcagaagctaaagaggggctgaagaggggagagacaactaaacacgccgtgtcccggggcaccgccaagttgcgctggttcgtcgaacgaaatctggtgaaacctgagggtaaggtaatagatctcggctgtgggagaggaggctggagttactattgcgcggggttaaagaaagtgacagaagttaagggatacacgaaaggcggtcccgggcacgaggaaccgatcccaatggctacctacggatggaacctggtgaaacttcatagcggcaaagacgtctttttcattcctcccgagaagtgtgatactctgctatgcgacatcggcgagtcttccccaaatcccacaattgaagaggggaggaccctccgggtgctgaaaatggtcgaaccttggttgcgcggaaaccaattttgtatcaagattctgaatccgtatatgccctcagtggttgagactctcgagcagatgcagagaaagcacggtggcatgcttgtaaggaacccactgagccgaaattcgacacatgaaatgtactgggtgtcttgcgggaccggaaacatcgtcagtgcagtgaatatgacgtcccggatgttactgaaccgtttcaccatggcccacagaaaacctacatatgagcgcgatgttgacttgggcgctggtactaggcacgtggccgtcgaacccgaggtggcaaacctcgatataattgggcagcggatcgaaaatatcaagcatgagcacaaaagcacctggcattacgacgaggataacccttataagacatgggcctaccacggatcatatgaagtaaaaccatccggctctgctagcagtatggtgaatggcgttgtcaagctgctaactaagccctgggacgtgattcctatggtgacccaaatagcgatgacagataccactccatttgggcagcagagagtcttcaaagagaaggttgacacgcgcacacccaaagccaagaggggaaccgcacaaatcatggaagtgactgctaaatggctttggggttttctgtcccgaaacaagaagccgcggatttgtaccagagaggagttcacaaggaaagtacgcagcaatgccgcaatcggcgccgtgtttgtcgacgagaaccagtggaactctgctaaggaggccgtggaagatgagcgtttctgggacctcgttcatcgggaaagagagctgcacaaacaggggaagtgcgcgacgtgcgtgtacaacatgatgggaaaaagggaaaagaagttgggcgagtttggtaaagcaaaggggtcacgcgccatttggtacatgtggctgggagctcgattcctcgagttcgaagcccttggctttatgaatgaggatcactggttcagtcgggaaaactccctgagcggcgtcgagggggagggattacataaactgggttatatcttgagagacatatctaagatccctggcgggaatatgtacgcagatgacaccgctggatgggatactaggattacagaagacgatctccagaacgaggcccgcatcaccgacattatggaaccagagcacgctctgctagccaaatcgatctttaaacttacttatcaaaataaagtggtaagagttcagcggcccgcaaagaacggcacagtgatggatgtcatatcaaggcgtgaccagcgaggtagcggacaggtgggaacctacggcctgaatacattcactaacatggaagcgcaactcattcgccagatggagtccgagggcatctttagtccttctgaactggagaccccaaacttggccgaaagagtgttagattggctggagaagtatggggtcgaacggctcaaaaggatggctatcagcggagacgactgtgttgtgaagcccattgatgaccgcttcgccacggcacttaccgctctgaatgatatgggtaaagtaagaaaggacataccgcagtgggagccttccaaaggctggaacgattggcagcaagtgcccttttgctcacatcacttccaccagctaatcatgaaggacgggcgggagattgtcgtgccatgtaggaatcaggatgaactggttggacgagcccgtgtgagtcagggcgcaggttggtctctcagagagacagcctgcttgggaaagagctacgcgcaaatgtggcagctgatgtattttcatcgccgggaccttaggctggctgccaacgcaatctgttccgccgtccctgtggattggattcccacttcaagaaccacatggagcatccacgctcatcaccagtggatgactaccgaagacatgctctctgtatggaatcgcgtttggatagaggaaaacccatggatggaggataaaacgcatatctccagttggggagacgtgccctacttaggcaagcgggaggaccaatggtgcggcagcctgattgggttgacagccagggcaacctgggctactaatatccaggtcgccattaaccaggtgcgaagactgatcggaaatgaaaactacctcgattatatgacatcgatgaaacggttcaagaatgagggtgaacctgagggcgcgctttggtga

SEQ ID NO: 14046 - RNA, 9879 nt, synthetic construct
  misc_feature 1..9879: note = derived and/or modified CDS sequence (opt3) from DENV-1__EU482510__SS-prME
  source 1..9879: mol_type = other RNA
agcgtgaccatgctgctcatgcttatgcccacagcactggctttccacttgactacgcggggaggggagcctcatatgatcgtctccaagcaggaaagaggaaaatctttactgtttaagacctcagccggtgttaacatgtgcacactgattgccatggacctcggagagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcagaacagaggtgaccaaccctgcagtcctgaggaaactttgcattgaagccaagatctctaatacgaccacagatagccggtgtccaactcaaggagaggctaccctggttgaagaacaggacgccaacttcgtgtgccgccgaacatttgtagatagaggctggggtaatgggtgtggattgttcggcaaaggctccctcataacttgcgcaaagtttaagtgcgtgaccaaactggaggggaagattgtccagtacgaaaacttaaaatattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaaggactggactggacttcaacgaaatggtgttgctaacaatgaaggagaaatcctggctggtacataagcagtggtttctcgatctgccgcttccctggacgtcaggcgccagcaccagtcaagagacttggaatcggcaggacctgttggttacattcaaaaccgcacacgctaagaagcaggaagtggtcgtgctcggttctcaagagggggccatgcacacagctctgactggcgccaccgaaatccagacgtccggaaccacaactatttttgcaggccatttaaaatgccgtctgaagatggataaactaaccctcaaggggatgagctatgtcatgtgtacaggatcgttcaaactggagaaggaagtggccgagactcagcacggtaccgttcttgtgcagataaagtacgagggcacggacgctccttgcaaaatcccattctctacacaagatgggaagggagtaacccagaacggccgcttgattactgcgaatcccatcgtcacagacaaagaaaagcctgtgaacatagaggcagaaccaccctttggtgagtcctatattgttatcggggccggcgagaaagctctgaagctctcatggttcaagaaaggaagtagcatcggcaagatgtttgaagccaccgcaagaggggccaggcggatggctattctgggagatactgcctgggacttcggttccatcggcggggtgtttacctctgtcggaaaacttgtgcatcagattttcggcacagcatacggtgtactgtttagcggggtgtcatggacgatgaagataggcatcggagttttgctcacctggctgggcttaaatagtcgatccactagcctgtctatgacatgtattgcggtcgggctagtgaccctctacctgggagtgatggtccaggctgattcaggctgcgttatcaactggaaaggtcgcgagcttaagtgtgggagtggaatcttcgtgacaaatgaagtgcacacttggaccgagcaatataagtttcaggccgacagcccgaaaagattgtccgcagccattggcaaggcttgggaagagggtgtatgcggcataaggtctgccacgcggctggagaacatcatgtggcgccagatttcgaacgaactcaatcatatcctgttagagaacgacatgaaattcacagtcgtggttggggatgtggtcggcattctggcacagggcaagaaaatgatcagacctcaacccatggaacacaagtacagctggaaatcctgggggaaggctaagataatcggagccgacgtgcagaataccacttttattatcgatggcccaaacacccctgagtgtcccgacgatcagagggcgtggaatatttgggaagttgaggactatggtttcgggatctttacaactaacatatggcttaaattgcgtgattcatacacccaggtgtgcgaccaccggctcatgagtgccgctattaaggattctaaagcagtacatgccgacatgggatattggatcgagagcgaaaagaatgagacatggaaactggctcgagcctccttcattgaagtcaagacgtgtatctggccaaagtcacacaccctatggagcaacggcgtgctggagtctgaaatgataatccccaaaatttacggtggccctatctcccaacataattatagaccagggtacttcactcagacagcaggaccgtggcacctcggcaagctggagcttgattttgacttgtgcgaggggaccactgtggtcgttgatgaacactgcggaaacaggggccccagtctgcgcacaaccacggtgactggtaaaattatccatgagtggtgttgccggagctgtaccttacctccactcagattcaagggggaagacggatgctggtacggcatggagataaggcccgtaaaagagaaggaagagaatctggtgaagtctatggtctccgcgggttcaggcgaagtggacagttttagccttgggctgttgtgtatttcgatcatgatcgaggaagttatgcgctcccgatggtctcggaaaatgctcatgacaggaaccctggccgtgttctttctactgattatgggccagctcacttggaacgatctgatccgtagctgcattatggtcggggctaatgcctcagacagaatgggaatgggcacaacctatcttgcattgatggctacattcaagatgaggcctatgtttgccgtgggtctgttattccgccggctcacaagtagagaggttctgcttctgaccatagggctatccctcgtggcatctgtcgagctgccaaacagcttggaagaactgggagatggcttagccatgggcatcatgattctcaaactgcttacggactttcaatcctaccagctgtgggctacattgctctcactgaccttcatcaagactacctttagcctacactatgcgtggaaaacaatggccatggtactgagtattgtgtctcttctccccctgtgtttgtccactaccagccagaagacgacatggctgccggttttactcgggtcgctgggatgcaagcctcttaccatgttcctgatcgcagaaaataaaatatggggtaggaagtcatggccattgaacgagggcatcatggctgtggggattgtctctatcctcctgagttccctactgaaaaacgatgtgccccttgccggacctctcattgccggcggtatgctgatcgcttgttacgtaataagcgggtctagcgcagacttgtccttagaaaaggccgcggaggtgtcatgggaggaagaggctgaacatagtggagccagccacaatattctggtcgaggttcaggatgacggcactatgaaaatcaaggatgaggaacgagacgatacactcaccatcctgcttaaagcaactctgttggccgtgtctggcgtgtatcccctatccattccagctacactgtttgtctggtacttctggcaaaagaagaaacagcgctcaggggtgctctgggacacccctagtcccccagaggttgaacgggcagtactggatgacggaatatatagaatcatgcagaggggtcttttaggccgtagccaggtgggggtcggagtgttccaagagaacgtttttcatacgatgtggcacgtgactcgcggcgccgtcctgatgtaccagggtaagcggctcgaaccgtcctgggcgtctgtgaaaaaggacttgatttcgtacgggggaggctggagactgcagggcagctggaataccggggaggaggtacaggtcatcgctgtggaacctggcaaaaatcccaagaatgttcaaacagccccaggtaccttcaagacacccgagggcgaagtgggggcaattgccctcgattttaaacctggaacttcaggctccccaatcgtcaacagggagggtaagatagtggggctgtatggaaatggcgttgtgaccacgagtggcacatacgtctctgctatcgcccaggcaaaagctagccaggaagggccccttcctgagattgaggacgaagtgttccgaaagcggaacctgactatcatggatttgcacccgggatccggtaaaacccgcagatatctaccagccattgtaagggaggcgatcaagcggaagctgcgaacactcatattagcccccaccagagtggttgcatcagaaatggctgaggccctgaaaggcatgcctattcgctaccaaactaccgctgtcaagtctgaacatacagggagggagatcgtggaccttatgtgccacgcaacgtttactatgcgtctgctcagcccagtgcgggtccccaattataacatgatcattatggatgaggcccatttcaccgaccctagttccatcgccgctagaggatacataagcacaagggtaggcatgggtgaagcggcagccatttttatgaccgctactccgcccgggtctgtggaggccttcccacagtcaaatgcagttatccaggatgaggaacgcgacattcctgaacgatcctggaacagtggatatgagtggatcacagattttcccggcaaaaccgtgtggttcgtcccaagcataaagtcgggcaatgacattgccaactgtttgaggaaaaatgggaagcgggtgatccagctgtctaggaagacgtttgatactgagtaccagaaaactaagaacaacgactgggactacgttgtgaccaccgatatctccgaaatgggagctaatttccgcgcggaccgtgtcattgatcctagacggtgcctcaaacccgtgatcctgaaggacggtccagagagggtaattcttgccggcccgatgcctgtgactgttgcaagcgctgcccaacgccgagggagaataggacggaaccacaataaagaaggcgatcagtatatctacatgggtcagcccctaaacaatgacgaggatcatgcacactggacagaggccaagatgctgttggacaacattaataccccagaagggatcatccccgctttattcgagcctgaaagggagaagtcagccgcgattgatggcgaatatcgcctgagaggagaggcaaggaaaacatttgtcgagctcatgcggcgtggcgacctgccagtgtggcttagttacaaggtggcctctgaagggttccaatattccgatcgccgatggtgctttgacggagagagaaacaatcaggtcctggaagagaacatggatgttgaaatatggactaaagagggtgagaggaagaaactccggccccgctggttggacgctagaacgtacagcgaccctctggccctaagggagttcaaggagtttgctgcaggccggcgatcagtgagtggggatctgatcctcgaaattggaaaacttccgcagcacctgacccagagagcccaaaatgctttagacaacttggtaatgctgcataatagcgagcagggcggtcgcgcctataggcacgcaatggaggaactcccagatacaatcgagactctgatgcttctggcgctcattgccgtgttgaccgggggcgtcacactgttctttttatccggacggggcctagggaagacctctatcggactgctctgtgtgatggctagctccgcccttctgtggatagcatcagttgaaccccattggatcgctgcctctattatcttggagttctttctgatggtgctcctgattcctgaacccgaccgtcagagaactccacaggataaccaacttgcatacgtcgtaatcggtctcctgttcatgatattgacggtggccgctaatgagatgggcctgttagagaccacaaagaaagacctagggattggacacgttgcggtggaaaaccaccatcacgccactatgctggatgtcgacctccatcctgcaagtgcttggaccctttacgccgtggccacaaccatcattactcccatgatgaggcacacaatcgagaacacgaccgcaaatatatcgctgactgctatcgccaaccaggcggctattttgatgggcctggataagggttggccaatcagcaaaatggacattggggtccctctcctggcccttggctgctattcccaggtgaatccgttaacactgaccgcagccgttctcatgttggtggctcattacgcaatcataggacccggcctgcaagccaaggcgacccgcgaagctcagaaacggacagccgcagggattatgaagaacccaactgtagatggaatcgtggccatcgacctagatcctgtcgtttatgacgctaagtttgagaaacagctgggccagattatgctccttatcctgtgtacgtctcaaatattgctgatgcgaaccacatgggccctctgcgaatcaattactctggcaaccggtcccttaacaaccctttgggaggggagcccaggaaagttctggaatactacgatcgctgtgtccatggccaacatttttagaggcagttacctggcgggtgccggcctcgcattctctctaatgaaaagcctagggggaggcaggcgcgggacaggagctcagggcgagaccttgggtgaaaagtggaaacggcagctgaatcagctctcaaagtccgagttcaacacttataagagaagtgggatcatggaagtcgaccgtagcgaggccaaagaaggacttaggcggggcgagaccacaaagcacgcagtgtctcgcggtactgctaaactgcgatggtttgtagagagaaatttggtgaagcctgaaggcaaagttatagatctggggtgtggaaggggcgggtggtcctactattgcgccggactcaagaaggtgaccgaggtcaaaggctacacaaagggtgggcccggacacgaggaaccgatcccaatggccacgtacggctggaacttagtgaaactgcattcaggcaaggacgtcttctttattcctcccgaaaaatgtgatacccttctgtgcgacatcggggagagctcgccaaatcccactattgaggaaggacggacactacgcgtgctcaagatggttgagccttggctgagaggtaaccaattctgtatcaaaattttgaatccgtatatgccctctgtagtggaaaccctggagcagatgcagaggaagtacggcgggatgctcgtccgaaacccacttagtagaaattccactcacgagatgtattgggtgagctgcggaacaggcaacatcgtttcagcggtgaatatgacctcccgtatgctgttaaacagatttacgatggctcatcgcaagcctacctacgaaagggatgtcgacctgggtgcagggacacggcacgtggccgtagagcccgaagtggctaacttggatataattggacagagaatcgagaatatcaaacacgaacataagtctacttggcactatgacgaggataacccttacaaaacctgggcctatcatggcagctacgaggttaagccaagtggctccgcaagctctatggtcaatggggtggtgaaactcctgacaaagccctgggacgtcattcctatggttactcaaatagccatgaccgatacaaccccattcggacagcagcgcgtgtttaaggaaaaagtagacactaggacgcccaaggctaaacgaggtacagcgcaaatcatggaggtgaccgcccggtggctatggggcttcctttcaagaaacaagaaaccgaggatttgtactcgcgaagagtttacccgtaaggtccggagtaatgcagctatcggggccgtgttcgttgacgaaaaccagtggaactccgcaaaggaggccgtggaggatgaaagattttgggacctggtccacagggagcgcgaactccataaacagggaaagtgcgctacatgcgtgtacaacatgatgggcaaacgagagaagaaactgggtgagttcgggaaggccaagggaagccgggcgatttggtatatgtggttgggcgcaagatttctggagttcgaggccctcggcttcatgaatgaagatcactggttttctagggagaactcgctttcaggggtagaaggagagggtctgcacaaattaggctacatcctgcgcgacataagcaagatccctgggggaaatatgtatgctgatgacacggccggctgggataccagaattactgaggacgatttgcagaacgaagcaaaaatcacagacattatggagccagaacatgctctcctggccacctccatcttcaagctaacttaccaaaataaagttgtgcgggtccagaggcccgctaagaacggtacagtgatggatgtgataagtcgtcgagaccagcgcgggtctggacaggtcggcacctatggccttaatacatttactaacatggaggcccaactgattagacagatggaaagcgaggggatcttctccccttcagagctcgaaaccccaaacctggcagagcgggttttggattggttagaaaaatacggagtggagaggctgaagcgcatggcgatcagtggtgacgactgtgtagtgaagcccattgatgacagatttgccacggctctcaccgcccttaatgatatgggcaaagtccggaaggacataccgcagtgggaaccttctaaagggtggaacgattggcagcaagtgcccttctgcagccaccattttcaccagctgatcatgaaggacggaagggagattgttgtgccatgtcgaaatcaggatgagctagtcggccgtgcaagagtgtcccagggtgctgggtggtcactgcgcgaaacagcctgcctcggaaaaagctatgcacaaatgtggcagttgatgtacttccaccggagggacctgagacttgccgcgaacgctatctgttctgccgtacctgttgattgggtgcccacttcccgcaccacatggagtattcatgcacaccatcagtggatgactaccgaggacatgctgagcgtctggaatcgggtgtggatcgaagagaacccatggatggaagataagacgcacatatcgtcctggggcgacgttccctacctcggcaagagggaggaccaatggtgcgggtctttaatcggactgacagcccgagctacctgggccactaatattcaggtggcaatcaaccaggtcagacggttgattggtaatgagaactatctggattacatgacatcaatgaaaaggtttaagaatgaaagcgaccctgagggcgctctctggtga

SEQ ID NO: 14047 - RNA, 9879 nt, synthetic construct
  misc_feature 1..9879: note = derived and/or modified CDS sequence (opt3) from DENV-1__EU482511__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatgtctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagatcattcacgaatggtgttgccgcagttgtaccctccctccactgcggttcagaggtgaggacgggtgctggtatggaatggagatcaggcccgtcaaagaaaaggaggaaaatcttgttaagagcatggtgtctgccggctccggtgaggtagactcatttagtctgggcttgctctgtataagcattatgatcgaagaggtgatgcgctcgcgatggtcccggaaaatgctgatgactgggacactagctgtcttctttctgctcatcatgggacagctgacctggaacgatcttattcgtttgtgcatcatggtgggcgccaatgcatctgacagaatggggatgggaacaacttacctggctttaatggccaccttcaagatgaggcctatgtttgcagttggcctcctgttccgccggcttacgagcagagaggtgctgctactcacaattggtctgtcattggtcgccagtgtggaactgccaaactccttagaggaactcggggatggactggctatgggcataatgatccttaaactgttgaccgactttcaatctcatcagctctgggcgactctgctaagcctgaccttcattaagacaactttttcccttcactatgcctggaaaaccatggcaatggttctctcaatcgtgagcctgttccccttgtgtctgagtacgacatctcagaagaccacttggttaccggtcctcctgggctcccttgggtgcaagcctctgacaatgtttttgattgctgagaataaaatctggggaaggcgaagctggccactcaacgaaggtataatggccgtaggcatcgtgtcgattctgctatcatctctgcttaagaacgatgttcccctcgccgggcctctgatcgctggaggcatgttgattgcatgttacgtgatcagtggttccagcgccgacttatctctggagaaagcggctgaggtcagctgggaagaggaagccgagcattccggggcatcacacaatatactcgtggaagtacaggatgacggaaccatgaagattaaagatgaggagcgcgacgatactctgacaatccttctgaaggccaccttgctagctgtgagtggcgtctatcccctgagcatcccagcaacactcttcgtttggtacttctggcagaagaagaagcagcggtctggcgtgctgtgggacactccttcacccccagaagtggagagagccgtccttgatgacgggatttataggataatgcagcgtggattactgggtcgcagccaggtgggcgttggggtatttcaagaaaacgtgttccataccatgtggcacgtcacacggggagcggtgctcatgtaccagggcaaaagattggagccgagttgggctagcgttaagaaagacctgatctcctacggtgggggatggaggctccagggctcttggaataccggcgaggaagtgcaggtcattgccgtggagcctgggaagaaccccaaaaatgtacaaacagcaccaggaacttttaagacccccgaaggtgaggtcggcgccatcgctctggatttcaagcctgggacgtcgggaagcccaattgtgaaccgagaaggcaaaatcgttggtctttatgggaatggagtggtcacaacttcaggcacctacgtgtccgccatagcacaggctaaggccagtcaggagggccccctgcctgagatcgaagacgaggtttttcggaaacgcaacttgacaattatggatctacacccggggtctggaaagaccagaaggtatctgccagcgatcgtgcgggaagccattaaacgaaagctcagaactttaatcctggcacccacccgcgtcgtggctagcgagatggccgaagctcttaagggtatgcctataaggtaccaaacaacggcagtaaaatccgagcatactggcaaggagattgtggacctgatgtgccacgccaccttcacaatgcgtctcttgtcaccagttcgggtccccaattataacatgatcatcatggatgaagcccattttaccgacccttctagcattgctgcgagagggtacatcagtactagggtgggaatgggcgaggcagccgctatattcatgacagccaccccgcccggttccgtggaagcatttccacagagcaatgccgtcattcaggatgaggaacgcgacatccctgagcgatcttggaactcagggtatgagtggattacggatttccccggaaaaactgtatggtttgtgccatccatcaagagtggcaatgacatagctaactgtctgaggaaaaatggcaagcgggttattcagctcagcaggaagacattcgataccgaataccagaaaaccaagaacaacgactgggactacgtggtcactacagatatctcggagatgggggcgaatttccgcgccgaccgtgtgatcgatcctagacggtgcctgaaacccgttattcttaaggacggaccagaaagggtgatcctagcaggtccgatgcctgtcaccgtggcttctgccgcacagcgccgaggcagaattgggcggaaccacaataaagagggagatcagtatatatacatgggccagcccctgaacaatgacgaggatcatgcccactggacagaagctaagatgttgttagacaacatcaatactccagagggtattatccccgccctgtttgaacctgagagggaaaagtccgcggcaatcgatggggagtatcgcctcagaggcgaggccaggaaaacgttcgtagaactgatgcggcgtggagaccttccagtgtggctgagctacaaggttgcttcagagggctttcaatatagtgatcgccgatggtgcttcgacggggaaagaaacaatcaggtcctcgaggaaaacatggatgtggagatttggaccaaagagggagaaaggaagaaattgcggccccgctggctggacgccagaacatactctgaccctctagctctgagggagtttaaggagttcgcagccggtcggcgatccgtgagcggcgatctcatacttgagatcgggaaactgccgcagcacttaactcagagagctcaaaatgccttggacaacctggtcatgctccataattcagaacagggaggccgcgcatataggcacgcgatggaggagctgccagataccattgaaacacttatgctgctcgccttgatcgctgttctgaccggtggggtgactttatttttcctaagtggccggggactgggcaagacgagcattgggctcctttgtgtaatggcctcctctgtgctgttgtggatggcaagcgtcgagccccattggatcgctgcctccataatcctggaatttttcctcatggtgctgcttattcctgagcccgaccgtcagagaaccccacaggataaccaactcgcatacgttgtgatcggactgttgtttatgattctgacagtcgccgctaatgagatgggtttactagaaactaccaagaaagacctgggcatcgggcacgtagcggtggagaaccaccatcacgccgcaatgctcgatgttgaccttcatcctgcttcagcctggacactgtacgccgtggcaaccactataattacacccatgatgaggcacacgatcgaaaacaccactgctaatatttctttgacagccatcgcgaaccaggctgccatactgatgggactcgataagggctggccaatcagtaaaatggacattggtgtccctctgcttgcattagggtgctatagccaggtgaatccgctgaccctcaccgccgctgtcttgatgctggtggcacattacgccatcattggccccggactacaagcgaaggctacacgcgaggcccagaaacggactgcagccggcatcatgaagaacccaacggttgatgggatagtggctattgacctggatcctgtagtgtatgacgccaagttcgaaaaacagctcggacagatcatgcttctgatcttgtgtaccagccaaattctgctcatgcgaacaacttgggcactgtgcgagtccatcaccttagctacaggcccccttaccactctgtgggagggttctccagggaagttttggaatacgacaatagccgtctcaatggcgaacattttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtatcatggaggttgaccgttccgaagcaaaagaggggctgaagaggggagagacaactaaacacgctgtgagtcggggcaccgccaagttgcgctggttcgtcgaacgaaatctggtgaaacctgagggtaaggtaattgatctcggctgtgggagaggaggctggagctactattgcgccgggttaaagaaagtgacagaagttaagggatacacgaaaggcggtcccgggcacgaggaaccgatcccaatggcgacctacggatggaacctggtgaaacttcattctggcaaagacgtctttttcatacctcccgagaagtgtgatactctgctatgcgacatcggcgagtcctcaccaaatcccacaattgaagaggggaggaccctccgggtgctgaaaatggtcgaaccttggttgcgcggaaaccaattttgtatcaagattctgaatccgtatatgcccagcgtggttgagactctcgagcagatgcagagaaagcacggtggcatgcttgtaaggaacccactgtcgcgaaattctacacatgaaatgtactgggtgagttgcgggaccggaaacatcgtctccgctgtgaatatgacgagccggatgttactgaaccgtttcaccatggcacacagaaaacctacatatgagcgcgatgttgacttgggcgccggtactaggcacgtggctgtcgaacccgaggtggccaacctcgatattatcgggcagcggatagaaaatattaagcatgagcacaaatcaacctggcattacgacgaggataacccttataagacatgggcataccacggatcctatgaagtaaaaccatctggcagcgccagttccatggtgaatggcgttgtcaagctgctaactaagccctgggacgtgatccctatggtgacccaaatcgctatgacagataccactccatttgggcagcagagagtcttcaaagagaaggttgacacgcgcacacccaaagcgaagaggggaaccgcccaaattatggaagtgactgcaaaatggctttggggttttctgagccgaaacaagaagccgcggatatgtaccagagaggagttcacaaggaaagtacgctctaatgctgccatcggcgcagtgtttgtcgacgagaaccagtggaactcagccaaggaggctgtggaagatgagcgtttctgggacctcgttcatcgggaaagagagctgcacaaacaggggaagtgcgccacgtgcgtgtacaacatgatgggaaaaagggaaaagaagttgggcgagtttggtaaagcgaaggggagtcgcgcaatttggtacatgtggctgggagcccgattcctcgagttcgaagctcttggctttatgaatgaggatcactggttctcccgggaaaacagcctgtctggcgtcgagggggagggattacataaactgggttatatcttgagagacatttcgaagatccctggcgggaatatgtacgccgatgacaccgcaggatgggatactaggataacagaagacgatctccagaacgaggctcgcatcaccgacattatggaaccagagcacgccctgctagctaaatcaatctttaaacttacttatcaaaataaagtggtaagagttcagcggcccgccaagaacggcacagtgatggatgtcattagcaggcgtgaccagcgaggttccggacaggtgggaacctacggcctgaatacattcactaacatggaagcacaactcatccgccagatggagagtgagggcatattttctcctagcgaactggagaccccaaacttggcgaagagagtgttagattggctggaaaaatatggggtcgagcggctcaagaggatggccatttccggagacgactgtgttgtgaaacccatcgatgaccgcttcgctacggcccttaccgcactgaatgatatgggtaaggtaagaaaagacatcccgcagtgggaaccttcaaagggctggaacgattggcagcaagtgcccttttgcagtcatcacttccaccagctaattatgaaggacgggcgggagatagtcgtgccatgtaggaatcaggatgagctggttggacgagctcgtgtgtctcagggcgccggttggagcctcagagaaacagcatgcttggggaaatcctacgcccaaatgtggcagctgatgtattttcatcgccgggaccttaggctggcggctaacgccatctgttcagcagtccctgtggattggattcccactagcagaaccacatggtctatccacgcccatcaccagtggatgactaccgaggacatgctctccgtatggaatcgcgtttggattgaagagaacccatggatggaagataagacgcatatcagtagctggggagacgtgccctacttaggcaaacgggaggaccaatggtgcggctcgctgatagggttgacagctagggccacctgggcaactaatatccaggtcgctattaaccaggtgcgaagactgatcggaaatgagaactacctcgattatatgacatccatgaagcggttcaaaaatgaatctgaccctgagggtgccctttggtga

SEQ ID NO: 14048 - RNA, 9879 nt, synthetic construct
  misc_feature 1..9879: note = derived and/or modified CDS sequence (opt3) from DENV-1__EU482513__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatggttctctcaattgtgagcctgttccccttgtgtctgagtacgacatctcagaagaccacttggttaccggtcctcctgggctcccttgggtgcaagcctctgacaatgtttttgatcgctgagaataaaatatggggaaggcgaagctggccactcaacgaaggtatcatggccgtaggcattgtgtcgatcctgctatcatctctgcttaagaacgatgttcccctcgccgggcctctgattgctggaggcatgttgatcgcatgttacgtgataagtggttccagcgccgacttatctctggagaaagcggctgaggtcagctgggaagaggaagccgagcattccggggcatcacacaatattctcgtggaagtacaggatgacggaaccatgaagatcaaagatgaggagcgcgacgatactctgacaatccttctgaaggccaccttgctagctgtgagtggcgtctatcccctgagcattccagcaacactcttcgtttggtacttctggcagaagaagaagcagcggtctggcgtgctgtgggacactccttcacccccagaagtggagagagccgtccttgatgacgggatatataggatcatgcagcgtggattactgggtcgcagccaggtgggcgttggggtatttcaagaaaacgtgttccataccatgtggcacgtcacacggggagcggtgctcatgtaccagggcaaaagattggagccgagttgggctagcgttaagaaagacctgatttcctacggtgggggatggaggctccagggctcttggaataccggcgaggaagtgcaggtcatcgccgtggagcctgggaagaaccccaaaaatgtacaaacagcaccaggaacttttaagacccccgaaggtgaggtcggcgccattgctctggatttcaagcctgggacgtcgggaagcccaatcgtgaaccgagaaggcaaaatagttggtctttatgggaatggagtggtcacaacttcaggcacctacgtgtccgccatcgcacaggctaaggccagtcaggagggccccctgcctgagattgaagacgaggtttttcggaaacgcaacttgacaatcatggatctacacccggggtctggaaagaccagaaggtatctgccagcgattgtgcgggaagccatcaaacgaaagctcagaactttaatactggcacccacccgcgtcgtggctagcgagatggccgaagctcttaagggtatgcctattaggtaccaaacaacggcagtaaaatccgagcatactggcaaggagatcgtggacctgatgtgccacgccaccttcacaatgcgtctcttgtcaccagttcgggtccccaattataacatgatcattatggatgaagcccattttaccgacccttctagcatcgctgcgagagggtacataagtactagggtgggaatgggcgaggcagccgctattttcatgacagccaccccgcccggttccgtggaagcatttccacagagcaatgccgtcatccaggatgaggaacgcgacattcctgagcgatcttggaactcagggtatgagtggatcacggatttccccggaaaaactgtatggtttgtgccatccataaagagtggcaatgacattgctaactgtctgaggaaaaatggcaagcgggttatccagctcagcaggaagacattcgataccgaataccagaaaaccaagaacaacgactgggactacgtggtcactacagatatctcggagatgggggcgaatttccgcgccgaccgtgtgattgatcctagacggtgcctgaaacccgttatccttaaggacggaccagaaagggtgattctagcaggtccgatgcctgtcaccgtggcttctgccgcacagcgccgaggcagaatagggcggaaccacaataaagagggagatcagtatatctacatgggccagcccctgaacaatgacgaggatcatgcccactggacagaagctaagatgttgttagacaacattaatactccagagggtatcatccccgccctgtttgaacctgagagggaaaagtccgcggcaattgatggggagtatcgcctcagaggcgaggccaggaaaacgttcgtagaactgatgcggcgtggagaccttccagtgtggctgagctacaaggttgcttcagagggctttcaatatagtgatcgccgatggtgcttcgacggggaaagaaacaatcaggtcctcgaggaaaacatggatgtggagatatggaccaaagagggagaaaggaagaaattgcggccccgctggctggacgccagaacatactctgaccctctagctctgagggagtttaaggagttcgcagccggtcggcgatccgtgagcggcgatctcatccttgagattgggaaactgccgcagcacttaactcagagagctcaaaatgccttggacaacctggtcatgctccataattcagaacagggaggccgcgcatataggcacgcgatggaggagctgccagataccatcgaaacacttatgctgctcgccttgattgctgttctgaccggtggggtgactttatttttcctaagtggccggggactgggcaagacgagcatcgggctcctttgtgtaatggcctcctctgtgctgttgtggatggcaagcgtcgagccccattggatagctgcctccatcattctggaatttttcctcatggtgctgcttatccctgagcccgaccgtcagagaaccccacaggataaccaactcgcatacgttgtgattggactgttgtttatgatcctgacagtcgccgctaatgagatgggtttactagaaactaccaagaaagacctgggcatagggcacgtagcggtggagaaccaccatcacgccgcaatgctcgatgttgaccttcatcctgcttcagcctggacactgtacgccgtggcaaccactattatcacacccatgatgaggcacacgattgaaaacaccactgctaatatctctttgacagccatagcgaaccaggctgccatcctgatgggactcgataagggctggccaattagtaaaatggacatcggtgtccctctgcttgcattagggtgctatagccaggtgaatccgctgaccctcaccgccgctgtcttgatgctggtggcacattacgccattatcggccccggactacaagcgaaggctacacgcgaggcccagaaacggactgcagccggcataatgaagaacccaacggttgatgggattgtggctatcgacctggatcctgtagtgtatgacgccaagttcgaaaaacagctcggacagatcatgcttctgattttgtgtaccagccaaatcctgctcatgcgaacaacttgggcactgtgcgagtccataaccttagctacaggcccccttaccactctgtgggagggttctccagggaagttttggaatacgacaattgccgtctcaatggcgaacatcttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtattatggaggttgaccgttccgaagcaaaagaggggctgaagaggggagagacaactaaacacgctgtgagtcggggcaccgccaagttgcgctggttcgtcgaacgaaatctggtgaaacctgagggtaaggtaatcgatctcggctgtgggagaggaggctggagctactattgcgccgggttaaagaaagtgacagaagttaagggatacacgaaaggcggtcccgggcacgaggaaccgataccaatggcgacctacggatggaacctggtgaaacttcattctggcaaagacgtctttttcatccctcccgagaagtgtgatactctgctatgcgacattggcgagtcctcaccaaatcccacaatcgaagaggggaggaccctccgggtgctgaaaatggtcgaaccttggttgcgcggaaaccaattttgtattaagatcctgaatccgtatatgcccagcgtggttgagactctcgagcagatgcagagaaagcacggtggcatgcttgtaaggaacccactgtcgcgaaattctacacatgaaatgtactgggtgagttgcgggaccggaaacattgtctccgctgtgaatatgacgagccggatgttactgaaccgtttcaccatggcacacagaaaacctacatatgagcgcgatgttgacttgggcgccggtactaggcacgtggctgtcgaacccgaggtggccaacctcgatatcatagggcagcggattgaaaatatcaagcatgagcacaaatcaacctggcattacgacgaggataacccttataagacatgggcataccacggatcctatgaagtaaaaccatctggcagcgccagttccatggtgaatggcgttgtcaagctgctaactaagccctgggacgtgatccctatggtgacccaaattgctatgacagataccactccatttgggcagcagagagtcttcaaagagaaggttgacacgcgcacacccaaagcgaagaggggaaccgcccaaataatggaagtgactgcaaaatggctttggggttttctgagccgaaacaagaagccgcggatctgtaccagagaggagttcacaaggaaagtacgctctaatgctgccattggcgcagtgtttgtcgacgagaaccagtggaactcagccaaggaggctgtggaagatgagcgtttctgggacctcgttcatcgggaaagagagctgcacaaacaggggaagtgcgccacgtgcgtgtacaacatgatgggaaaaagggaaaagaagttgggcgagtttggtaaagcgaaggggagtcgcgcaatctggtacatgtggctgggagcccgattcctcgagttcgaagctcttggctttatgaatgaggatcactggttctcccgggaaaacagcctgtctggcgtcgagggggagggattacataaactgggttatattttgagagacatctcgaagatacctggcgggaatatgtacgccgatgacaccgcaggatgggatactaggatcacagaagacgatctccagaacgaggctcgcattaccgacatcatggaaccagagcacgccctgctagctaaatcaatttttaaacttacttatcaaaataaagtggtaagagttcagcggcccgccaagaacggcacagtgatggatgtcatcagcaggcgtgaccagcgaggttccggacaggtgggaacctacggcctgaatacattcactaacatggaagcacaactcatacgccagatggagagtgagggcatattttctcctagcgaactggagaccccaaacttggcggaaagagtgttagattggctggagaagtatggggtcgaacggctcaaaaggatggccatctccggagacgactgtgttgtgaagcccatcgatgaccgcttcgctacggcccttaccgcactgaatgatatgggtaaagtaagaaaggacattccgcagtgggagccttcaaaaggctggaacgattggcagcaagtgcccttttgcagtcatcacttccaccagctaataatgaaggacgggcgggagatcgtcgtgccatgtaggaatcaggatgaactggttggacgagctcgtgtgtctcagggcgccggttggagcctcagagagacagcatgcttggggaagtcctacgcccaaatgtggcagctgatgtattttcatcgccgggaccttaggctggcggctaacgccatttgttcagcagtccctgtggattggatccccactagcagaaccacatggtctattcacgcccatcaccagtggatgactaccgaagacatgctctccgtatggaatcgcgtttggatcgaggaaaacccatggatggaggataaaacgcatataagtagctggggagacgtgccctacttaggcaagcgggaggaccaatggtgcggctcgctgatcgggttgacagctagggccacctgggcaactaatattcaggtcgctatcaaccaggtgcgaagactgattggaaatgaaaactacctcgattatatgacatccatgaaacggttcaagaatgagtctgaccctgaaggtgccctttggtga

SEQ ID NO: 14049 - RNA, 9879 nt, synthetic construct
  misc_feature 1..9879: note = derived and/or modified CDS sequence (opt3) from DENV-1__EU482515__SS-prME
  source 1..9879: mol_type = other RNA
agcgtgaccacactgctcatgcttatgcccactgccctggctttccacttgacgaccagaggaggggaacctcatatgatcgtctccaagcaggaaaggggaaaatctttactgtttaagacatcagccggtgttaatatgtgcactttaattgccatggacctcggcgagctgtgtgaagataccatgacatacaaatgcccacggataaccgagactgaaccggacgatgtggactgttggtgcaatgcgacagatacctgggtaacgtatgggacttgtagtcaaaccggagagcaccgccgagacaagcgtagcgtggctcttgcaccccatgtcggcctgggtttggagacaagaactgaaacctggatgtcctctgagggggcatggaaacagatccagagggtggaaacatgggccctccggcaccctggattcaccgttattgctctgtttctggcacatgccatcggcacgtcgattactcagaagggcatcatattcatcctcttaatgctggtgacaccatcaatggctatgcgctgcgtcgggattggaagcagagattttgtggagggtcttagtggcgccacctgggtagacgttgtgttggagcacgggtcctgtgtcactacaatggcgaaggataaacccaccctggacatcgaactgctcaagacggaggtgaccaaccctgcagtgctgaggaaactttgcattgaagccaagatctctaatacaactaccgatagccggtgtccaacacaaggagaggctactctggtcgaagaacaggacgccaacttcgtttgccgccgaacctttgtggatagaggctggggtaatgggtgtggattgttcggcaaaggctccctcataacatgcgcaaagtttaagtgcgtaaccaaactggaggggaagattgtgcagtacgaaaacttaaaatattcagtcatcgtgactgttcacacgggagaccagcatcaagtgggtaatgagagtacagaacacggcaccactgctaccattacaccccaggcccctaccactgagatccagctgacagactacggggcgctcacgcttgattgtagcccaaggaccggactggacttcaacgaaatggtcttgctaactatgaaggagaaatcttggctggtgcataagcagtggtttctcgatctgccgcttccctggacatccggcgcctcaaccagccaagagacatggaatcggcaggacctgttggtaactttcaaaaccgcacacgctaagaagcaggaagttgtggtcctcggtagtcaagagggggccatgcacacggctctgaccggcgccacagaaatccagacttctggaaccacaactatttttgcaggccatttaaaatgccgtctgaagatggataaactaaccctcaaggggatgtcctatgtgatgtgtacggggtcgttcaaactggagaaggaacttgccgagacacagcacggtaccgtcttggtgcagataaagtacgagggcactgacgctccttgcaaaatcccattctcgacacaagatgaaaagggggttacccagaacggacgcctgattactgcgaatcccatcgtgaccgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccacagcaagaggcgccaggcggatggctattcttggggatacggcctgggacttcggaagcatcggtggcgtgtttacctccgttgggaaactggtgcatcagattttcggaactgcatacggcgtcttgttttctggtgtgagctggacaatgaagatagggatcggcgtactcctgacctggttaggactaaattcacgaagtacatccctaagcatgacttgtattgcggtgggcctcgttaccctgtaccttggggtcatggtgcaggctgattctggatgcgtgatcaactggaaaggccgcgaattgaagtgtggttcagggatcttcgtcacgaatgaggttcacacatggaccgaacaatataagtttcaggccgacagtccgaaaagactgagcgcagccattggaaaggcttgggaggagggcgtgtgcggtataaggtccgccactcggctcgaaaacatcatgtggaaacagatttctaacgagctgaatcatatcttactggaaaacgacatgaagttcaccgtggtagtcggcgatgtggcagggattcttgctcagggcaaaaagatgatccgccctcaacccatggagtacaaatattcgtggaaaagctggggcaaggccaaaataatcggggcggacgttcagaatacaacttttattatcgatggaccaaacacccctgaatgtcccgacgatcagagagcctggaatatttgggaggtggaggactacggcttcggtatctttacaacgaacatatggttgaagctcagggattcctatacccaggtctgcgaccaccgtctgatgtcagctgcaattaaagatagtaaggccgtgcacgctgacatggggtactggatcgaatctgagaaaaatgaaacttggaagctagcccgggcatccttcattgaggttaagacatgtatctggccaaaatcccataccctgtggtcaaacggagtgctcgaaagcgagatgataatccccaagatttatggcggtcctatgtctcaacacaattaccgaccaggctacttcactcagacagcggggccgtggcatctgggaaaacttgagttggattttgacctgtgcgaaggcaccacggtagtcgtggatgagcactgcgggaacagaggaccctccttaaggactaccacagtgaccggcaagatcattcacgaatggtgttgccgcagttgtactctccctccactgcggttcagaggtgaggacgggtgctggtatggaatggagatcaggcccgtcaaagaaaaggaggaaaatcttgttaagagcatggtgtctgccggctccggtgaggtagactcatttagtctgggcttgctctgtataagcattatgatcgaagaggtgatgcgctcgcgatggtccaaaaagatgctgatgacagggaccctagctgtcttctttctgctcatcatgggacagctgacatggaacgatcttattcggttgtgcatcatggtgggcgccaatgcatctgaccgtatggggatgggaactacctacctggctttaatggccacgttcaaaatgagacctatgtttgcagttggcctcctgttcaggcgccttacaagccgggaggtgctgctactcaccattggtctgtcattggtcgccagtgtggaactgccaaactccttagaggaactcggggatggactggctatgggcataatgatccttaagctgttgactgactttcaatctcatcagctctgggcgaccctgctaagcctgacattcattaaaactaccttttcccttcactatgcctggaagacgatggcaatggttctctcaatcgtgagcctgttccccttgtgtctgagtacaacctctcagaagactacatggttaccggtcctcctgggctcccttgggtgcaaacctctgaccatgtttttgattgctgagaataagatctggggaagaaggagctggccactcaacgaaggtataatggccgtaggcatcgtgtcgattctgctatcatctctgcttaaaaacgatgttcccctcgccgggcctctgatcgctggaggcatgttgattgcatgttacgtgatcagtggttccagcgccgacttatctctggagaaggcggctgaggtcagctgggaagaggaagccgagcattccggggcatcacacaatatactcgtggaagtacaggatgacggaactatgaaaattaaggatgaggagcgagacgatacactgaccatccttctgaaagccacgttgctagctgtgagtggcgtctatcccctgagcatcccagcaactctcttcgtttggtacttctggcaaaagaagaaacagcgctctggcgtgctgtgggacaccccttcacccccagaagtggagcgggccgtccttgatgacgggatttatagaataatgcagaggggattactgggtcgtagccaggtgggcgttggggtatttcaagaaaacgtgttccatacaatgtggcacgtcacccgcggagcggtgctcatgtaccagggcaagcggttggagccgagttgggctagcgttaaaaaggacctgatctcctacggtgggggatggagactccagggctcttggaatacaggcgaggaagtgcaggtcattgccgtggagcctgggaaaaaccccaagaatgtacaaactgcaccaggaacctttaagacgcccgaaggtgaggtcggcgccatcgctctggatttcaaacctgggacatcgggaagcccaattgtgaacagggaaggcaagatcgttggtctttatgggaatggagtggtcactacctcaggcacatacgtgtccgccatagcacaggctaaagccagtcaggagggccccctgcctgagatcgaagacgaggtttttcgaaagcggaacttgaccattatggatctacacccggggtctggaaaaactcgcagatatctgccagcgatcgtgagggaagccattaagcggaagctccgaaccttaatcctggcacccacaagagtcgtggctagcgagatggccgaagctcttaaaggtatgcctatacgctaccaaacgactgcagtaaagtccgagcataccggcaaagagattgtggacctgatgtgccacgccacattcaccatgaggctcttgtcaccagttcgtgtccccaattataacatgatcatcatggatgaagcccattttactgacccttctagcattgctgcgcgggggtacatcagtacaagagtgggaatgggcgaggcagccgctatattcatgaccgccacgccgcccggttccgtggaagcatttccacagagcaatgccgtcattcaggatgaggaaagggacatccctgagcgctcttggaactcagggtatgagtggattactgatttccccggaaagacagtatggtttgtgccatccatcaaaagtggcaatgacatagctaactgtctgcgaaagaatggcaagagagttattcagctcagccggaaaaccttcgataccgaataccaaaagactaaaaacaacgactgggactacgtggtcacaaccgatatctcggagatgggggcgaatttcagggccgaccgcgtgatcgatcctcgtagatgcctgaagcccgttattcttaaagacggaccagaacgggtgatcctagcaggtccgatgcctgtcacagtggcttctgccgcacagaggcgcggccgaattgggagaaaccacaataaggagggagatcagtatatatacatgggccagcccctgaacaatgacgaggatcatgcccactggactgaagctaagatgttgttagacaacatcaatacgccagagggtattatccccgccctgtttgaacctgagcgggaaaaatccgcggcaatcgatggggagtataggctccgcggcgaggccagaaagaccttcgtagaactgatgaggcggggagaccttccagtgtggctgagctacaaagttgcttcagagggctttcaatatagtgatcgtcgctggtgcttcgacggggaacgaaacaatcaggtcctcgaggaaaacatggatgtggagatttggacaaaggagggagaaaggaaaaagttgaggccccggtggctggacgcccgcacttactctgaccctctagctctgagagagtttaaagagttcgcagccggtaggcggtccgtgagcggcgatctcatacttgagatcgggaagctgccgcagcacttaacccagcgagctcaaaatgccttggacaacctggtcatgctccataattcagaacagggaggcagagcatatcgccacgcgatggaggagctgccagatacaattgaaacccttatgctgctcgccttgatcgctgttctgactggtggggtgacgttatttttcctaagtggcaggggactgggcaagaccagcattgggctcctttgtgtaatggcctcctctgtgctgttgtggatggcaagcgtcgagccccattggatcgctgcctccataatcctggaatttttcctcatggtgctgcttattcctgagcccgaccggcagcgtacaccacaggataaccaactcgcatacgttgtgatcggactgttgtttatgattctgactgtcgccgctaatgagatgggtttactagaaaccaccaaaaaggacctgggcatcgggcacgtagcggtggagaaccaccatcacgccgcaatgctcgatgttgaccttcatcctgcttcagcctggaccctgtacgccgtggcaactacaataattacgcccatgatgagacacaccatcgaaaacactacagctaatatttctttgaccgccatcgcgaaccaggctgccatactgatgggactcgataaaggctggccaatcagtaagatggacattggtgtccctctgcttgcattagggtgctatagccaggtgaatccgctgaccctcacagccgctgtcttgatgctggtggcacattacgccatcattggccccggactacaagcgaaagctactagggaggcccagaagcgcacggcagccggcatcatgaagaacccaaccgttgatgggatagtggctattgacctggatcctgtagtgtatgacgccaaattcgaaaagcagctcggacagatcatgcttctgatcttgtgtacaagccaaattctgctcatgcggactacctgggcactgtgcgagtccatcacattagctaccggcccccttactacgctgtgggagggttctccagggaaattttggaatacaaccatagccgtctcaatggcgaacattttccgaggaagctacctcgccggcgcaggtctagctttctccctgatgaagagtttgggcgggggaagaaggggcactggggcccagggagaaaccctgggcgagaaatggaagcgccagctcaatcagctttctaagagcgaatttaacacatataaacggtcaggtatcatggaggttgacagatccgaagcaaaggaggggctgaaacgtggagagactaccaagcacgctgtgagtaggggcacagccaaattgcggtggttcgtcgaacgcaatctggtgaagcctgagggtaaggtaattgatctcggctgtgggcgaggaggctggagctactattgcgccgggctaaagaaggtgacggaagttaaaggatacaccaagggcggtcccgggcacgaggaaccgatcccaatggcgacttacggatggaacctggtgaaacttcattctggcaaggacgtctttttcatacctcccgagaaatgtgatacactgctatgcgacatcggcgagtcctcaccaaatcccaccattgaagaggggagaactctcagggtgctgaagatggtcgaaccttggttgcggggaaaccaattttgtatcaagattctgaatccgtatatgcccagcgtggttgagacactcgagcagatgcagcgcaaacacggtggcatgcttgtaagaaacccactgtcgagaaattctacccatgaaatgtactgggtgagttgcgggacgggaaacatcgtctccgctgtgaatatgaccagccgaatgttactgaaccggttcacaatggcacaccgtaagcctacttatgagagagatgttgacttgggcgccggtacccgccacgtggctgtcgaacccgaggtggccaacctcgatattatcgggcagaggatagaaaatattaaacatgagcacaagtcaacatggcattacgacgaggataacccttataaaacttgggcataccacggatcctatgaagtaaagccatctggcagcgccagttccatggtgaatggcgttgtcaagctgctaaccaaaccctgggacgtgatccctatggtgacacaaatcgctatgaccgatactacgccatttgggcagcagcgggtcttcaaggagaaagttgacacaagaacccccaaggcgaaacgcggaactgcccaaattatggaagtgaccgcaaagtggctttggggttttctgagcaggaacaagaaaccgcgaatatgtacacgggaggagttcacgagaaaggtaaggtctaatgctgccatcggcgcagtgtttgtcgacgagaaccagtggaactcagccaaagaggctgtggaagatgagcgcttctgggacctcgttcatcgtgaacgggagctgcacaagcaggggaaatgcgccacatgcgtgtacaacatgatgggaaagagagaaaagaaattgggcgagtttggtaaggcgaaagggagtagggcaatttggtacatgtggctgggagcccgcttcctcgagttcgaagctcttggctttatgaatgaggatcactggttctcccgagaaaacagcctgtctggcgtcgagggggagggattacataagctgggttatatcttgcgggacatttcgaaaatccctggcgggaatatgtacgccgatgacactgcaggatgggatacaagaataaccgaagacgatctccagaacgaggctaggatcactgacattatggaaccagagcacgccctgctagctaagtcaatctttaaacttacatatcaaaataaggtggtacgcgttcagagacccgccaagaacggcaccgtgatggatgtcattagccggagggaccagcgtggttccggacaggtgggaacatacggcctgaatactttcaccaacatggaagcacaactcatccgacagatggagagtgagggcatattttctcctagcgaactggagacgccaaacttggcgaaacgcgtgttagattggctggaaaagtatggggtcgagagactcaaacggatggccatttccggagacgactgtgttgtgaagcccatcgatgacaggttcgctaccgcccttacagcactgaatgatatgggtaaagtacgcaaggacatcccgcagtgggaaccttcaaagggctggaacgattggcagcaagtgcccttttgcagtcatcacttccaccagctaattatgaaagacgggagagagatagtcgtgccatgtcggaatcaggatgagctggttggaagggctcgagtgtctcagggcgccggttggagcctccgtgaaactgcatgcttggggaagtcctacgcccaaatgtggcagctgatgtattttcatagacgcgaccttcggctggcggctaacgccatctgttcagcagtccctgtggattggattcccaccagcaggacaacttggtctatccacgcccatcaccagtggatgaccacggaggacatgctctccgtatggaatagagtttggattgaagagaacccatggatggaagataaaacacatatcagtagctggggagacgtgccctacttaggcaagcgcgaggaccaatggtgcggctcgctgatagggttgaccgctcgggccacttgggcaacaaatatccaggtcgctattaaccaggtgaggcgactgatcggaaatgagaactacctcgattatatgacctccatgaaaagattcaagaatgaatctgaccctgagggtgccctttggtga

SEQ ID NO: 14050 - RNA, 9879 nt, synthetic construct
  misc_feature 1..9879: note = derived and/or modified CDS sequence (opt3) from DENV-1__EU482516__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactctgtcccttcactatgcctggaaaaccatggcaatggtgctctcaattgtcagcctgtttcccttgtgtctgagtacgacatctcagaagaccacttggttaccggtactcctgggctcccttgggtgcaagcctctgacaatgttcttgatcgctgagaataaaatatggggaaggcgaagctggccactcaacgaaggtatcatggccgtgggcattgtttcgatcctgctatcatctctgcttaagaacgatgtgcccctcgccgggcctctgattgctggaggcatgttgatcgcatgttacgtcataagtggttccagcgccgacttatctctggagaaagcggctgaggtgagctgggaagaggaagccgagcattccggggcatcacacaatattctcgtagaagtgcaggatgacggaaccatgaagatcaaagatgaggagcgcgacgatactctgacaatccttctgaaggccaccttgctagctgtcagtggcgtttatcccctgagcattccagcaacgctctttgtgtggtacttctggcagaaaaagaagcagcggtctggcgtgctgtgggacactccttcacccccagaagtcgggagagccgtgcttgatgacggaatatataggatcatgcagcgtggtttactgggccgcagccaggttggggtaggagtgttccaagagaacgtctttcataccatgtggcacgtgacacggggcgcggttctcatgtaccagggtaaaagattggaaccgagttgggctagcgtgaagaaagacctgatttcctacgggggaggctggaggctccagggctcttggaataccggggaggaggtccaggtgatcgccgtagaacctggaaagaaccccaaaaatgtccaaacagcaccaggtactttcaagacccccgagggcgaagtgggggccattgctctggattttaagcctggaacgtcgggcagcccaatcgttaaccgagagggtaaaatagtggggctttatggaaatggcgtcgtgacaacttcaggcacctacgtttccgccatcgcacaggctaaggccagtcaggaagggcccctgcctgagattgaggacgaagtgttccggaaacgcaacttgacaatcatggatctacacccgggatctggtaagaccagaaggtatctgccagcgattgtccgggaggccatcaaacgaaagctcagaactttaatactggcacccacccgcgtggtagctagcgaaatggccgaggctcttaagggcatgcctattaggtaccaaacaacggcagtgaaatccgaacatactgggaaggagatcgttgacctgatgtgccacgccacctttacaatgcgtctcttgtcaccagtccgggtgcccaattataacatgatcattatggatgaggcccatttcaccgacccttctagcatcgctgcgagaggatacataagtactagggtgggcatgggtgaagcagccgctatttttatgacagccaccccgcccgggtccgtcgaggcattcccacagagcaatgccgtaatccaggatgaagaacgcgacattcctgaacgatcttggaactcaggatatgagtggatcacggattttcccggcaaaactgtgtggttcgttccatccataaagagtggcaatgacattgctaactgtctgaggaaaaatgggaagcgggtgatccagctcagcaggaagacatttgataccgagtaccagaaaaccaagaacaacgactgggactacgtcgtgactacagatatctcggaaatgggagcgaatttccgcgccgaccgtgttattgatcctagacggtgcctgaaacccgtgatccttaaggacggtccagagagggtcattctagcaggcccgatgcctgtgaccgtagcttctgccgcacagcgccgagggagaataggacggaaccacaataaagaaggcgatcagtatatctacatgggtcagcccctgaacaatgacgaggatcatgcccactggacagaggctaagatgttgttagacaacattaatactccagaagggatcatccccgccctgttcgagcctgaaagggagaagtccgcggcaattgatggcgaatatcgcctcagaggagaggccaggaaaacgtttgtggagctgatgcggcgtggcgaccttccagtttggctgagctacaaggtcgcttcagaagggttccaatatagtgatcgccgatggtgctttgacggagagagaaacaatcaggtgctcgaagagaacatggatgtggaaatatggaccaaagagggtgagaggaagaaattgcggccccgctggctggacgccagaacatactctgaccctctagctctgagggagttcaaggagtttgcagccggccggcgatccgtcagcggggatctcatccttgaaattggaaaactgccgcagcacttaactcagagagctcaaaatgccttggacaacctggttatgctccataattcagagcagggcggtcgcgcatataggcacgcgatggaggaactgccagataccatcgagacacttatgctgctcgccttgattgctgtgctgaccgggggcgtaactttattctttctaagtggacggggcctggggaagacgagcatcggactcctttgtgtgatggcctcctctgtcctgttgtggatggcaagcgtggaaccccattggatagctgcctccatcattctggagttctttctcatggttctgcttatccctgaacccgaccgtcagagaaccccacaggataaccaactcgcatacgtggtcattggtctgttgttcatgatcctgacagtagccgctaatgagatgggcttactagagactaccaagaaagacctggggataggacacgtggcggttgaaaaccaccatcacgccgcaatgctcgatgtggaccttcatcctgcttcagcctggacactgtacgccgtcgcaaccactattatcacacccatgatgaggcacacgattgagaacaccactgctaatatctctttgacagccatagcgaaccaggctgccatcctgatgggcctcgataagggttggccaattagtaaaatggacatcggggtgcctctgcttgcattaggctgctattcgcaggtcaatccgctgaccctcaccgccgctgtgttgatgctggttgcacattacgccattatcggacccggcctacaagcgaaggctacacgcgaagcccagaaacggactgcagccgggataatgaagaacccaacggtggatggaattgtagctatcgacctggatcctgtggtctatgacgccaagtttgagaaacagctcggccagatcatgcttctgattttgtgtaccagccaaatcctgctcatgcgaacaacttgggcactgtgcgaatccataaccttagctacaggtccccttaccactctgtgggaggggtctccaggaaagttctggaatacgacaattgccgtttcaatggcgaacatctttagaggcagctacctcgccggtgcaggcctagctttctccctgatgaaaagtctagggggaggcaggcgcgggaccggagcccagggcgagactctgggtgaaaagtggaaacggcagctcaatcagctttctaagagcgagttcaacacctataagagatcagggattatggaagtggaccgttccgaggcaaaagaaggactgaagaggggcgagacaactaaacacgctgtcagtcggggtaccgccaagttgcgctggtttgtggagcgaaatctggtaaaacctgaaggcaaggtgatcgatctcgggtgtggaagaggcgggtggagctactattgcgccggattaaagaaagttacagaggtgaagggctacacgaaaggtgggcccggacacgaggaaccgataccaatggcgacctacggctggaacctggtcaaacttcattctggcaaagacgtgttctttatccctcccgaaaagtgtgatactctgctatgcgacattggggagtcctcaccaaatcccacaatcgaggaaggaaggaccctccgggtcctgaaaatggtggagccttggttgcgcggtaaccaattctgtattaagatcctgaatccgtatatgcccagcgttgtagaaactctcgagcagatgcagagaaagcacggcgggatgcttgtgaggaacccactgtcgcgaaattctacacatgagatgtactgggtcagttgcggaaccggcaacattgtgtccgctgttaatatgacgagccggatgttactgaaccgttttaccatggcacacagaaaacctacatatgaacgcgatgtggacttgggtgccgggactaggcacgtcgctgtggagcccgaagtagccaacctcgatatcataggacagcggattgagaatatcaagcatgaacacaaatcaacctggcattacgacgaggataacccttataagacatgggcataccacggctcctatgaggtgaaaccatctggcagcgccagttccatggttaatggggtcgtgaagctgctaactaagccctgggacgtgatccctatggtcacccaaattgctatgacagataccactccattcggacagcagagagtttttaaagaaaaggtggacacgcgcacacccaaagcgaagaggggtaccgcccaaataatggaggtaactgcaaaatggctttggggcttcctgagccgaaacaagaagccgcggatctgtaccagagaagagtttacaaggaaagtgcgctctaatgctgccattggggcagtcttcgtggacgaaaaccagtggaactcagccaaggaggctgttgaggatgaacgtttttgggacctcgtgcatcgggagagagaactgcacaaacagggaaagtgcgccacgtgcgtctacaacatgatgggcaaaagggagaagaagttgggtgagttcgggaaagcgaagggaagtcgcgcaatctggtacatgtggctgggcgcccgatttctcgagttcgaggctcttggcttcatgaatgaagatcactggttttcccgggagaacagcctgtctggggtggaaggagagggtttacataaactgggctatattttgagagacatctcgaatatacctgggggaaacatgtacgccgatgacaccgcaggctgggatactaggatcacagaggacgatctccagaatgaagctcgcattaccgacatcatggagccagaacacgccctgctagctaagtcaattttcaaacttacttatcaaaacaaggtagttagagtgcagcggcccgccaaaaatggtacagtcatggatgtgatcagcaggcgtgaccagcgagggtccggacaggtgggcacctacggcctgaacacatttactaacatggaggcacaactcatacgccagatggaaagtgaggggattttctctcctagcgagctggaaaccccaaatttggcggagagagtcttagattggctggaaaagtatggagttgagcggctcaagaggatggccatctccggtgacgactgtgtggtaaaacccatcgatgaccgctttgctacggcccttaccgcactgaacgatatgggcaaggtgagaaaagacattccgcagtgggaaccttcaaaggggtggaatgattggcagcaagtccccttctgcagtcatcactttcaccagctaataatgaaagacggacgggagatcgtggttccatgtaggaaccaggatgagctggtgggccgagctcgtgtctctcagggtgccgggtggagcctcagagaaacagcatgcttgggaaagtcctacgcccaaatgtggcagctgatgtatttccatcgccgggaccttaggctggcggctaatgccatttgttcagcagtgcctgtagattggatccccactagcagaaccacatggtctattcacgcccatcaccagtggatgactaccgaggacatgctctccgtttggaaccgcgtgtggatcgaagagaatccatggatggaagataagacgcatataagtagctggggcgacgtcccctacttaggcaaacgggaggaccaatggtgcgggtcgctgatcggattgacagctagggccacctgggcaactaacattcaggtggctatcaatcaggttcgaagactgattggtaacgagaattacctcgattatatgacatccatgaagcggtttaaaaacgaatctgaccctgagggcgccctttggtga

SEQ ID NO: 14051 - RNA, 9879 nt, synthetic construct
  misc_feature 1..9879: note = derived and/or modified CDS sequence (opt3) from DENV-1__EU482517__SS-prME
  source 1..9879: mol_type = other RNA
agcgtgaccatgctgctcatgcttatgcccaccgcactggctttccacttgactacgagaggcggggaacctcatatgatcgtctccaagcaggaaaggggaaaatctttactgtttaagacctcagccggtgttaatatgtgcacgctaattgccatggacctcggcgaactgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaacactgcacacgctaaaaagcaggaagttgtggtcctcggtagtcaagagggggccatgcacaccgctctgacgggcgccaccgaaatccagacatctggaactaccacaatttttgcaggccatttaaagtgccgtctgaaaatggataagctaactctcaaagggatgtcctatgtgatgtgtaccggtagcttcaagctggagaaagaacttgccgagacgcagcacggaacagtcttggtgcagataaagtacgagggcaccgacgctccttgcaagatcccattctcgactcaagatgaaaaaggggttacacagaatggacgcctgattaccgcgaaccccatcgtgactgacaaggagaaacctgtaaatatagaagcagagccaccctttggcgagtcttatattgtcatcggtgccggggaaaaggctctcaaactgtcctggttcaagaagggctcaagtatcggaaaaatgtttgaggccaccgcaagaggcgccaggcggatggctattcttggggatacagcctgggacttcggaagcatcggtggcgtgtttacgtccgttgggaagctggtgcatcagattttcggaaccgcatacggcgtcttgttttctggtgtgagctggactatgaaaatagggatcggcgtactcctgacatggttaggactgaactcacgaagtacctccctaagcatgacatgtattgcggtgggcctcgttactctgtaccttggggtcatggtgcaggctgattctggatgcgtgatcaattggaagggccgcgaattgaaatgtggttcagggatcttcgtcaccaacgaggttcacacgtggacagaacaatataagtttcaggccgacagtccgaagagactgagcgcagccattggaaaggcttgggaggagggcgtgtgcggtataaggtccgccacccggctcgaaaacatcatgtggaagcagatttctaatgagctgaaccatatcttactggaaaatgacatgaaattcactgtggtagtcggcgatgtggcagggattcttgctcagggaaagaaaatgatccgccctcaacccatggagcacaagtactcgtggaaaagctggggcaaggccaagataatcggggcggacgttcagaacaccacatttattatcgatggaccaaatactcctgaatgtcccgacgatcagagagcctggaacatttgggaggtggaggactatggcttcggtatctttaccacaaatatatggttgaaactcagggattcctacacgcaggtctgcgaccaccgtctgatgtcagctgcaattaaggatagtaaagccgtgcatgctgacatggggtattggatcgaatctgagaagaacgaaacctggaaactagcccgggcatccttcattgaggttaagacttgtatctggccaaagtcccacacactgtggtcaaatggagtgctcgaaagcgagatgataatccccaaaatttacggcggtcctatctctcaacataactatcgaccaggctacttcacccagactgcggggccgtggcacctgggaaaacttgagttggattttgacctgtgcgaaggcacaaccgtagtcgtggatgagcactgcgggaatagaggaccctccttaaggacgactaccgtgacaggcaaaattatccatgaatggtgttgccgcagttgtaccctccctccactgcggttcagaggtgaggacgggtgctggtacggaatggagataaggcccgtcaaggaaaaagaggaaaaccttgttaagagcatggtgtctgccggctccggtgaggtagactcatttagtctgggcttgctctgtattagcatcatgatcgaagaggtgatgcgctcgcgatggtcccggaagatgctgatgactgggacactagctgtcttctttctgctcattatgggacagctgacctggaatgatcttatccgtttgtgcattatggtgggcgccaacgcatctgacagaatggggatgggaacaacttatctggctttaatggccaccttcaaaatgaggcctatgtttgcagttggcctcctgttccgccggcttacgagcagagaggtgctgctactcacaataggtctgtcattggtcgccagtgtggaactgccaaattccttagaggaactcggggatggactggctatgggcatcatgattcttaagctgttgaccgactttcaatctcaccagctctgggcgactctgctaagcctgaccttcatcaaaacaactttttcccttcattacgcctggaagaccatggcaatggttctctcaattgtgagcctgttccccttgtgtctgagtacgacatctcagaaaaccacttggttaccggtcctcctgggctcccttgggtgcaagcctctgacaatgtttttgatcgctgagaacaagatatggggaaggcgaagctggccactcaacgaaggtatcatggccgtaggcattgtgtcgatcctgctatcatctctgcttaaaaatgatgttcccctcgccgggcctctgattgctggaggcatgttgatcgcatgttatgtgataagtggttccagcgccgacttatctctggagaaggcggctgaggtcagctgggaagaggaagccgagcactccggggcatcacataacattctcgtggaagtacaggatgacggaaccatgaaaatcaaggatgaggagcgcgacgatactctgacaatccttctgaaagccaccttgctagctgtgagtggcgtctaccccctgagcattccagcaacactcttcgtttggtatttctggcaaaagaaaaagcagcggtctggcgtgctgtgggacactccttcacccccagaagtggagagagccgtccttgatgacgggatatacaggatcatgcagcgtggattactgggtcgcagccaggtgggcgttggggtatttcaagaaaatgtgttccacaccatgtggcacgtcacacggggagcggtgctcatgtatcagggcaagagattggagccgagttgggctagcgttaaaaaggacctgatttcctacggtgggggatggaggctccagggctcttggaacaccggcgaggaagtgcaggtcatcgccgtggagcctgggaaaaatcccaagaacgtacaaacagcaccaggaacttttaaaacccccgaaggtgaggtcggcgccattgctctggatttcaagcctgggacgtcgggaagcccaatcgtgaatcgagaaggcaagatagttggtctttacgggaacggagtggtcacaacttcaggcacctatgtgtccgccatcgcacaggctaaagccagtcaggagggccccctgcctgagattgaagacgaggtttttcggaagcgcaatttgacaatcatggatctacatccggggtctggaaaaaccagaaggtacctgccagcgattgtgcgggaagccatcaagcgaaaactcagaactttaatactggcacccacccgcgtcgtggctagcgagatggccgaagctcttaagggtatgcctattaggtatcaaacaacggcagtaaagtccgagcacactggcaaagagatcgtggacctgatgtgccatgccaccttcacaatgcgtctcttgtcaccagttcgggtccccaactacaatatgatcattatggatgaagcccactttaccgacccttctagcatcgctgcgagagggtatataagtactagggtgggaatgggcgaggcagccgctattttcatgacagccaccccgcccggttccgcagaagcctttccacagagcaacgctgtgatccaggatgaggaacgcgacattcctgagcgatcttggaactcagggtacgagtggatcacggatttccccggaaagactgtctggtttgtaccatccataaaaagtggcaacgacattgcgaattgtctgagaaagaacggcaaacgggtgatccagctcagcaggaagacattcgataccgaatatcaaaagaccaaaaacaatgactgggactacgttgtgactacagatatctcggagatgggggccaacttccgcgcagaccgtgtcattgatcctagacggtgcctgaagcccgtgatccttaaagacggaccagaaagggttattctagctggtccgatgcctgtgaccgtcgcctctgcagcccagcgccgaggcagaatagggcggaatcataacaaggagggagatcagtacatctatatgggccagcccctgaataacgacgaggatcacgctcactggacagaagccaaaatgttgttagacaatattaacactccagagggtatcatccccgcgctgtttgaacctgagagggaaaagtccgcagccattgatggggagtaccgcctcagaggcgaggctaggaagacgttcgtggaactgatgcggcgtggagaccttccagtatggctgagctataaagtggcctcagagggctttcaatacagtgatcgccgatggtgcttcgacggggaaagaaataaccaggttctcgaggaaaatatggatgtcgagatatggaccaaggagggagaaaggaaaaagttgcggccccgctggctggacgctagaacatattctgaccctctagcactgagggagtttaaagagttcgccgctggtcggcgatccgtgagcggcgatctcatccttgagattgggaagctgccgcagcatttaactcagagagcccaaaacgcattggacaatctggtgatgctccacaactcagaacagggaggccgcgcgtacaggcatgccatggaggagctgccagataccatcgaaacacttatgctgctcgctttgattgccgtcctgaccggtggggttactttatttttcctaagtggccggggactgggcaaaacgagcatcgggctcctttgtgtgatggcatcctctgtactgttgtggatggctagcgtggagccccactggatagccgcatccatcattctggaatttttcctcatggtcctgcttatccctgagcccgaccgtcagagaaccccacaggataatcaactcgcctatgtggttattggactgttgtttatgatcctgacagtggctgcgaacgagatgggtttactagaaactaccaagaaggacctgggcatagggcacgtcgccgtagagaaccatcaccatgcagctatgctcgatgtggaccttcaccctgcctcagcctggacactgtacgcagttgctaccactattatcacacccatgatgaggcatacgattgaaaataccactgccaacatctctttgacagcgatagctaatcaggccgcaatcctgatgggactcgataaaggctggccaattagtaagatggacatcggtgtgcctctgcttgccttagggtgctactcgcaggtcaacccgctgaccctcaccgctgcagtgttgatgctggtcgcccactatgcgattatcggccccggactacaagctaaagccacacgcgaggcacagaagcggactgccgctggcataatgaaaaatccaacggtggatgggattgttgccatcgacctggatcctgtggtatacgacgcaaagttcgaaaagcagctcggacagatcatgcttctgattttgtgtaccagccaaatcctgctcatgcgaacaacttgggctctgtgcgagtccataaccttagccacaggcccccttaccactctgtgggagggttctccagggaaattttggaacacgacaattgcggtgtcaatggccaatatcttcagaggaagctatctcgcaggcgctggtctagccttctccctgatgaagagtttgggcgggggaaggcgcggcaccggggcacagggagaaactctgggcgagaaatggaagcggcagctcaaccagctttctaaaagcgaatttaatacctacaagagatcaggtattatggaggtcgaccgttccgaagctaaggaggggctgaaaaggggagagacaactaagcacgccgttagtcggggcaccgccaaattgcgctggttcgtggaacgaaacctggtcaagcctgagggtaaagtgatcgatctcggctgtgggagaggaggctggagctattactgcgcggggttaaagaaggtaacagaagtgaaaggatatacgaagggcggtcccgggcatgaggaaccgataccaatggctacctacggatggaatctggttaaacttcactctggcaaggacgtgtttttcatccctcccgagaaatgtgatactctgctatgcgacattggcgagtcctcaccaaaccccacaatcgaagaggggaggaccctccgggtcctgaagatggtggaaccttggttgcgcggaaatcaattttgtattaaaatcctgaacccgtacatgcccagcgtcgtggagactctcgagcagatgcagagaaagcatggtggcatgcttgttaggaatccactgtcgcgaaactctacacacgaaatgtattgggtaagttgcgggaccggaaatattgtgtccgcagtcaacatgacgagccggatgttactgaaccgtttcaccatggcccacagaaagcctacatacgagcgcgatgtggacttgggcgctggtactaggcatgttgccgtggaacccgaggtcgcaaatctcgatatcatagggcagcggattgaaaacatcaaacacgagcataagtcaacctggcactatgacgaggataatccttacaaaacatgggcctatcatggatcctacgaagtgaagccatctggcagcgctagttccatggtaaacggcgtggttaaactgctaactaagccctgggacgtcatccctatggtgacccaaattgcgatgacagataccactccatttgggcagcagagagtgttcaaggagaaagtcgacacgcgcacacccaaggccaaaaggggaaccgcacaaataatggaagttactgctaagtggctttggggttttctgagccgaaataaaaagccgcggatctgtaccagagaggagttcacaaggaaggtgcgctctaacgccgcaattggcgccgtatttgtggacgagaatcagtggaactcagctaaagaggccgtcgaagatgagcgtttctgggacctcgtgcaccgggaaagagagctgcacaagcaggggaaatgcgcgacgtgcgtttataatatgatgggaaagagggagaaaaagttgggcgagtttggtaaggcaaaagggagtcgcgccatctggtacatgtggctgggagctcgattcctcgagttcgaagcccttggctttatgaacgaggatcattggttctcccgggaaaatagcctgtctggcgtggagggggagggattacacaagctgggttacattttgagagacatctcgaaaatacctggcgggaacatgtatgcagatgacaccgctggatgggatactaggatcacagaagacgatctccagaatgaggcccgcattaccgacatcatggaaccagagcatgctctgctagccaagtcaatttttaaacttacttaccaaaacaaggtcgtgagagtacagcggcccgccaaaaatggcacagttatggatgtgatcagcaggcgtgaccagcgaggttccgggcaggtcggaacctatggcctgaacacattcactaacatggaagcgcaactcatacgccagatggatagtgagggcatattttctcctagcgagctggaaaccccaaatttggccgagagagtgttagactggctggaaaagtacggggtggagcggctcaagaggatggctatctccggagacgattgtgtcgttaaacccatcgacgatcgcttcgccacggcacttaccgctctgaacgacatgggtaaggtgagaaaagatattccgcagtgggaaccttcaaagggctggaatgactggcagcaagtacccttttgcagtcaccacttccatcagctaataatgaaagatgggcgggagatcgtggtcccatgtaggaaccaggacgagctggtgggacgagcccgtgtttctcagggcgcaggttggagcctcagagaaacagcctgcttggggaagtcctatgcgcaaatgtggcagctgatgtactttcaccgccgggatcttaggctggctgccaatgcaatttgttcagccgtgcctgtcgactggatccccactagcagaaccacatggtctattcatgctcaccatcagtggatgactaccgaggatatgctctccgtgtggaaccgcgtatggatcgaagagaatccatggatggaagacaagacgcacataagtagctggggagacgttccctatttaggcaaacgggaggatcaatggtgcggctcgctgatcgggttgacagccagggcaacctgggctactaacattcaggtggccatcaatcaggtccgaagactgattggaaacgagaattacctcgactacatgacatccatgaagcggttcaaaaacgaatctgatcctgagggtgcgctttggtga

SEQ ID NO: 14052 - RNA, 9879 nt, synthetic construct
  misc_feature 1..9879: note = derived and/or modified CDS sequence (opt3) from DENV-1__EU482519__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggatcaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttatggcactgtttctggcccatgctattggcacctctatcacgcagaagggcattatcttcatactcttaatgctggtgactccatcgatggccatgcgctgcgtcgggatcggatcaagagattttgtggagggtcttagcggcgcgacatgggttgacgttgtgttggagcacgggagttgtgtcaccactatggcaaaggataaacccacactggacattgaactactcaagaccgaggtgacgaaccctgccgtgctgaggaaactttgcatcgaagctaagatttccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaaggtagtgcagtacgaaaacttaaaatattccgtcatagtgaccgttcacactggagaccagcatcaagtgggtaatgagtcaacggaacacggcacaaccgccactattacaccccaggcgcctacaagtgagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaattcagacctctggaacaactaccatctttgccggccatttaaaatgccgtctgaagatggataaactaacactcaaggggatgtcctatgtgatgtgtactggatcgttcaaactggagaaggaagtcgctgagacccagcacggtacggtgcttgttcagatcaagtacgagggcacagacgcgccttgcaaaattccattctcgacccaagatgaaaagggggtgatacagaacggacgcttgatcactgcaaatcccattgtaacagacaaagagaagcctgtcaacatcgaagccgagccaccctttggcgagtcttatatagtgattggtgttggggaaaaagctctgaagctctcctggttcaagaaaggctcaagtatcggaaagatgtttgaggccaccgcaagaggcgccaggcggatggctatcctgggggatactgcctgggacttcggaagcattggtggcgtgtttacctccgtcgggaaacttgtgcatcagatcttcggaacagcatacggcgtactgttttctggtgtgagctggacgatgaagattgggataggcgttttgctcacctggctgggattaaattcacgaagtacttccctgagcatgacatgtatcgcggtcggcctagtgaccctctacctgggggtgatggtccaggctgattctggatgcgttattaactggaaaggccgcgaacttaagtgtggttcagggatcttcgtgacaaatgaggtgcacacttggaccgaacaatataagtttcaggccgacagtccgaaaagattgagcgcagccatcggaaaggcttgggaggagggcgtatgcggtattaggtccgccacgcggctggaaaacataatgtggaaacagatctctaacgagctcaatcatattctgttagaaaacgacatgaagttcacagtcgtggttggcgatgtggtcgggatcctggcacagggcaaaaagatgattcgccctcaacccatggagcacaaatactcgtggaaaagctggggcaaggctaagatcataggggccgacgtgcagaataccacttttatcattgatggaccaaacacccctgaatgtcccgacgatcagagagcgtggaatatctgggaggttgaggactatggcttcggtatttttacaactaacatctggcttaagttgagggattcctacacccaggcctgcgaccaccgtctcatgtcagctgcaataaaagatagtaaggccgtgcatgctgacatggggtattggattgaatctgagaaaaatgaaacatggaagctggcccgggcatccttcatcgaggtaaagacgtgtatttggccaaaatcccacaccctatggtcaaacggagtcctggaaagcgagatggtgatccccaagatatacggcggtcctatctctcaacataattatcgaccaggctacttcactcagacagcggggccgtggcacctcggaaaactggagcttgattttgacttgtgcgaaggcaccactgtggtcgttgatgagcactgcgggaacagaggaccctccctgaggacaaccacggtgactggcaagattatccatgaatggtgttgccgcagttgtaccttacctccactccggttcaaaggtgaggacgggtgctggtacggaatggagattagacccgtaaaggaaaaggaggaaaatctggtgaaaagcatggtctctgccggctccggtgaggtggactcatttagtcttggcctgttgtgtatcagcataatgattgaagaggttatgaggtcgcgctggtcccgaaagatgctcatgacagggaccctggctgtgttcctactgctcatcatgggacagctgacttggaacgatcttacacggttgtgcatcatggtcggcgccaatgcatctgaccgtatggggatgggaaccacatatctggctttaatggccacttttaaaatgagacctatgttcgcagtgggcctcctgtttaggcgccttaccagccgggaggttctgctactcacgattggtctgtcattggtggccagtgtcgaactgccaaactccttagaggaactcggggatggactggctatgggcatcatgattcttaagctgttgacagacttccaatctcaccagctctgggcgaccctgctaagcctgacttttataaaaaccacactttccctccattacgcctggaagactatggcaatggtactgtcaatcgtgagcttgttccccctgtgtttaagtaccacgtctcagaagacaacctggctcccggttctgcttggctccctggggtgcaaacctttgactatgtttctcattgctgagaataagatctggggaagaaaaagctggccactgaacgaaggtattatggccgtgggcgtcgtgtcgatcctactgtcatctcttctcaagaacgatgtacccctggccgggcctttgatagctggaggcatgttaatcgcatgttatgtgattagtggttccagcgccgacctgtctctcgagaaagcggctgaggtcagctgggaagaggaagccgagcactccggggcatcacataatatcctggttgaagtgcaggatgacggaacaatgaagattaaagatgaggagagggacgatacccttactatcctgttgaaggccacactactggctgtgagtggcgtctaccccctcagcataccagcaaccctgttcgtgtggtatttttggcaaaagaaaaagcagcgatctggcgttctttgggacacgccttcacccccagaagtagagcgcgccgtgttagatgacgggatttaccggatcatgcagagaggactgctcggtaggagccaggtcggcgtgggggttttccaagaaaacgtgttccacactatgtggcacgtcacccgtggagcggtgttgatgtatcagggcaaacgcctggagccgagttgggctagcgtaaagaaagacctcatctcctacggtgggggatggcggctgcagggctcttggaatacaggcgaggaagtccaggtgattgccgttgagcctgggaagaaccccaagaatgtgcaaaccgcaccaggaacatttaaaactcccgaaggtgaggtcggcgccatagctcttgatttcaagcctgggacctcgggaagcccaatcgtgaacagagaaggcaaaattgttggtctgtacgggaatggagtggtcacgacatcaggcacttatgtgtccgccatcgcacaggctaaggccagtcaggagggccccttgcctgagattgaagacgaggtatttaggaaacgaaacctaaccatcatggatctgcatccggggtctggaaagacacggcgctacctcccagcgatagtgagagaagccatcaagaggaaattacggaccctgattcttgcacccactcgagttgtcgctagcgagatggccgaagctctgaagggtatgcctatcagatatcaaaccacagcagtgaaatccgagcacacgggcaaggagattgtggacctcatgtgccatgccactttcaccatgcgcttgctgtcaccagtcagggtacccaattacaacatgatcataatggatgaagcccactttacagacccttctagcattgctgcgcgtgggtatatcagtacccgggtgggaatgggcgaggcagccgctatcttcatgactgccacaccgcccggttccgttgaagcatttccacagagcaatgccgtgattcaggatgaggaaagagacatccctgagaggtcttggaactcagggtacgagtggataaccgatttccccggaaaaacggtctggtttgtgccatccattaagagtggcaatgacatcgctaactgtctccgcaagaatggcaaacgagttattcagctgagcagaaagactttcgatacagaatatcagaaaaccaagaacaacgactgggactacgtggtcaccactgatatctcggagatgggggcgaattttcgggccgacagggtgatagatcctcgccgttgccttaaacccgtaattctaaaggacggaccagaaagagtgatcctggcaggtccgatgcctgttacagtcgcttctgccgcacagcggaggggccgcatcgggcgaaaccataataaggagggagatcagtacatttatatgggccagcccttgaacaatgacgaggatcacgcccactggaccgaagctaaaatgttactggacaacatcaatacaccagagggtattatacccgccctcttcgaacctgagagagaaaagtccgcggcaatcgatggggagtaccggctgaggggcgaggcccgcaaaactttcgtggaacttatgagaaggggagacctgccagtgtggctcagctataaggtcgcttcagagggctttcaatacagtgatcggcgttggtgcttcgacggggaacgcaacaatcaggttttggaggaaaacatggatgtggagatttggacgaaagagggagaacgaaagaaactgagacccaggtggctagacgcccggacctattctgaccctctggctctccgcgagtttaaggagttcgcagccggtagaaggtccgtaagcggcgatcttatcctggagatcgggaagttaccgcagcatttgacacagcgggctcaaaatgccctggacaacctcgtgatgctgcacaattcagaacagggaggccgagcatacagacatgcgatggaggagcttccagatactattgaaaccctgatgctcttggccctgatagctgtcttaacaggtggggtgaccctatttttcctgagtggccgcggactcggcaaaactagcatcgggcttctgtgtgttatggcctcctctgtgttgctgtggatggcaagcgtcgagccccactggattgctgcctccatcattctcgaatttttcctgatggtacttctcatccctgagcccgacaggcagcggacgccacaggataaccaactggcatatgtggttataggattgctgtttatgatcttaaccgtggccgctaatgagatgggtctactggaaacaactaagaaagacctcggcattgggcacgtcgcggtggagaaccatcaccatgccaccatgcttgatgtcgacctgcaccctgcatcagcttggacattgtacgccgtggccaccactatcattacacccatgatgcgtcatacgatcgaaaacaccactgcaaatatatctctgacagctattgccaaccaggcggctatcctcatgggactggataagggctggccaattagtaaaatggacatcggtgttcctcttttagccctggggtgctacagccaggtgaatccgctcaccttgaccgcagccgtactgatgctagtggctcactatgcaataatcggccccggactgcaagccaaggcgacaagagaggctcagaagaggactgccgcaggcattatgaaaaacccaacggtcgatgggatcgttgccattgacctcgatcctgtggtctacgacgctaagttcgaaaaacagcttggacagatcatgctgttgatactgtgtaccagccaaattctcctgatgcgcacaacttgggccttatgcgagtccatcacccttgcaacaggccccctgaccactctctgggagggttctccagggaagttttggaatacgacaatcgctgtgtcaatggccaacattttccggggaagctatctagcgggcgccggtctggcattttccttgatgaaaagtctgggcgggggacgaagaggcaccggggctcagggagaaactctcggcgagaagtggaagaggcagcttaatcagctgtctaaaagcgagttcaacatctacaagcgctcaggtataatggaggtagaccggtccgaagccaaagaggggttgaagagaggagagaccacacgtcacgcagtgagtaggggcactgctaaactgcggtggttcgttgaacgcaatctcgtgaagcctgagggtaaggtcattgatttaggctgtgggcgaggaggctggagctattactgcgccgggctgaaaaaggtgaccgaagtcaaaggatatacaaagggcggtcccgggcatgaggaaccgatcccaatggccacgtacggatggaaccttgtgaaactgcactctggcaaggacgtatttttcacccctcccgagaaatgtgatactctactctgcgacattggcgagtcctcaccaaatcccacaatcgaagaggggagaaccctgagggtattgaagatggtggaaccttggctgcggggaaaccaattttgtataaagatcctcaatccgtacatgcccagcgtcgtggagactcttgagcagatgcagcgcaaacatggtggcatgctggttagaaacccattatcgagaaattctacacacgaaatgtattgggtgagttgcgggaccggaaacattgtctccgcggtgaatatgacgagccgaatgctgttgaaccggttcaccatggctcaccgtaagcctacatacgagagagatgtagacctcggcgcaggtactcgccatgtggccgttgaacccgaggtcgctaacctggatatcattgggcagaggatcgaaaatattaaacacgagcataagtcaacctggcactatgacgaggataacccttacaaaacatgggcctatcatggatcctacgaagtgaagccatctggcagcgcaagttccatggtgaatggcgtcgttaagctacttactaaaccctgggacgtgatccctatggtaacccaaatagccatgacagataccactccatttgggcagcagcgggtgttcaaggagaaagtcgacacgagaacacccaaggctaaacgcggaaccgcgcaaattatggaagtgactgccaggtggctgtggggttttctcagccgaaacaagaagccgcggatctgtaccagagaggagttcacaaggaaagttcgctctaatgcagctatcggcgccgtgtttgtcgacgagaaccagtggaactcagcaaaggaggccgtggaagatgagcgtttctgggacctggtacagaaagaacgggagttgcacaagcaggggaaatgcgctacgtgcgtttataacatgatgggaaagagagaaaagaaactgggcgagtttggtaaggccaaagggagtagggcgatttggtacatgtggctcggagcacgcttccttgagtttgaagccctgggcttcatgaatgaggatcactggttctcccgagaaaacagcttatctggcgtggagggggagggactgcataagttgggttacatactccgggacatctcgaaaattcctggcgggaatatgtatgctgatgacaccgccggatgggatactagaatcacagaagacgatctgcaaaacgaggcaaagattaccgacatcatggaaccagagcacgctctacttgccacttcaatatttaaactgacataccagaataaggtcgtgagggtgcagcgccccgctaagaacggcaccgtcatggatgttatcagcagacgggaccagaggggttccgggcaagtgggaacatatggcctcaatactttcaccaacatggaagcccagctgattcgtcagatggagagtgagggcatctttttgccttctgaattagagacgccaaacctggcagaacgagtactcgattggcttgagaaacatggggtggaacgcctgaagagaatggcgattagcggagacgactgtgtcgtgaaacccatcgatgaccggttcgccaccgctctaacagccctgaatgatatgggtaaggttaggaaagacataccgcagtgggagccttccaagggctggaacgattggcaacaggtgcccttttgctcacaccacttccatcagctcattatgaaggacgggcgcgagatcgtcgtgccatgtagaaatcaggatgaattggtaggacgggcaagggttagtcaaggcgctggttggtctctgcgagagactgcctgccttgggaaaagctacgcacagatgtggcagctgatgtattttcaccgtagagacctccgcttagccgcgaacgctatctgttccgccgtgcctgtcgattgggtgcccacctcacggacaacttggagcattcatgcacaccatcaatggatgaccacggaagacatgctgtctgtttggaatagggtgtggatagaggaaaacccatggatggaggataagacacacgtctccagttggggagacgtgccctacttgggcaaaagagaggaccagtggtgcggcagcctgatcgggctcaccgcccgcgctacttgggcctcgaatattcaggtagcaatcaaccaggtgcggaggcttattggaaatgaaaactatctggattacatgacatccatgaagcgattcaaaaatgagggtgaccctgaaggcgctctatggtga

SEQ ID NO: 14053 - RNA, 9879 nt, synthetic construct
  misc_feature 1..9879: note = derived and/or modified CDS sequence (opt3) from DENV-1__EU482520__SS-prME
  source 1..9879: mol_type = other RNA
agcgtgaccatgctgctcatgcttatgcccaccgccctggctttccacttgactacgaggggaggggaacctcatatgatcgtctccaagcaggaaaggggaaagtctttactgtttaagacctcagccggtgttaatatgtgcacgctaattgccatggacctcggcgaactgtgtgaagatactatgacctacaagtgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagccgggattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggataggggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgcgggagaagtcttggctggtgcataaacagtggtttctcgatctgccgcttccctggacttccggcgcctcaacaagccaagagacctggaatcgtcaggacctgttggtaacattcaagactgcacacgctaaaaagcaggaagttgtggtcctcggtagtcaagagggggccatgcacaccgctctgacgggcgccaccgaaatccagacatctggaactaccacaatttttgcaggccatttaaagtgccgcctgaaaatggataagctaactctcaaagggatgtcctatgtgatgtgtaccggtagcttcaagctggagaaagaagtcgccgagacgcagcacggaacagtgcttgttcagataaagtacgagggcaccgacgctccttgcaagatcccattctcgactcaagatgaaaaaggggtgacacagaacggaagattgattaccgcgaatcccatcgtaactgacaaggagaaacctgtcaacatagaagcagagccaccctttggcgagtcttatattgtgatcggtgccggggaaaaggctctgaaactctcctggttcaagaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagtacaagtattcgtggaaaagctggggcaaggccaagataatcggggcggacgtgcagaataccacatttattatcgatggaccaaacactcctgaatgtcccgacgatcagagggcctggaatatttgggaggtcgaggactacggcttcggtatctttaccacaaacatatggcttaaattgcgtgattcctatacacaggtgtgcgaccaccggctcatgtcagctgcaattaaggatagtaaagccgttcacgctgacatggggtactggatcgaatctgagaagaatgaaacctggaaactggcccgagcatccttcattgaggtgaagacttgtatctggccaaagtcccatacactatggtcaaacggagtactggaaagcgagatgataatccccaaaatttatggcggtcctatctctcaacacaattacagaccaggctacttcacccagactgcggggccgtggcatctcggaaagctggagcttgattttgacttgtgcgaaggcacaaccgtcgtggtggatgggcactgcggaaacaggggcccctccctgcgcacgactaccgtcacaggtaaaattatccacgagtggtgttgccggagttgtaccttacctccactcagattcagaggggaagacggatgctggtatggcatggagatacgccccgttaaggagaaagaagagaatctggtaaagagcatggtatctgccggttccggcgaagtggactcatttagtcttgggctgttgtgtattagcatcatgatcgaggaagtcatgcgatcgcggtggtcccgtaagatgctcatgactggcattctggctgtgttctttctactgatcatgggccagctcacatggaacgatctgattagactttgcataatggttggggccaatgcatctgacaggatgggaatgggcaccacatacttggctctgatggccactttcaaaatgcgccctatgtttgcagtgggtttactcttccggagactgaccagcagggaggtccttctgctaacgatcgggctctcactggtggccagtgttgagttgccaaactccctggaagagttaggagatggcctcgctatgggcattatgatcctgaaacttctgacagactttcaatctcatcagttgtgggcgaccctcctgagcctaactttcattaaaaccacattttccctgcactatgcctggaagactatggcaatggtgctttcaatcgtcagcctcttccccctgtgtttgagtaccacgtctcagaaaacaacctggctgccggtattactcgggtccctgggatgcaagcctcttactatgtttctgatagctgaaaataagatctggggtcgacgcagctggccattgaacgagggcattatggccgtggggatcgtttcgattctcctgtcatctctactgaaaaacgatgtgccccttgccggacctctcatcgctggcggtatgctgatagcatgttacgtcattagtgggtccagcgccgacttgtctttagaaaaggcggctgaggtgagctgggaggaagaggccgaacattccggagcatcacacaatatcctggtagaggtgcaggatgacggcacaatgaaaatcaaggatgaagaacgggacgataccctcactattctgcttaaagccacactgttggctgtcagtggcgtttatcccctaagcataccagcaaccctgttcgtgtggtacttctggcaaaagaaaaagcagagatctggggtgctctgggacacgccttcacccccagaggtcggaagggccgtgctggatgacggtatctatcgtattatgcagcgcggccttttagggcggagccaggttggagtaggcgtgtttcaagaaaacgtcttccatactatgtggcacgtgaccagaggtgcggttctgatgtaccaggggaagaggctcgagccgagttgggctagcgtgaaaaaggacttgatctcctacggaggcggctggcgactgcaggggtcttggaatacaggagaagaggtccaggtgattgccgtagagcctggtaaaaaccccaagaatgtccaaaccgcaccaggcacatttaaaactcccgaaggggaggtgggagccatcgctctcgatttcaagcctggcacctcgggtagcccaatagttaaccgggaagggaagatcgtgggactgtatggcaatggcgtcgtgacgacatcagggacttacgtttccgccattgcacaggctaaagccagtcaggagggaccccttcctgaaatcgaggacgaggtgtttcgcaagagaaacctgaccattatggatttgcacccgggttctggcaaaacaaggcggtatctaccagcgatcgtccgagaagccataaagagaaaactgcgcaccctcattttagcacccactagggtggtagctagcgagatggccgaagctctgaaggggatgcctatccgttaccaaaccacagcagtgaagtccgagcatacgggaaaagaaatcgttgaccttatgtgccacgccactttcaccatgcggctgctctcaccagtcagagtgcccaattataacatgattatcatggatgaggcccattttacagacccttctagcatagctgcgaggggctacattagtacccgcgtgggtatgggggaggcagccgctatcttcatgactgccacaccgcccggatccgtcgaagcatttccacagagcaatgccgtaattcaggatgaggaacgagacatccctgagagatcttggaactcaggctatgaatggataaccgatttccccggcaagacggtgtggtttgttccatccattaaaagtgggaatgacatcgctaactgtttgcggaagaatggaaaaagggtgatccagctgagccgcaagactttcgatacagagtaccaaaagaccaaaaacaacgactgggactacgtcgtgaccactgatatttcggagatgggtgcgaatttccgtgccgacagagttatcgatcctcggaggtgcctcaagcccgtgattctgaaagacggcccagaacgcgtcatacttgcagggccgatgcctgtgacagtagcttctgccgcacagcgaagaggacggatcggcaggaaccacaataaggagggtgatcagtatatttacatggggcagcccctaaacaatgacgaagatcatgcccactggaccgaggctaaaatgctgttggacaacatcaatacaccagagggcatcattcccgccttatttgaacctgagcgcgaaaagtccgcggcaatagatggagagtatagactgaggggcgaagcccggaagactttcgtggagctcatgcgtcgcggggacctgccagtttggcttagctacaaagtcgcttcagagggatttcaatatagtgatcgaagatggtgcttcgacggtgaaaggaacaatcaggtgctggaggaaaacatggatgtggagatctggacgaaggaaggcgagcggaaaaagctccgccccagatggttggacgccaggacctactctgaccctctggctctacgggagtttaaagagttcgcagccgggcgaagatccgtcagcggagatctgattctcgagatcggcaaacttccgcagcacctgacacagcgcgctcaaaatgccttagacaacttggttatgctgcataattcagaacagggtgggagggcatatcggcacgcgatggaggaactcccagatactattgagaccctgatgcttctggccctcatcgctgtgttgacaggcggagtaaccctgtttttcttaagtggccgtgggctaggaaaaactagcataggtctgctctgtgtgatggcctcctctgtccttctgtggatggcaagcgtggagccccattggatcgctgcctccattatcttggaatttttcctgatggttctcctgattcctgagcccgacagacagaggacgccacaggataaccaacttgcatacgtggtcatcggcctcctgtttatgatattgaccgtagccgctaatgaaatggggctgttagagacaactaagaaggacctaggaattggccacgtggcggttgagaaccaccatcacgccgcaatgctggatgtggacctccatcctgcttcagcctggaccctttacgccgtcgcaacaaccatcattactcccatgatgcgccacacaatcgaaaacacgaccgctaatatatctctgactgccatcgcgaaccaggctgccattttgatgggtctggataaagggtggccaatcagtaagatggacattggcgtgcctctcctggcacttggatgctattcgcaggtcaatccgttaacactgaccgccgctgtgctcatgttggttgcacattacgccatcataggccccgggctgcaagcgaaagctacccgggaggcccagaagcgaacagcagccggaattatgaaaaacccaactgtggatggcatcgtagctatcgacctagatcctgtggtctatgacgccaagttcgaaaagcagctgggtcagattatgctccttatcctgtgtacgagccaaatattgctgatgagaaccacatgggcactctgcgagtccattactctggctaccgggcccttaacaaccctttgggaaggatctccaggcaaattttggaatactacgatcgccgtttcaatggcgaacattttcaggggtagctacctggccggcgcagggctcgctttctccctaatgaagagtctgggaggcgggcgccggggaacaggcgcccagggtgagaccttgggggagaaatggaagagacagctgaatcagctctctaaaagcgaatttaacacttataagcgttcaggaatcatggaggtggacaggtccgaagcaaaggagggccttaaacggggtgaaaccacaaagcacgctgtcagtcgcggcactgccaaactgcgatggttcgtggagagaaatttggtaaagcctgaggggaaagtgatagatctgggatgtggcagagggggatggagctactattgcgccggcctcaagaaggttaccgaagtgaaaggttacacaaaagggggacccggccacgaggaaccgatcccaatggcgacgtacggctggaacttagtcaaactgcattctgggaaggacgtgtttttcattcctcccgagaaatgtgatacccttctgtgcgacatcggagaatcctcaccaaatcccactattgaggagggtcggacactacgcgtcctcaagatggtggaaccttggctgagaggcaaccaattttgtatcaaaattttgaatccgtatatgcccagcgttgtagagaccctggaacagatgcagaggaagcacgggggaatgctcgtgcgaaacccactttcgagaaattctactcatgagatgtactgggtcagttgcggcacaggtaacatcgtgtccgctgttaatatgaccagccgtatgctgttaaacagattcacgatggcacaccgcaagcctacctatgagagggatgtggacctgggggccggaacacggcacgtcgctgtggaacccgaggtagccaacttggatataattggccagagaatcgaaaatatcaaacatgagcacaagtcaacttggcattacgacgaagataacccttataaaacctgggcataccacggctcctatgaggtgaagccatctgggagcgccagttccatggttaatggagtcgtgaaactcctgacaaagccctgggacgtgattcctatggtcactcaaatagctatgaccgatacaaccccatttggtcagcagcgcgttttcaaggagaaagtggacactaggacgcccaaggcgaaacgaggcacagcccaaatcatggaagtaaccgcaaagtggctatgggggtttcttagccggaacaaaaagccgagaatttgtactagggaggagttcacccgcaaggtgcgttctaatgctgccatcggagcagtctttgtggacgagaaccagtggaactcagccaaagaagctgttgaggatgagcggttctgggacctggtgcatagagaaagggagctccacaagcagggcaaatgcgccacatgcgtctacaacatgatgggtaagcgcgagaagaagctgggggagtttggaaaggcgaaaggcagtcgagcaatttggtacatgtggttgggcgcccggttcctggagttcgaggctctcgggtttatgaatgaggatcactggttctccagagaaaacagcctttctggagtggagggtgaaggcctgcataagttagggtatatcctgagggacatatcgaatatccctggaggcaacatgtacgccgatgacacggcaggttgggatacccgcattactgaggacgatttgcagaatgaggctagaatcacagacattatggaaccagagcacgccctcctggctaaatcaatctttaagctaacctatcaaaacaaagtagttcgggtgcagaggcccgccaagaatgggactgtcatggatgtgataagccgtcgagaccagcgcggatccggccaggtgggcacatacgggcttaacaccttcacaaacatggaagcacaactgattagacagatggagagtgaaggaatcttttctcctagcgagctcgagactccaaatctggcggaacgggtcttggattggttagagaaatatggtgttgaaaggctgaagcgcatggccatctccggcgacgactgtgtggtaaagcccattgatgacagattcgctaccgccctcacggcacttaacgatatggggaaagtgcggaaggacataccgcagtgggagccttcaaaaggatggaatgattggcagcaagtccccttttgcagtcatcacttccaccagctgatcatgaaggacggcagggaaattgtggttccatgtcgaaaccaggatgagctagtgggtcgtgctagagtctctcagggggccggatggagcctgcgcgagaccgcatgcctcggcaaatcctacgcccaaatgtggcagttgatgtattttcatcggagggacctgagacttgcggctaatgccatctgttcagcagtgcctgtagattggattcccacaagccgcactacctggtctatccacgcccatcaccagtggatgacaactgaagacatgctgtccgtttggaaccgggtgtggatagaggaaaatccatggatggaggataagacccatatcagtagctggggcgacgtcccctacctcgggaagagggaagaccaatggtgcggatcgttaattggtctgacggctcgagccacatgggcaaccaacatccaggtggctattaatcaggttagacggttgatcggcaacgagaattacctggattatatgacttccatgaaaaggttcaagaacgagtctgaccctgaaggggccctctggtga

SEQ ID NO: 14054 - RNA, 9879 nt, synthetic construct
  misc_feature 1..9879: note = derived and/or modified CDS sequence (opt3) from DENV-1__EU482521__SS-prME
  source 1..9879: mol_type = other RNA
tccgtgaccatgctgctcatgcttatgcccacagcactggctttccacttgactacgagaggcggggagcctcatatgatcgtctccaagcaggaaaggggaaagtctttactgtttaagacctcagccggtgttaatatgtgcacactgattgcaatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggtagcttcaaactggagaaggaagtggctgagacccagcacggaacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaagaatgtttgaggcaactgccaggggcgctcggcgaatggccatcctgggggataccgcatgggacttcggaagcattggtggcgtgtttacatccgttgggaaacttgtgcatcagatattcggaacggcgtacggcgtcctgttttctggtgtgagctggaccatgaaaatcgggattggcgtattgctcacttggctgggattaaattcacgcagtacatccttcagcatgacctgtatcgctgtgggcctggttacactatacctcggggtcatggtgcaggccgattctggatgcgtgatcaactggaagggcagagaactgaaatgtggttcagggatttttgtcactaatgaggttcacacctggacggaacaatataagttccaggcagacagtccgaagaggcttagcgccgctataggaaaagcctgggaggagggcgtgtgcggtatccggtccgcaacacgcttggaaaacattatgtggaagcagatctctaacgagctgaatcatattctcctggaaaacgacatgaaatttaccgtggtagtcggcgatgtggctgggatcttagcccagggaaagaaaatgataagacctcaacccatggagtacaagtattcgtggaggagctggggcaaagcgaagatcattggggccgacgttcagaatactaccttcatcattgatggaccaaacacacctgaatgtcccgacgatcagcgtgcttggaatatctgggaggtggaggactacggctttggtatattcactaccaacatttggctgaaacttcgggattcctatacacaggtctgcgaccaccgattgatgtcagcagccatcaaagatagtaaggctgtgcacgccgacatggggtactggattgaatctgagaaaaatgaaacgtggaagctcgcaagagcgagcttcatcgaggttaaaacctgtatatggccaaagtcccatactctgtggtcaaacggagtgctagaaagcgagatgatcattcccaagatctatggcggtcctatttctcaacacaattacaggccaggctactttacacagaccgccgggccgtggcatctgggaaaactcgagctggatttcgacctttgcgaaggcactacagtagtcgtggatgagcactgcgggaaccgcggaccctccttgcggaccacgactgtgaccggcaagatcatacacgaatggtgttgcagaagttgtacactgcctccattaaggtttcgcggtgaggacgggtgctggtatggaatggagattcgacccgtcaaagaaaaggaggaaaatctcgttaaaagcatggtgtctgctggctccggtgaggtagactcattcagtctgggccttctgtgtatcagcatcatgattgaagaggtgatgcggtcgcgttggtccagaaagatgttgatgaccgggactctcgccgtctttctgctactgatcatgggacagctcacatggaacgatctgattaggctttgcataatggtgggcgcaaatgcttctgaccgcatggggatgggaaccacatacttggccctgatggcaactttcaagatgcggcctatgtttgccgttggcttactcttcagaaggctgaccagccgagaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaagaccacattttccctgcactatgcatggaaaactatggctatggttctttcaatcgtgagcctcttccccctgtgtttgagtaccacgtctcagaagacaacctggctgccggtcttactcggctccctggggtgcaaacctcttactatgtttctgatagccgagaataagatctggggacgccggagctggccattgaacgaaggtattatggccgtaggcatcgtgtcgattctcctgtcatctctactgaagaacgatgttccccttgctgggcctctcatcgcaggaggcatgctgatagcctgttacgtgattagtggttccagcgcggacttgtctttagagaaagctgccgaggtcagctgggaagaggaagcagagcattccggggcctcacacaatatcctggtggaagtacaggatgacggaacaatgaagatcaaagatgaggagagagacgataccctcactattctgcttaaggctacactgttggcagtgagtggcgtctatcccctaagcataccagccaccctgttcgtttggtacatctggcagaagaagaaacagaggtctggcgtgctctgggacacgccttcacccccagaagtggagcgtgcggtcctggatgacgggatttatcgcatcatgcagcggggacttttaggtagaagccaggtgggcgttggggtattccaagaaaacgtgtttcatactatgtggcacgtcaccaggggagctgtgctgatgtaccagggcaagcgactcgagccgagttgggccagcgttaagaaagacttgatttcctacggtgggggatggcggctgcagggctcttggaatacaggcgaggaagtgcaggtcatcgcagtggagcctgggaagaaccccaaaaatgtacaaaccgccccaggaacattcaagactcccgaaggtgaggtcggcgctatagccctcgattttaaacctgggacctcgggaagcccaatcgtgaaccgcgaaggcaagattgttggtctgtatgggaatggagtggtcacgacatcaggcacttacgtgtccgcaatcgctcaggccaaggcgagtcaggagggcccccttcctgagattgaagacgaggttttcagaaaaaggaacctgaccatcatggatttgcacccggggtctggaaagacacggcgatatctaccagccatagtgagagaagcaattaaacgcaagctgaggaccctcatcttagctcccactcgtgtcgtggccagcgagatggctgaagcactgaaaggtatgcctatccggtaccaaaccacagccgtaaagtccgagcatacgggcaaggagattgtggaccttatgtgccacgccacttttaccatgagactgctctcaccagttagggtccccaattataacatgatcataatggatgaagctcatttcacagacccttctagcattgcggcacgcgggtacatcagtacccgagtgggaatgggcgaggccgctgccatttttatgactgcaacaccgcccggttccgtggaagccttcccacagagcaatgctgtcatccaggatgaggaaagagacatacctgagcggtcttggaactcagggtatgagtggattaccgattttcccggaaaaacggtatggttcgtgccatccatcaagagtggcaatgacatcgcgaactgtttgaggaaaaatggcaagcgcgttattcagctgagccgtaaaacttttgatacagaataccaaaagaccaagaacaacgactgggactacgtggtcaccactgatatctcggagatgggggccaatttcagagcagaccgggtgattgatcctaggcgctgcctcaaacccgttatactgaaggacggaccagaacgagtgatccttgctggtccgatgcctgtcacagtggcctctgcagcccagagacggggcaggattgggcgcaaccacaataaagagggagatcagtatatctacatgggccagcccctaaacaatgacgaggatcatgctcactggaccgaagccaagatgctgttggacaacatcaatacaccagagggtattatacccgcgttattcgaacctgagagagaaaaatccgcagccatcgatggggagtataggctgcggggcgaggctcgtaagacttttgtagaactcatgcgccgaggagacctgccagtgtggcttagctacaaggttgcctcagagggcttccaatatagtgatagaaggtggtgctttgacggggaacggaacaatcaggtcctggaggaaaacatggatgtggagatttggacgaaagagggagaacgcaagaaactcagacccaggtggttggacgctcggacctactctgaccctctggcactacgagagttcaaggaatttgccgctggtagacgctccgtgagcggcgatctgatcctcgagattgggaaacttccgcagcacctgacacagagggcccaaaatgcattagacaacttggtcatgctgcataattcagaacagggaggccgggcgtatcgtcacgccatggaggagctcccagatactatcgaaaccctgatgcttctggctctcatagccgttttgacaggtggggtgaccctgttctttttaagtggcagaggactaggcaagactagcatcgggctgctctgtgtaatggcatcctctgtgcttctgtggatggctagcgtcgagccccattggattgccgcatccatcattttggagttctttctgatggtgctcctgatccctgagcccgacaggcagcgcacgccacaggataaccaacttgcctacgttgtgataggactcctgttcatgattttgaccgtcgctgcgaatgagatgggtctgttagaaacaactaaaaaggacctaggcatcgggcacgtagccgtgggaaaccaccatcacgcagctatgctggatgttgacctccatcctgcctcagcctggaccctttacgcagtggctacaaccattatcactcccatgatgcggcacacaatagagaacacgaccgccaatatctctctgactgcgattgctaaccaggccgcaatcttgatgggcctggataagggttggccaattagtaaaatggacatcggggtccctctcctggcccttggctgctattcgcaagtgaatccgttaacactgaccgctgcagtcctcatgttggtggcccattacgcgataattggacccggcctgcaagctaaggccacccgagaagcacagaaaagaacagccgctgggatcatgaagaacccaactgttgatggaatcgtggccattgacctagatcctgtagtgtatgacgcaaaatttgagaagcagctgggccagatcatgctccttatactgtgtacgagccaaattttgctgatgaggaccacatgggctctctgcgaatccatcactctggccaccggtcccttaacaaccctttgggaggggtctccaggaaagttctggaatactacgattgcggtctcaatggccaacatctttcgcggcagctacctggccggtgctggcctcgccttctccctaatgaaaagtctagggggaggccggagagggacaggagcacagggcgagaccttgggtgaaaagtggaaacgtcagctgaatcagctctctaagagcgagttcaacacttataaaaggtcagggataatggaagttgaccggtccgaggctaaggaaggacttaagcgcggcgagatcaccaaacacgccgtgagtcgaggtacagccaagctgagatggtttgtcgagaggaatttggtgaaacctgaaggcaaggtaattgatctggggtgtggacggggcgggtggagctactattgcgcgggactcaaaaaggtgactgaggttaagggctacaccaaaggtgggcccggacacgaagaaccgatcccaatggctacatacggctggaacttagtgaagctgcattctggcaaagacgtcttctttgtgcctcccgaaaagtgtgatacgcttctgtgcgacattggggagtcctcaccaaatcccaccatcgaggaaggacgcactctaagagtcctcaaaatggtggagccttggctgaggggtaaccaattctgtattaagatcttgaatccgtatatgcccagcgttgtagaaacactggagcagatgcagcgaaaacacggcgggatgctcgtgcggaacccactttcgcgtaattctacccatgagatgtactgggtcagttgcggaactggcaacatagtgtccgcagttaatatgacaagcagaatgctgttaaaccgctttaccatggcccacaggaagcctacgtatgaacgggatgtggacctgggtgctgggaccagacacgtcgccgtggagcccgaagtagcaaacttggatattatcggacagcgcatcgagaatattaagcatgaacacaaatcaacatggcattacgacgaggataacccttataagacttgggcctaccacggctcctatgaggtgaaaccatctggcagcgctagttccatggttaatggggtcgtgaagctcctgaccaaaccctgggacgtgatacctatggtcacacaaatcgcgatgactgataccacaccattcggacagcagagggtttttaaggaaaaggtggacacccgaactcccaaagccaagcggggtacggcacaaattatggaggtaacagctaaatggctatggggcttccttagcagaaacaagaaaccgaggatctgtacccgcgaagagtttactcgtaaggtgcggtctaatgccgcaattggggccgtcttcgtggacgaaaaccagtggaactcagctaaggaggccgttgaggatgaaagattttgggacctggtgcatagggagcgcgaactccacaaacagggaaagtgcgcgacctgcgtctacaacatgatgggcaaacgagagaagaaactgggtgagttcgggaaggcaaagggaagtcgggccatctggtacatgtggttgggcgctagatttctggagttcgaggccctcggcttcatgaatgaagatcactggttttccagggagaacagcctttctggggtggaaggagagggtctgcataaattaggctatatactgcgcgacatctcgaagattcctgggggaaatatgtacgcagatgacacagctggctgggatacgagaatcaccgaggacgatttgcagaacgaagcccggattactgacatcatggagccagaacacgctctcctggccaaatcaatattcaagctaacatatcaaaataaagtagttagggtgcagcgtcccgcaaagaacggtaccgtcatggatgtgattagccgacgcgaccagagagggtccggacaggtgggcacttacggccttaatacatttaccaacatggaggcgcaactgatccggcagatggaaagtgaggggatcttctctcctagcgagctcgaaacaccaaacctggccgagagggtcttggattggttagaaaaatatggagttgagcgcctgaagagaatggctatttccggtgacgactgtgtggtaaagcccatagatgaccggtttgccactgcactcaccgctcttaatgatatgggcaaagtgaggaaggacatcccgcagtgggaaccttcaaaagggtggaacgattggcagcaagtccccttctgcagtcatcactttcaccagctgattatgaaggacggacgagagatcgtggttccatgtcgtaatcaggatgagctagtgggcagagcccgcgtctctcagggtgcagggtggagcctgcgggaaacggcctgcctcggaaaatcctacgcgcaaatgtggcagttgatgtatttccataggagagacctgcgccttgctgccaacgcaatttgttcagccgtgcctgtagattggatccccaccagccggacaacttggtctatacacgctcatcaccagtggatgaccacagaggacatgctgtccgtttggaatagggtgtggatcgaagagaacccatggatggaagataagactcatattagtagctggggcgacgtcccctacctcggcaagcgagaggaccaatggtgcgggtcgttaatcggactgaccgccagagcaacgtgggctacaaatattcaggtggccatcaaccaggttcggaggttgattggtaatgagaactacctggattatatgacctccatgaaacgctttaagaatgaatctgaccctgagggcgcgctctggtga

SEQ ID NO: 14055 - RNA, 9879 nt, synthetic construct
  misc_feature 1..9879: note = derived and/or modified CDS sequence (opt3) from DENV-1__EU482523__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacgctaattgccatggacctcggcgaactgtgtgaagatactatgacctacaaatgcccacggattacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagacccttctagcatcgcggcaagggggtacataagtacccgcgtgggaatgggcgaggccgctgccattttcatgactgcaacaccgcccggttccgtcgaagcctttccacagagcaatgctgtaatccaggatgaggaacgagacattcctgagagatcttggaactcagggtatgagtggatcaccgatttccccggaaagacggtgtggtttgttccatccataaaaagtggcaatgacattgcgaactgtttgcggaagaatggcaaaagggtgatccagctgagccgcaagactttcgatacagaataccaaaagaccaaaaacaacgactgggactacgtcgtgaccactgatatctcggagatgggggccaatttccgtgcagacagagttattgatcctcggaggtgcctcaagcccgtgatcctgaaagacggaccagaacgcgtcattcttgctggtccgatgcctgtgacagtagcctctgcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttatttgaacctgagcgcgaaaagtccgcagccattgatggggagtatagactgaggggcgaggctcggaagactttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatatggacgaaggagggagaacggaaaaagctccgccccagatggttggacgctaggacctactctgaccctctggcactacgggagtttaaagagttcgccgctggtcgaagatccgtcagcggcgatctgatcctcgagattgggaaacttccgcagcacctgacacagcgcgcccaaaatgcattagacaacttggttatgctgcataattcagaacagggaggcagggcgtatcggcacgccatggaggagctcccagatactatcgaaaccctgatgcttctggctctcattgccgtgttgacaggtggggtaaccctgtttttcttaagtggccgtggactaggcaaaactagcatcgggctgctctgtgtgatggcatcctctgtccttctgtggatggctagcgtggagccccattggatagccgcatccatcattttggaatttttcctgatggttctcctgatccctgagcccgacagacagaggacgccacaggataaccaacttgcctacgtggtcattggactcctgtttatgatcttgaccgtagctgcgaatgagatgggtctgttagaaacaactaagaaggacctaggcatagggcacgtggccgttgagaaccaccatcacgcagctatgctggatgtggacctccatcctgcctcagcctggaccctttacgcagtcgctacaaccattatcactcccatgatgcgccacacaattgaaaacacgaccgccaatatctctctgactgcgatagctaaccaggccgcaatcttgatgggactggataaaggctggccaattagtaagatggacatcggtgtgcctctcctggcccttgggtgctattcgcaggtcaatccgttaacactgaccgctgcagtgctcatgttggttgcccattacgcgattatcggccccggactgcaagctaaagccacccgggaggcacagaagcgaacagccgctggcataatgaaaaacccaactgtggatgggattgtagccatcgacctagatcctgtggtctatgacgcaaagttcgaaaagcagctgggacagatcatgctccttattctgtgtacgagccaaatcttgctgatgagaaccacatgggctctctgcgagtccataactctggccaccggccccttaacaaccctttgggagggttctccagggaaattttggaatactacgattgcggtttcaatggccaacatcttcaggggaagctacctggcaggcgctggtctcgccttctccctaatgaagagtctgggcgggggacgccggggcacaggggcacagggagaaaccttgggcgagaaatggaagagacagctgaatcagctctctaaaagcgaatttaacacttataagcgttcaggtattatggaggtggacaggtccgaagctaaggaggggcttaaacggggagagaccacaaagcacgccgtcagtcgcggcactgccaaactgcgatggttcgtggaaagaaatttggtaaagcctgagggtaaagtgatcgatctgggctgtgggaggggaggctggagctactattgcgcggggctcaagaaggttaccgaagtgaaaggatacacaaagggcggtcccgggcacgaggaaccgataccaatggctacgtacggatggaacttagtcaaactgcattctggcaaggacgtgtttttcatccctcccgagaaatgtgatacccttctgtgcgacattggcgagtcctcaccaaatcccactatcgaagaggggcggacactacgcgtcctcaagatggtggaaccttggctgagaggaaaccaattttgtattaaaatcttgaatccgtatatgcccagcgttgtagagaccctggagcagatgcagaggaagcacggtggcatgctcgtgcgaaacccactttcgagaaattctactcatgaaatgtactgggtcagttgcgggacaggaaacattgtgtccgcagttaatatgaccagccgtatgctgttaaacagattcacgatggcccaccgcaagcctacctatgagagggatgtggacctgggcgctggtacacggcacgtcgccgtggaacccgaggtagcaaacttggatatcatagggcagagaattgaaaatatcaaacatgagcacaagtcaacttggcattacgacgaggataacccttataaaacctgggcctaccacggatcctatgaagtgaagccatctggcagcgctagttccatggttaatggcgtcgtgaaactcctgacaaagccctgggacgtgatccctatggtcactcaaattgcgatgaccgatacaaccccatttgggcagcagcgcgttttcaaggagaaagtggacactaggacgcccaaggccaaacgaggaacagcacaaataatggaagtaaccgctaagtggctatggggttttcttagccggaacaaaaagccgagaatctgtactagggaggagttcacccgcaaggtgcgttctaatgccgcaattggcgccgtctttgtggacgagaaccagtggaactcagctaaagaggccgttgaagatgagcggttctgggacctggtgcatagagaaagggagctccacaagcaggggaaatgcgcgacatgcgtctacaacatgatgggaaagcgcgagaagaagctgggcgagtttggtaaggcaaaagggagtcgagccatctggtacatgtggttgggagctcggttcctggagttcgaagccctcggctttatgaatgaggatcactggttctccagagaaaacagcctttctggcgtggagggggagggactgcataagttaggttatattctgagggacatctcgaaaatacctggcgggaatatgtacgcagatgacacggctggatgggatacccgcatcactgaagacgatttgcagaacgaggccagaattacagacatcatggaaccagagcacgctctcctggccaagtcaatttttaaactaacctatcaaaataaggtagttcgggtgcagaggcccgccaaaaatggcactgtcatggatgtgatcagccgtcgagaccagcgcggttccggacaggtgggaacatacggccttaataccttcacaaacatggaagcgcaactgataagacagatggagagtgagggcatattttctcctagcgaactcgagactccaaacctggccgaacgggtcttggattggttagagaagtatggggttgaaaggctgaagcgcatggctatctccggagacgactgtgtggtaaaacccatcgatgacagattcgccaccgcactcacggctcttaatgatatgggtaaggtgcggaaagacattccgcagtgggagccttcaaagggctggaacgattggcagcaagtccccttttgcagtcatcacttccaccagctgataatgaaagacgggagggagatcgtggttccatgtcgaaatcaggatgagctagtgggacgtgccagagtctctcagggcgcaggttggagcctgcgcgagaccgcctgcctcgggaagtcctacgcgcaaatgtggcagttgatgtattttcatcggagggacctgagacttgctgccaacgcaatttgttcagccgtgcctgtagattggatccccacaagccgcactacctggtctattcacgctcatcaccagtggatgacaactgaagacatgctgtccgtttggaatcgggtgtggatcgaggaaaacccatggatggaggataagacccatataagtagctggggagacgtcccctacctcggcaaaagggaggaccaatggtgcggctcgttaatcgggctgacggcccgagcaacatgggctaccaatattcaggtggccatcaaccaggttagacggttgattggaaatgaaaactacctggattatatgacttccatgaagaggttcaaaaatgagtctgaccctgaaggtgcgctctggtga

SEQ ID NO: 14056 - RNA, 9879 nt, synthetic construct
  misc_feature 1..9879: note = derived and/or modified CDS sequence (opt3) from DENV-1__EU482525__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacactaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccttcagcatgacctgtattgctgttggcctggtcacactatacctcggggtgatggtgcaggccgattctggatgcgtcatcaactggaaaggccgcgaactgaagtgtggttcagggatctttgttactaatgaggtgcacacctggacggaacaatataagttccaggcagacagtccgaaaagacttagcgccgctattggaaaggcctgggaggagggcgtgtgcggtataaggtccgcaacacggttggaaaacatcatgtggaaacagatttctaacgagctgaatcatatcctcctggaaaacgacatgaagttaaccgtagtcgtgggcgatgttgctgggattctgggacagggcaaaaagatgatccgccctcaacccatggagtacaaatattcgtggaaaagctgggggaaggccaagataatcggagcggacgcccagaatactacctttattatcgatggcccaaacacacctgaatgtcccgacgatcagagagcttggaatatttgggaggtggaggactacggtttcgggatctttactaccaacatatggcttaagttgagggattcctatacacaggtctgcgaccaccgtctcatgtcagcagccattaaagatagtaaggctgtgcacgccgacatgggatactggatcgaatctgagaaaaatgaaacgtggaagctggcacgggcgagcttcattgaggttaagacctgtatctggccaaaatcccatactctatggtcaaacggcgtgctggaaagcgagatgataatccccaagatttatggtggccctatctctcaacacaattaccgaccagggtacttcacacagaccgccggaccgtggcatctcggcaaactggagcttgattttgacttgtgcgaagggactacagtagtcgtggatgagcactgcggaaacagaggcccctccctgaggaccacgactgtgaccggtaagattatccacgaatggtgttgccgcagttgtacattacctccactccggttcagaggggaggacggatgctggtatggcatggagataaggcccgtcaaagaaaaggaggaaaatctggttaagagcatggtgtctgctggttccggcgaggtagactcatttagtcttgggctgttgtgtattagcatcatgatcgaagaggtgatgcgctcgcgatggtcccggaaaatgctcatgaccggaactctggccgtcttctttctactgattatgggccagctcacatggaacgatctgatccgtctttgcattatggtgggggcaaatgcttctgacagaatgggaatgggcaccacatacttggccctgatggcaactttcaagatgaggcctatgtttgccgttggtttactcttccgccggctgaccagcagagaggtgcttctgctaacgatagggctctcactggtcgctagtgtggaattgccaaactccctggaggaattaggagatggcctcgcgatgggcatcatgattctgaaacttctgacagactttcaatctcatcagttgtgggccaccctcctgagcctaactttcatcaagaccacattttccctgcactatgcatggaaaactatggctatggttctttcaattgtgagcctcttccccctgtgtttgagtaccacgtctcagaagacaacctggctgccggtcttactcgggtccctgggatgcaagcctcttactatgtttctgatcgccgagaataaaatatggggtaggaagtcctggccattgaacgaaggcatcatggccgtagggattgtgtcgatcctcctgtcatctctactgaaaaacgatgttccccttgctggacctctcattgcaggcggtatgctgatcgcctgttacgtgataagtgggtccagcgcggacttgtctttagagaaggctgccgaggtcagctgggaagaggaagcagagcattccggagcctcacacaatattctggtggaagtacaggatgacggcacaatgaaaatcaaggatgaggagcgagacgataccctcactatcctgcttaaagctacactgttggcagtgagtggcgtctatcccctaagcattccagccaccctgttcgtttggtacttctggcaaaagaagaaacagcgctctggggtgctctgggacacgccttcacccccagaagtggagcgggcggtcctggatgacggaatatatagaatcatgcagaggggtcttttaggccgtagccaggtgggggttggagtatttcaagaaaacgtgttccatactatgtggcacgtcacccgcggcgctgtgctgatgtaccagggtaagcggctcgagccgagttgggccagcgttaaaaaggacttgatttcctacgggggaggctggagactgaggggctcttggaatacaggggaggaagtgcaggtcatcgcagtggagcctggcaagaatcccaagaatgtacagaccgccccaggtacatttaagactcccgaaggcgaggtcggggctattgccctcgatttcaaacctggaacctcgggcagcccaatcgtgaaccgagaaggtaagatagttgggctgtatggaaatggcgtggtcacgacatcaggcacttacgtgtccgcaatcgctcaagccaaagcgagtcaggaggggccccttcctgagattgaagacgaggtttttcggaagcgcaacctgaccatcatggatttgcacccgggatctggtaaaacaagaaggtatctaccagccattgtgcgggaagcaatcaagcgaaagctgagaaccctcatattagctcccactcgcgtcgtggccagcgagatggctgaagcactgaaaggcatgcctattaggtaccagaccacagccgtaaagtccgagcatacggggaaagagatcgtggaccttatgtgccacgccactttcaccatgcgtctgctctcaccagttcgggtccccaattataacatgatcattatggatgaagctcattttacagacccttctagcatcgcggcaagaggatacataagtaccagggtgggcatgggtgaggccgctgccattttcatgactgcaacaccgcccgggtccgtggaagcctttccacaaagcaatgctgtcatccaggatgaggaacgcgacattcctgagcgatcttggaactcaggatatgagtggatcaccgatttccccggcaagacggtatggtttgtgccatccataaaaagtggcaatgacattgcgaactgtttgagaaagaatgggaagcgggttatccagctgagcaggaaaactttcgatacagaataccagaagaccaaaaacaacgactgggactacgtggtcaccactgatatctcggagatgggagccaatttccgcgcagaccgtgtgattgatcctagacggtgcctcaagcccgttatcctgaaagacggtccagaaagggtgattcttgctggcccgatgcctgtcacagtggcctctgcagcccaacgccgagggagaataggacggaaccacaataaggagggcgatcagtatatctacatgggtcagcccctaaacaatgacgaggatcatgctcactggaccgaagccaagatgctgttggacaacattaatacaccagaggggatcatccccgcgttatttgaacctgagagggaaaaatccgcagccgtagatggcgagtatcgcctgagaggagaggctaggaagactttcgtggaactcatgcggcgtggcgacctgccagtttggcttagctacaaagtcgcctcagaggggtttcagtatagtgatcgccgatggtgcttcgacggagaaagaaacaatcaagtgctggaggaaaacatggatgtggagatttggacgaaggagggtgaaaggaaaaagctccggccccgctggttggacgctagaacctactctgaccctctggcactaagggagtttaaagagttcgccgctggccggcgatccgtcagcggggatctgatactcgagatcggaaaacttccgcagcacctgacacagagagcccagaatgcattagacaacttggttatgctgcataattcagaacaaggcggtcgcgcgtataggcacgccatggaggagctcccagatactattgaaaccctgatgcttctggctctcatcgccgtgttgacagggggcgtaaccctgtttttcttaagtggacggggcctagggaagactagcattggactgctctgtgtgatggcatcctctgtccttctgtggatggctagcgtggagccccattggatcgccgcatccataatcttggaatttttcctgatggttctcctgattcctgagcccgaccgtcagagaacgccacaggataaccagcttgcctacgtggtcatcggtctcctgtttatgattttgaccgtagctgcgaatgagatgggcctgttagaaacaactaaaaaggacctagggatcggacacgtggccgttgagaaccaccatcacgcagctatgctggatgtggacctccatcctgcctcagcctggaccctttacgcagtcgctacaaccataattactcccatgatgaggcacacaatcgaaaacacgaccgccaatatttctctgactgcgatcgctaaccaagccgcaatattgatgggcctggataaaggttggccaatcagtaagatggacattggggtgcctctcctggcccttggctgctattcgcaggtcaatccgttaacactgaccgctgcagtgctcatgttggttgcccattacgcgatcattggacccggcctgcaggctaaagccacccgcgaggcacaaaagcggacagccgctgggatcatgaagaacccaactgtggatggaatagtagccattgacctagatcctgtggtctatgacgcaaaattcgaaaagcagctgggccagatcatgctccttatcctgtgtacgagccagattttgctgatgcgaaccacatgggctctctgcgagtccatcactctggccaccggtcccttaacaaccctttgggaggggtctccaggaaaattttggaatactacgatagcggtttcaatggccaacattttcagaggcagctacctggcaggagctggcctcgccttctccctaatgaagagtctagggggaggcaggcgcgggacaggagcacaaggcgaaaccttgggtgagaaatggaagcggcagctgaatcagctctctaagagcgaatttaacacttataaaagatcagggatcatggaggtggaccgttccgaagctaaggagggacttaaaaggggcgagaccacaaagcacgccgtcagtcggggtactgccaaactgcgctggttcgtggaacgaaatttggtaaagcctgagggcaaggtgattgatctggggtgtggaagaggcgggtggagctactattgcgcgggactcaaaaaggttaccgaagtgaaaggctacacaaagggtgggcccggacacgaggaaccgatcccaatggctacgtacggctggaacttagtcaaactgcattctggcaaggacgtgtttttcatacctcccgagaaatgtgatacccttctgtgcgacatcggggagtcctcaccaaatcccactattgaagagggaaggacactacgggtcctcaagatggtggaaccttggctgcgcggtaaccagttttgtatcaagattttgaatccgtatatgcccagcgttgtagagaccctggagcaaatgcagagaaaacacggcgggatgctcgtgaggaacccactttcgcgaaattctactcatgaaatgtactgggtcagttgcggaacaggcaacatcgtgtccgcagttaatatgaccagccggatgctgttaaaccgtttcacgatggcccacagaaagcctacctatgagcgcgatgtggacctgggtacagggactaggcacgtcgctgtggaacccgaggtagccaacttggatattatcggacagcggatagaaaatattaaacatgagcacaagtcaacctggcattacgacgaggataacccttataaaacatgggcataccacggctcctatgaagtgaagccatctggcagcgccagttccatggttaatggggtcgtgaagctcctgactaaaccctgggacgtgatccctatggtcacccagatcgctatgacagataccactccatttggacaacagagagttttcaaggagaaagtggacacgcgcacacccaaggcgaaaaggggtaccgcccagattatggaagtaactgcacgatggctatggggctttcttagccggaacaagaagccgagaatatgtaccagggaggagttcacacgcaaagtgcgttctaatgctgccatcggggcagtctttgtggacgagaaccaatggaactcagccaaggaggctgttgaagatgagcggttctgggacctggtgcatagagaaagggagctccacaaacagggaaagtgcgccacgtgcgtctacaacatgatgggcaaacgcgaaaagaagctgggtgagtttgggaaagcgaagggaagtcgagcaatttggtacatgtggttgggcgcccggttcctggagttcgaagctctcggctttatgaatgaggatcactggttctccagagaaaacagcctttctggggtggagggagagggtctgcataaattaggctatatcctgagggacatttcgaagatccctgggggaaatatgtacgccgatgacaccgcaggctgggatactcgcataacagaagacgatttgcagaacgaggctaaaatcaccgacattatggaaccagagcacgccctcctggctaaggccatctttaaactaacttatcagaataaggtagttagagtgcaacggcccgcaaagaacggtacagtcatggatgtgatttcaaggcgtgaccagcgagggagcggacaggtgggcacctacggccttaatacattcactaacatggaagcgcagctgatccgccaaatggagtccgaggggatatttagtccttctgaactcgagaccccaaacctggccgaaagagctttggattggttagagaaatatggaattgaacggctgaagaggatggccatcagcggtgacgactgtgtcgttaaacccatcgatgaccgcttcgcaacggctctcaccgcccttaatgatatgggcaaggtgagaaaagacattccgcagtgggagccttccaaggggtggaacgattggcagcaggtacccttttgctcacatcacttccaccaactgataatgaaggacggacgggagatcgtggtcccatgtaggaatcaggatgagctggtgggccgagcacgtgttagtcagggtgccgggtggtctctgagagagacagcgtgcctcggaaaaagctacgctcagatgtggcaattgatgtattttcatcgccgggacctgaggcttgccgcaaacgccatttgttccgctgtgcctgtcgattgggtgcccacttcaagaaccacatggagcatccacgcccatcaccagtggatgactaccgaagacatgctgtctgtatggaatcgcgtttggattgaggaaaacccatggatggaggataagacgcatatctccagttgggaggacgtgccctacctcggcaaacgggaagaccagtggtgcggcagcttaatagggctgacagcaagggctacctgggccactaatatccaagtcgcgattaaccaggtgcgaagattgatcggaaatgagaactacctggattatatgacatcgatgaagcggttcaaaaatgaaaccgaccctgagggtgctctctggtga

SEQ ID NO: 14057 - RNA, 9879 nt, synthetic construct
  misc_feature 1..9879: note = derived and/or modified CDS sequence (opt3) from DENV-1__EU482526__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaaaaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctactgctcattatgggacagctgacatggaacgatcttatccggttgtgcattatggttggcgccaatgcatctgaccgtatggggatgggaaccacatatctggctttaatggccacttttaaaatgagacctatgttcgcagtgggcctcctgtttaggcgccttaccagccgggaggtcctgctactcacgataggtctgtcattggtggccagtgttgaactgccaaactccttagaggaactcggggatggactggctatgggcatcatgattcttaagctgttgacagacttccaatctcaccagctctgggcgaccctgctaagcctgacttttatcaaaaccacactttccctccattacgcctggaagactatggcaatggtgctgtcaattgtcagcttgttccccctgtgtttaagtaccacgtctcagaagacaacctggctcccggtactgcttggctccctggggtgcaaacctttgactatgtttctcatcgctgagaataagatatggggaagaaaaagctggccactgaacgaaggtatcatggccgtgggcgttgtgtcgattctactgtcatctcttctcaagaacgatgtccccctggccgggcctttgatcgctggaggcatgttaattgcatgttatgtgatcagtggttccagcgccgacctgtctctcgagaaagcggctgaggtaagctgggaagaggaagccgagcactccggggcatcacataatatactggtggaagtccaggatgacggaacaatgaagattaaagatgaggagagggacgatacccttactatcctgttgaaggccacactactggctgttagtggcgtgtaccccctcagcatcccagcaaccctgttcgtgtggtatttttggcaaaagaaaaagcagcgatctggcgtcctttgggacacgccttcacccccagaagtggagcgcgccgttttagatgacgggatttaccggataatgcagagaggactgctcggtaggagccaggtaggcgtgggggtcttccaagaaaacgtgttccacactatgtggcacgttacccgtggagcggtgttgatgtatcagggcaaacgcctggagccgagttgggctagcgtcaagaaagacctcatctcctacggtgggggatggcggctgcagggctcttggaatacaggcgaggaagtgcaggtaattgccgtcgagcctgggaagaaccccaagaatgtgcaaaccgcaccaggaacatttaaaactcccgaaggtgaggttggcgccatcgctcttgatttcaagcctgggacctcgggaagcccaattgtgaacagagaaggcaaaatcgtcggtctgtacgggaatggagtggttacgacatcaggcacttatgtgtccgccatagcacaggctaaggccagtcaggagggccccttgcctgagatcgaagacgaggtctttaggaaacgaaacctaaccattatggatctgcatccggggtctggaaagacacggcgctacctcccagcgatcgtgagagaagccattaagaggaaattacggaccctgatccttgcacccactcgagtagtggctagcgagatggccgaagctctgaagggtatgcctataagatatcaaaccacagcagttaaatccgagcacacgggcaaggagattgtcgacctcatgtgccatgccactttcaccatgcgcttgctgtcaccagtgagggtgcccaattacaacatgatcatcatggatgaagcccactttacagacccttctagcattgctgcgcgtgggtatatcagtacccgggtcggaatgggcgaggcagccgctatattcatgactgccacaccgcccggttccgtagaagcatttccacagagcaatgccgtgattcaggatgaggaaagagacatccctgagaggtcttggaactcagggtacgagtggattaccgatttccccggaaaaacggtttggtttgtgccatccatcaagagtggcaatgacatagctaactgtctccgcaagaatggcaaacgagtcattcagctgagcagaaagactttcgatacagaatatcagaaaaccaagaacaacgactgggactacgtggttaccactgatatctcggagatgggggcgaattttcgggccgacagggtgatcgatcctcgccgttgccttaaacccgtcattctaaaggacggaccagaaagagtgatcctggcaggtccgatgcctgtaacagtggcttctgccgcacagcggaggggccgcattgggcgaaaccataataaggagggagatcagtacatatatatgggccagcccttgaacaatgacgaggatcacgcccactggaccgaagctaaaatgttactggacaacatcaatacaccagagggtattatccccgccctcttcgaacctgagagagaaaagtccgcggcaatcgatggggagtaccggctgaggggcgaggcccgcaaaactttcgttgaacttatgagaaggggagacctgccagtctggctcagctataaggtggcttcagagggctttcaatacagtgatcggcgttggtgcttcgacggggaacgcaacaatcaggtgttggaggaaaacatggatgtcgagatttggacgaaagagggagaacgaaagaaactgagacccaggtggctagacgcccggacctattctgaccctctggctctccgcgagtttaaggagttcgcagccggtagaaggtccgttagcggcgatcttatactggagatcgggaagttaccgcagcatttgacacagcgggctcaaaatgccctggacaacctcgtgatgctgcacaattcagaacagggaggccgagcatacagacatgcgatggaggagcttccagatactattgaaaccctgatgctcttggccctgatcgctgtattaacaggtggggtgaccctatttttcctgagtggccgcggactcggcaaaactagcattgggcttctgtgtgtcatggcctcctctgtgttgctgtggatggcaagcgttgagccccactggatcgctgcctccataatcctcgaatttttcctgatggtgcttctcattcctgagcccgacaggcagcggacgccacaggataaccaactggcatatgtcgtaatcggattgctgtttatgattttaaccgtggccgctaatgagatgggtctactggaaacaactaagaaagacctcggcatcgggcacgttgcggtggagaaccatcaccatgccaccatgcttgatgtcgacctgcaccctgcatcagcttggacattgtacgccgtggccaccactataattacacccatgatgcgtcatacgatcgaaaacaccactgcaaatatttctctgacagctatcgccaaccaggcggctatactcatgggactggataagggctggccaatcagtaaaatggacattggtgtccctcttttagccctggggtgctacagccaggtgaatccgctcaccttgaccgcagccgttctgatgctagtggctcactatgcaatcattggccccggactgcaagccaaggcgacaagagaggctcagaagaggactgccgcaggcatcatgaaaaacccaacggtagatgggatagtggccattgacctcgatcctgtcgtttacgacgctaagttcgaaaaacagcttggacagatcatgctgttgatcctgtgtaccagccaaattctcctgatgcgcacaacttgggccttatgcgagtccatcacccttgcaacaggccccctgaccactctctgggagggttctccagggaagttttggaatacgacaatagctgtgtcaatggccaacattttccggggaagctatctagcgggcgccggtctggcattttccttgatgaaaagtctgggcgggggacgaagaggcaccggggctcagggagaaactctcggcgagaagtggaagaggcagcttaatcagctgtctaaaagcgagttcaacatctacaagcgctcaggtattatggaggtcgaccggtccgaagccaaagaggggttgaagagaggagagaccacacgtcacgcagtgagtaggggcactgctaaactgcggtggttcgtagaacgcaatctcgtgaagcctgagggtaaggttatcgatttaggctgtgggcgaggaggctggagctattactgcgccgggctgaaaaaggtgaccgaagtcaaaggatatacaaagggcggtcccgggcatgaggaaccgataccaatggccacgtacggatggaaccttgtgaaactgcactctggcaaggacgtctttttcacccctcccgagaaatgtgatactctactctgcgacatcggcgagtcctcaccaaatcccacaattgaagaggggagaaccctgagggtgttgaagatggttgaaccttggctgcggggaaaccaattttgtatcaagattctcaatccgtacatgcccagcgtagtggagactcttgagcagatgcagcgcaaacatggtggcatgctggtcagaaacccattatcgagaaattctacacacgaaatgtattgggtgagttgcgggaccggaaacatcgtttccgcggtgaatatgacgagccgaatgctgttgaaccggttcaccatggctcaccgtaagcctacatacgagagagatgtcgacctcggcgcaggtactcgccatgtggccgtagaacccgaggtggctaacctggatattatcgggcagaggatagaaaatattaaacacgagcataagtcaacctggcactatgacgaggataacccttacaaaacatgggcctatcatggatcctacgaagttaagccatctggcagcgcaagttccatggtcaatggcgtggtgaagctacttactaaaccctgggacgtcatccctatggttacccaaatcgccatgacagataccactccatttgggcagcagcgggtgttcaaggagaaagtagacacgagaacacccaaggctaaacgcggaaccgcgcaaattatggaagtgactgccaggtggctgtggggttttctcagccgaaacaagaagccgcggatatgtaccagagaggagttcacaaggaaagtccgctctaatgcagctatcggcgccgtgtttgttgacgagaaccagtggaactcagcaaaggaggccgtggaagatgagcgtttctgggacctggtccagaaagaacgggagttgcacaagcaggggaaatgcgctacgtgcgtgtataacatgatgggaaagagagaaaagaaactgggcgagtttggtaaggccaaagggagtagggcgatttggtacatgtggctcggagcacgcttccttgagtttgaagccctgggcttcatgaatgaggatcactggttctcccgagaaaacagcttatctggcgtagagggggagggactgcataagttgggttacatcctccgggacatttcgaaaatccctggcgggaatatgtatgctgatgacaccgccggatgggatactagaataacagaagacgatctgcaaaacgaggcaaagatcaccgacattatggaaccagagcacgctctacttgccacttcaatctttaaactgacataccagaataaggttgtgagggtccagcgccccgctaagaacggcaccgtgatggatgtgattagcagacgggaccagaggggttccgggcaagtcggaacatatggcctcaatactttcaccaacatggaagcccagctgatccgtcagatggagagtgagggcatattttctcctagcgaattggagattccaaacttagcagaacgagttctggattggctcgagaaatacggggtggaacgccttaagagaatggcgatctccggagacgactgtgtagtgaaacccatcgatgaccggttcgccacggctctgaccgccctaaatgatatgggtaaggtcaggaaagacgtgccgcagtgggagccttcaaagggctggaacgattggcaacaggttcccttttgcagtcatcacttccaccagctgattatgaaggacgggcgcgagatagtggtcccatgtagaaatcaggatgaactcgtgggacgggcaagggtatctcaaggcgctggttggagcttgcgagagacagcctgcctggggaaatcctatgcacagatgtggcagcttatgtactttcatcgtagagacctgcgcctcgccgcgaacgctatctgttcagccgttcctgtggattgggtccccactagccggaccacatggtctattcacgcacatcaccaatggatgactaccgaagacatgttatccgtgtggaatagggtttggatcgaggaaaacccatggatggaggataagacgcatgtgagtagctggggagacgtcccctatctgggcaaaagagaggaccagtggtgcggctcgttgattgggctgacagcccgcgctacctgggcctccaatatccaggtggcaataaaccaggtacggaggctcatcggaaatgaaaactaccttgattacatgacttctatgaagcgattcaaaaatgagggtgaccctgaaggcgctctgtggtga

SEQ ID NO: 14058 - RNA, 9879 nt, synthetic construct
  misc_feature 1..9879: note = derived and/or modified CDS sequence (opt3) from DENV-1__EU482527__SS-prME
  source 1..9879: mol_type = other RNA
agcgtgacaatgctgctaatgcttatgcccacagcactggctttccacttgactacgcgaggcggggagcctcatatgatcgtctccaagcaggaaaggggaaaatctttactgtttaagacatcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgttccgtggcactggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgggaaaggagtgacccaaaacggccgccttattactgcaaatcccatcgtaacagacaaggaaaaacctgtcaacatagaggccgaaccacccttcggtgagtcctatattgtgatcggggctggcgagaaggccttgaagctgtcatggtttaaaaagggaagtagcatcggcaaaatgttcgaagcaaccgccagaggggctaggcggatggccattctcggagatactgcatgggactttggttccatcggcggggttttcacctctgtgggaaagctggtccatcagatttttggcacagcgtacggtgtgcttttcagcggggtatcatggacgatgaaaataggcatcggagtgctgttgacctggctcggcctgaatagtcgatccactagcttatctatgacatgtattgctgttgggctggtcaccctatacctcggagtgatggtgcaggccgattcaggctgcgtcatcaactggaagggtcgcgagctgaagtgtgggagtggaatctttgttacaaatgaagtgcacacttggaccgagcagtataaattccaagcagacagcccgaagagactttccgccgctattggcaaagcctgggaagagggtgtgtgcggcataaggtctgcaacgcggttggagaacatcatgtggaagcagatttcgaacgaactgaatcatatcctcctggagaacgacatgaaatttacagtagtcgtgggggatgttgctggaattttagcccagggcaagaaaatgatccgccctcagcccatggaatacaagtatagctggaagtcctgggggaaagcgaagataatcggagccgacgtgcaaaataccactttcattatcgatggcccaaacacccctgagtgtcccgacgatcagagagcttggaatatttgggaagtcgaggactacggttttgggatcttcacaactaacatatggctgaaacttagggattcatatacccaggtgtgcgaccaccgtttgatgagtgcagccattaaggattctaaagctgttcacgccgacatgggatactggatcgagagcgaaaagaatgagacatggaagctcgcacgggcgtccttcattgaagtgaaaacgtgtatctggccaaagtcacataccctgtggagcaacggcgtactagagtctgaaatgataatccccaaaatttatggtggccctatctcccagcacaattaccgaccagggtactttactcaaacagccggaccgtggcatctgggcaagctcgagctggatttcgacctttgcgaggggaccactgtcgtggtggatgaacactgcggaaacagaggccccagtttgaggacaaccacggtcactggtaaaattatccacgagtggtgttgccgcagctgtaccctgcctccattacggtttaagggggaagacggatgctggtatggcatggagataagacccgttaaggagaaagaagagaatctcgtgaagtctatggtatccgctggttcaggcgaagtggacagtttcagcctggggcttctgtgtatttcgatcatgatcgaggaagtcatgaggtcccgctggtctcgaaaaatgttgatgacaggaaccctcgccgtgtttttcctgctaattatgggccagctgacttggaacgatctcatccggctgtgcattatggttggggcaaatgctagcgaccgtatgggaatgggcacaacctaccttgccttgatggcaacatttaagatgagacctatgttcgccgtgggtctgttatttaggcgcctcacttcacgggaggtcctgcttctgaccatagggctaagtctcgtggctttcgttgagctgccaaactccttggaggaactgggagatggcttagcgatgggcatcatgattctcaaactgcttacggactttcagtctcatcaactgtgggccacattgctcagcctgaccttcatcaagactaccttttccctacactatgcatggaagacaatggctatggtgctgtcaattgtcagccttttccccctctgtctgagtactacctctcagaaaacgacatggttgccggtactgttagggtccctcggatgcaagcctctgaccatgttccttatcgccgaaaataaaatatggggtagaaagagctggccactgaacgagggcatcatggccgtggggattgtttcgatcttgctctcatctctgctcaagaacgatgtgcccctggctggacctcttattgcaggcggtatgctcatcgcctgttacgtcataagtgggtccagcgcggacctgtctttggaaaaggctgccgaggtgagctgggaggaagaggcagaacattccggagcctcacacaatattttagtagaggtgcaggatgacggcactatgaaaatcaaggatgaagagagggacgatacactgaccatcctcctgaaggctactcttctggcagtcagtggcgtttatcccttgagcattccagccacactatttgtgtggtacttctggcagaaaaagaaacaacgatctggggtgctgtgggacaccccttcacccccggaggtcgaacgcgcggtgctcgatgacggaatatatcggatcatgcagagaggtctgcttggcaggagccaggttggggtaggagtgtttcaggagaacgtcttccatacgatgtggcacgtgactcgtggcgctgttttaatgtaccaaggtaagcgcctggaaccgagttgggccagcgtgaaaaaggacctcatttcctacgggggaggctggcggttgcagggctcttggaataccggggaggaggtccaggtgatcgcagtagaacctggaaagaaccccaaaaatgtccagacagccccaggtacctttaagacatcggagggcgaagtgggggctattgccctggatttcaaacccggaactagcggctcacctatcgttaacagagagggtaagatagtggggctctatggaaatggcgtcgtgaccacgtccggcacatacgttagtgcaatcgctcaagccaaagcgtctcaggaagggccactgcccgagattgaggacgaagtgtttaggaagcgaaaccttactatcatggatctgcaccctggaagcggtaagacccggcgctatttgccggccattgtcagagaggcaatcaaaaggaagctacggacactgatactcgctccaacccgagtggtagcctccgaaatggctgaggcattaaaaggcatgcccattagataccagactaccgccgtgaagtcagaacatacagggaaagagatcgttgacctgatgtgccacgccacgttcactatgcgccttctgtctcctgtcagggtgccaaattataacatgatcattatggatgaggctcattttaccgaccccagcagtatcgcggcacgtggatacatatccacacgggtgggcatgggtgaagccgctgccattttcatgaccgcaactcctccggggagcgtcgaggcctttccccaatctaatgctgtaatccaggatgaagagagagacattccagaaaggtcatggaactccggatatgagtggatcacagatttccctggcaagaccgtgtggttcgttcccagtataaagagcggcaatgacattgcgaactgtctccgcaaaaatgggaagcgagtgatccagttgtcgagaaaaacgtttgatactgagtaccagaagaccaaaaacaacgactgggactacgtcgtgaccaccgatatctctgaaatgggagccaatttccgggcagacagggttattgatccacgccgttgcctgaagcctgtgatcctcaaggacggtcccgagagagtcattctggctggcccaatgccggtgactgtagcctccgcagcccaacggagggggcgcataggacgaaaccacaataaagaaggcgatcagtatatctacatgggtcagcctcttaacaatgacgaggatcatgctcactggacagaggccaagatgctactggacaacattaatacccccgaagggatcatcccagcgttgtttgagcccgaaagagagaaaagcgcagccattgatggcgaatatcggttaaggggagaggctcgcaagacattcgtggagctgatgagaaggggcgacctccctgtttggctgtcatacaaagtcgccagtgaagggtttcagtattctgatcggcgttggtgcttcgacggagagcgcaacaatcaagtgcttgaagagaacatggatgtggaaatatggactaaggagggtgagaggaaaaagctgagaccaagatggctcgacgctcggacgtactccgaccccttggcactgcgcgaatttaaggagttcgccgctggcagaaggagcgtctcaggggatctaatcctggaaattggaaaactccctcagcaccttacccagcgggcccagaatgcactggacaacttagttatgttgcataatagtgagcaaggcggtcgagcgtatagacacgccatggaggaactgccggatacaatcgagactctcatgctgcttgctctgattgccgtgctcaccgggggcgtaacattgtttttcctgagcggacgcggcttagggaagacctccatcggactactgtgtgtgatggcatctagcgtcctcctttggatggcttccgtggaaccacattggatagccgcatcaatcattctggagtttttcttgatggttctgctcatccccgaacctgacaggcagcggactccccaggataaccagctggcctacgtggtcattggtcttctctttatgatcctgacggtagctgcgaatgagatgggcttgctggagaccaccaaaaaggacttagggataggacacgtggccgttgaaaaccaccatcacgcagctatgctagatgtggacctgcatccagcctctgcctggactctctacgcagtcgctaccacaattatcacccctatgatgcgtcacactattgagaacacaacggccaatatcagtcttaccgcgatagctaaccaagccgcaatcctgatgggcttggataaaggttggcccatttcgaagatggacatcggggtgccactgctcgccctgggctgctatagccaggtcaatcctcttactttaacagctgcagtgctgatgctcgttgcccattacgcgattatcggaccgggcttgcaggctaaggccaccagagaagcacagaaaaggaccgccgctgggataatgaagaaccccacagtggatggaattgtagccatcgacctggatccagtggtctatgacgcaaaattcgagaagcagctaggccagatcatgctgctcattctttgtacttcccagatcctgttgatgcgcacgacctgggctctgtgcgaatctataacactcgccactggtcctctgaccacattatgggaggggtcacccggaaaattctggaataccactattgcggttagcatggccaacatctttcggggctcctaccttgccggtgctggcctggccttcagtctcatgaagtctctagggggaggccgaagagggacgggagcacaaggcgagacactgggtgaaaagtggaaaaggcagttgaatcagctgagcaagtcagagtttaacacctataaacgctccgggattatggaagtggaccggagtgaggctaaggaaggactcaaaagaggcgagactaccaagcacgccgtcagccgtggtacagccaaacttaggtggttcgtggagcggaatctggtaaaaccagaaggcaaggtgatcgatttggggtgtggacgcggcgggtggtcttactattgcgcgggactgaaaaaggttactgaggtgaaaggctacaccaagggtgggcctggacacgaggaacccataccgatggctacatacggctggaacctcgtcaaattacattccggcaaggacgtgtttttcatcccacctgaaaagtgtgatacgctgctttgcgacattggggagtcaagccccaatccaaccatcgaggaaggacgaactctgagagtcctaaaaatggtggagccctggctcaggggtaaccagttttgtattaagatcctgaatccttatatgccgtcggttgtagaaacattggagcaaatgcagcggaaacacggcgggatgctggtgcgcaaccccctctctagaaatagtacccatgagatgtactgggtctcctgcggaactggcaacattgtgagcgcagttaatatgacatcaaggatgcttctgaaccgattcaccatggcccaccggaagccaacgtatgaacgtgatgtggacttaggtgctgggaccagacacgtcgccgtggagcctgaagtagcaaacctggatatcataggacagcgcattgagaatatcaaacatgaacacaagtccacatggcattacgacgaggataacccctataagacttgggcctaccacggctcttatgaggtgaaacctagcggcagtgcttccagcatggttaatggggtcgtgaagttgctcaccaaaccatgggacgtgatccccatggtcacacagattgcgatgactgataccacaccttttggacaacagagggttttcaaggaaaaagtggacacccggactccaaaggccaagagaggtacggcacagataatggaggtaacagctaaatggctgtggggctttctatctcgcaacaagaaacccaggatctgtacccgagaagagttcactcggaaggtgagatcaaatgccgcaattggggccgtctttgtggacgaaaaccaatggaatagtgctaaagaggccgttgaggatgaaaggttctgggaccttgtgcatcgcgagcgtgaactgcacaagcagggaaagtgcgcgacctgcgtctacaacatgatgggcaaacgggagaagaaactcggtgagttcgggaaggcaaaaggatccagagccatctggtacatgtggctgggcgctaggtttttggagttcgaggccctgggctttatgaatgaagatcactggttcagccgcgagaactctctctcgggggtggaaggagagggtcttcataagctgggctatattttacgagacatctcaaaaataccagggggaaatatgtacgcagatgacacagctggctgggatacgcggatcaccgaggacgatctgcagaacgaagccaagattactgacatcatggagcctgaacacgctttgctcgccaagagcatttttaaactgacatatcagaataaggtagttagagtgcaaaggccagccaaaaacggtaccgtcatggatgtgatctcccgcagagaccagcgggggagtggacaggtgggcacttacggcctaaatacattcaccaacatggaggcgcagcttataaggcaaatggaatctgaggggatttttagcccctccgagctggaaacacctaacctcgccggacgtgtcctggattggttggagaagcatggtgttgaacgattaaaacgcatggctatctcaggcgacgactgtgtggtaaagccaatcgatgacagattcgccactgcactgaccgctctcaatgatatggggaaggtgcggaaagacattccccagtgggagccgagtaagggatggaacgattggcagcaggtccctttttgctctcaccacttccatcaacttataatgaaagacggcagggaaatcgtggttccctgtcgcaatcaggatgagctggtgggtagagcccgggtcagccagggggcaggatggtccctaagggagacggcctgcctgggcaagtcatatgcgcagatgtggcaactcatgtactttcaccgacgtgacttgagactggctgccaacgcaatttgtagcgccgtgccagtagattgggttcctacctctcgcacaacttggtccatccatgctcaccatcagtggatgaccacagaagacatgcttagtgtgtggaatcgggtctggattgaggaaaacccctggatggaggataaaactcacatcagctcgtggggcgacgtgccatatctggggaagagggaagaccagtggtgcggatccctcataggtttaaccgccagagcaacgtgggctacaaatatccaagttgccattaaccaggtgcgccggctgatcggcaatgagaactacttggattacatgacctctatgaagaggttcaaaaatgagtcagaccccgaaggggcgctgtggtga

SEQ ID NO: 14059 - RNA, 9879 nt, synthetic construct
  misc_feature 1..9879: note = derived and/or modified CDS sequence (opt3) from DENV-1__EU482528__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaagtctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggccatggtgcaggcagattcaggatgcgtgattaactggaagggccgcgaactgaagtgtggtagtgggatctttgtcactaatgaggttcacacctggacggaacagtataaattccaagccgacagcccgaagagactttccgctgccatcggaaaagcatgggaggagggcgtgtgcggtattaggtctgctacacggttggaaaacataatgtggaagcagatctcgaacgagctgaatcatattctcctggaaaacgacatgaaatttaccgtggtagtcggcgatgtggccgggatcttagcgcagggaaagaaaatgattcgccctcagcccatggagtacaagcacagctggaagtcctggggcaaagccaagatcataggggctgacgttcaaaatactaccttcatcattgatggaccaaacacacctgaatgtcccgacgatcagagagcatggaatatctgggaggtggaggactatggctttggtattttcactaccaacatctggctgaaacttagggattcatacacacaggtctgcgaccaccgtttgatgagtgccgctataaaggattctaaagccgtgcatgcagacatggggtattggattgaaagcgagaagaatgaaacgtggaagctcgcgcgggcctccttcatcgaggttaaaacctgtatttggccaaagtcacacactctgtggagcaacggagtgctagaatctgagatgatcatacccaaaatctacggcggtcctatttcccagcataattatcgaccaggctactttacacaaaccgctgggccgtggcacctgggaaagctcgagctggatttcgacctttgcgaaggcactacagtagtcgtggatgagcactgcgggaacagaggacccagtttgaggaccacgactgtgaccggcaaaatcattcatgaatggtgttgccgcagctgtacactgcctccattacggtttaagggtgaggacgggtgctggtacggaatggagatcagacccgtcaaggaaaaagaggaaaatctcgttaagtctatggtgtccgccggctcaggtgaggtagacagtttcagcctgggccttctgtgtatatcgattatgatcgaagaggtgatgaggtcccgctggtctcgaaaaatgttgatgaccgggactctcgcagtctttttcctgctaatcatgggacagctgacatggaacgatctcattcggctgtgcatcatggtgggcgctaatgccagcgaccgtatggggatgggaaccacatatcttgcattgatggccacttttaagatgagacctatgttcgctgttggcctgttatttaggcgcctcacctcacgggaggtgctgcttctgacgattggtctaagtctcgtcgcgtccgtggaactgccaaactctttggaggaactgggggatggattagccatgggcataatgatcctcaaactgcttacagacttccagagccaccaactgtgggcaaccttgctctccctgacttttattaagaccacattctcactacattacgcttggaagactatggccatggttctgagcatcgtgagtctttttcccctctgtctgtctaccacgtcccagaaaacaacctggttgccggtcctgttaggcagcctcgggtgcaagcctctgactatgttccttattgccgagaataaaatctggggaagaaagtcgtggccactgaacgaaggtataatggctgtaggcatcgtgtcaattttgctctctagtctgctcaagaatgatgttcccctggcagggcctcttatcgccggaggcatgctcattgcgtgttatgtgatctccggtagctctgctgacctgagcttggagaaggccgcagaggtctcctgggaagaggaagccgagcactcaggggctagtcataatatattagtggaagtacaggatgacggaacaatgaaaattaaggatgaggagagggacgataccctgactatcctcctgaaggcaacacttctggccgtgagcggcgtctaccccttgtctatcccagcgaccctattcgtttggtatttttggcagaaaaagaaacaacgatccggcgtgctgtgggacacgccttcacccccagaagtggagcgcgctgtcctcgatgacgggatttaccggataatgcagagaggactgcttggtaggagtcaggtgggcgttggggtattccaggaaaacgtgtttcacactatgtggcacgtcacccgtggagccgtgttaatgtatcaaggcaagcgcctggagccgagctgggcatccgttaaaaaggacctcatctcttacggtgggggatggcggttgcagggctcgtggaatacaggcgaggaagtgcaggtcattgccgtggagcctgggaagaaccccaaaaatgtacagaccgctccaggaacattcaagactagcgaaggtgaggtcggcgccatcgcactggattttaaacccgggacctcaggatcccctattgtgaacagagaaggcaagatcgttggtctctacgggaatggagtggtcacgacaagtggcacttatgtgtctgctatagcccaagcgaaagccagccaggagggcccactgcccgagatcgaagacgaggttttcaggaagcgaaaccttaccattatggatctgcatcctgggtccggaaagacacggcgctacttgccggcaatcgtgagagaagctattaaaaggaagctacggaccctgatcctcgccccaactcgagtcgtggcttcagagatggcagaagccttaaaaggtatgcccataagatatcagaccacagccgtaaagtctgagcacacgggcaaagagattgtggacctgatgtgccatgctacttttaccatgcgccttctgagccctgttagggtcccaaattacaacatgatcatcatggatgaagcgcacttcacagaccccagttccattgcagcccgtgggtatatcagcacccgggtgggaatgggcgaggctgccgcaatatttatgactgccacacctccgggttctgtggaggctttcccccaatcaaatgcggtcattcaggatgaggaaagagacatcccagagaggtcctggaacagtgggtacgagtggattaccgattttcctggaaagacggtatggttcgtgcccagcatcaagtcgggcaatgacatagccaactgtctccgcaaaaatggcaagcgagttattcagttgtctagaaaaactttcgatacagaatatcagaagaccaaaaacaacgactgggactacgtggtcaccactgatatctccgagatgggggcaaattttcgggctgacagggtgatcgatccacgccgttgcctgaagcctgttattctcaaggacggacccgaaagagtgatcctggccggtccaatgccggtcacagtggcaagcgccgctcaacggaggggccgcattgggcgaaaccataataaagagggagatcagtacatatatatgggccagcctcttaacaatgacgaggatcacgcccactggaccgaagcgaagatgctactggacaacatcaatacacccgagggtattatcccagcattgttcgaacccgagagagaaaaatcagccgctatcgatggggagtaccggttaaggggcgaggcccgcaagacttttgtagaactgatgagaaggggagacctccctgtgtggctgagttataaagttgcttctgagggcttccagtactccgatcggcgttggtgctttgacggggaacgcaacaatcaagtccttgaggaaaacatggatgtggagatttggacgaaggagggagaacgaaagaaactgagaccaaggtggctcgacgcacggacctatagcgaccccttggccctgcgcgagttcaaagaatttgctgccggtagaaggtcagtgagtggcgatctaatactggagatcgggaaactccctcagcatcttacacagcgggcacagaatgcgctggacaacttagtcatgttgcacaatagcgaacaaggaggccgagcctacagacatgctatggaggagctgccggatactattgaaaccctcatgctgcttgccctgatcgcagttctcacaggtggggtgaccttgttctttctgtccggccgcggattaggcaagacttctattgggctactgtgtgtaatggctagctccgtgctcctttggatggcctcagtcgagccacactggatcgcagcctctataatcctggagttctttttgatggtgctgctcattcccgagcctgacaggcagcggacgccccaggataaccagctggcttatgttgtgatcggacttctcttcatgattctgaccgtcgcggccaatgagatgggtttgctggaaacaactaaaaaggacttaggcatcgggcacgtagcagtggagaaccatcaccatgctgccatgctagatgttgacctgcacccagccagtgcatggaccctctacgctgtggccacaaccataattactcctatgatgcgtcatacaatcgaaaacacgaccgcgaatatttcgcttactgctatcgccaaccaagcagccatactgatgggattggataaaggctggcccatcagcaagatggacattggtgtcccactgctcgctctggggtgctactcccaggtgaatcctcttacattaaccgcagccgtcctgatgctcgtggcgcactatgctatcattggcccgggattgcaggccaaggcaaccagagaggcccagaagaggacagctgccggcatcatgaagaaccccactgttgatgggatagtggcaattgacctggatccagtagtgtacgacgctaaatttgaaaagcagctaggacagatcatgctgctcatcctttgtacgtctcagattctgttgatgcgcaccacatgggccctgtgcgagtcaatcactctcgcgaccggccctctgacaaccttatgggagggtagccccgggaaattctggaatactacgatagccgtctccatggcaaacattttccggggaagttatcttgctggcgccggtctggcattttctctcatgaaaagcctaggcgggggacgaagaggcacaggggctcaaggagaaaccctgggcgagaagtggaaaaggcagttgaatcagctgtcaaagtccgagttcaacacttacaaacgcagtggtatcatggaggttgaccggagcgaagccaaggaggggctcaaaagaggagagaccacaaagcacgccgtgtctcgtggcactgcgaaacttaggtggtttgtcgaacggaatctggtgaaaccagagggtaaggtaattgatttgggctgtgggcgcggaggctggtcctattactgcgctgggctgaaaaaggtgaccgaagttaaaggatatacaaagggcggtcctgggcatgaggaacccatcccgatggcaacgtacggatggaacctcgtgaaattacactcaggcaaggacgtcttctttataccacctgagaagtgtgataccctgctttgcgacatcggcgagagctcgcccaatccaactattgaagaggggcgaacactgagagtgctaaaaatggtcgaaccctggctcaggggaaaccagttctgtatcaagattctgaatccttacatgccgtctgtggttgagaccttggagcaaatgcagcggaaacatggtggcatgctggtacgcaaccccctcagtagaaattccactcacgaaatgtattgggtgagctgcgggacaggaaacatcgtctcagccgtgaatatgacctccaggatgcttctgaaccgatttacgatggctcaccggaagccaacctacgagcgtgatgttgacttaggcgccggtacaagacatgtggcagtcgaacctgaggtggccaacctggatattatcgggcagcgcatagaaaatattaaacacgagcataagtctacttggcactatgacgaggataacccctacaagacctgggcttatcatggaagctacgaagtaaaacctagtggctccgcgagctctatggtgaatggcgttgtcaagttgctcacaaaaccatgggacgtgatccccatggtgactcagatcgccatgaccgatacaacccctttcgggcaacagagggtctttaaggagaaagttgacactcggacgccaaaggcaaagagaggaacagctcagattatggaagtgaccgccaaatggctgtggggtttcctatcacgcaacaagaaacccaggatatgtactcgagaggaatttacccggaaggtaagaagtaatgcagccatcggcgctgtgttcgtcgacgagaaccaatggaactccgccaaagaggcggtggaagatgagaggttttgggaccttgttcaccgcgaacgtgagctgcacaagcaggggaagtgcgcaacatgcgtgtataacatgatgggaaaacgggaaaagaaactcggcgagttcggtaaggccaaagggagcagagctatttggtacatgtggctgggagccaggttcttggagtttgaagcactgggcttcatgaatgaggatcattggttttctcgcgaaaactcgctctcaggcgtcgagggggagggacttcacaagctgggttacatcttacgagacattagcaaaatcccgggcgggaatatgtatgctgatgacacggccggatgggatacccggataactgaagacgatctgcagaacgaggctaagatcacagacattatggaacctgagcatgccttgctcgcaaagtccatcttcaaactgacctaccagaataaggtggtaagagttcaaaggccagcgaaaaacggcactgtgatggatgtcattagtcgcagagaccagcggggttctggacaggtgggaacatatggcctaaatacctttacaaacatggaagcccagcttatcaggcaaatggagagcgagggcatattctccccctcagaactggagactcctaacctcgctgggcgtgtgctggattggttggaaaagcacggagtcgagcgattaaaacgcatggccattagtggtgacgactgtgttgtgaagccaatcgatgacagatttgcaaccgctctgacggccctcaatgatatgggcaaggtacggaaagacatcccccagtgggaaccgtctaaggggtggaacgattggcaacaggtgcctttctgcagccaccattttcaccaacttattatgaaagacggaaggggcatagtcgtgccctgtcgcaatcaggatgagctggttggtagagcacgggtgtcccagggggccggatggtcactaagggagaccgcgtgcctgggcaagagctacgctcagatgtggcaactcatgtatttccatcgacgtgacttgagactggccgcaaacgccatctgttctgctgtcccagtggattgggtacctacatcccgcactacctggagtattcacgcccatcaccagtggatgacaactgaagacatgcttagcgtttggaatcgggtgtggatcgaggaaaacccctggatggaggataaaacccacatttcgtcctggggcgacgtcccatacctggggaagagggaagaccagtggtgcggatctctcatcggtttaacggcaagagctacatgggccaccaatatacaagtggcgatcaaccaggttcgccggctgattggcaatgagaactatttggattacatgacttcaatgaagaggtttaaaaatgagagcgaccccgaaggggctctgtggtga

SEQ ID NO: 14060 - RNA, 9879 nt, synthetic construct
  misc_feature 1..9879: note = derived and/or modified CDS sequence (opt3) from DENV-1__EU482529__SS-prME
  source 1..9879: mol_type = other RNA
agcgtgaccatgctgctcatgcttatgcccacggccctggctttccacttgactacgagaggaggggaacctcatatgatcgtctccaagcaggaaagagggaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacactgcaagagacctggaatcggcaggacttgctcgtaacattcaaaactgcacacgctaagaagcaggaagttgtggtcctgggtagccaagagggggccatgcacaccgctttaacgggcgccaccgaaatccagacaagtggaactaccacaatttttgcaggccatctgaaatgccgtctaaagatggataaactcactctgaaggggatgtcttatgtgatgtgtaccggatccttcaaacttgagaaggaagtcgccgagacgcagcacggtacagtgttggttcagataaagtacgagggcaccgacgctccttgcaaaatcccattcagcactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagccacacgcaggtctgcgaccaccgtctgatgtccgctgcaatcaaagattcaaaggccgtgcatgctgacatggggtattggattgaaagtgagaaaaatgaaacctggaagctagcccgggcatctttcatcgaggttaagacttgtatatggccaaaaagccacacactgtggtccaacggagtgctcgaatcagagatgatcattcccaagatctacggcggtcctattagccaacataattatcgaccaggctacttcacccagactgcggggccgtggcacctgggaaaacttgagttggattttgacctgtgcgaaggcacaaccgtagtcgtggatgagcactgcgggaacagaggaccctctttaaggacgactaccgtgacaggcaagatcatacatgaatggtgttgccgctcctgtaccctccctccactgcggttcagaggtgaggacgggtgctggtacggaatggagattaggcccgtcaaagaaaaggaggaaaatcttgttaagagtatggtgagcgccggctctggtgaggtagactccttttcactgggcttgctctgtatcagtatcatgattgaagaggtgatgcgcagccgatggtcgcggaaaatgctgatgactgggacactagctgtcttctttctgctcatcatgggacagctgacctggaacgatcttattcgtttgtgcataatggtgggcgccaatgcatccgacagaatggggatgggaacaacttatctggctttaatggccaccttcaagatgaggcctatgtttgcagttggcctcctgttccgccggcttacgtctagagaggtgctgctactcacaatcggtctgagcttggtcgcctcagtggaactgccaaacagtttagaggaactcggggatggactggctatgggcattatgatccttaaactgttgaccgactttcaatcccaccagctctgggcgactctgctatctctgaccttcattaagacaacttttagccttcattacgcctggaaaaccatggcaatggttctctccatcgtgtcactgttccccttgtgtctgagcacgacaagtcagaagaccacttggttaccggtcctcctgggctctcttgggtgcaagcctctgacaatgtttttgatagctgagaataaaatctggggaaggcgatcctggccactcaacgaaggtattatggccgtaggcatcgtgagcattctgctatcgtcactgcttaagaacgatgttcccctcgccgggcctctgatcgctggaggcatgttgatagcatgttatgtgatttctggtagttccgccgacttaagcctggagaaagcggctgaggtctcttgggaagaggaagccgagcacagcggggcatcccataatatcctcgtggaagtacaggatgacggaaccatgaagatcaaagatgaggagcgcgacgatactctgacaattcttctgaaggccaccttgctagctgtgtcaggcgtctaccccctgagtataccagcaacactcttcgtttggtatttctggcagaagaagaagcagcggagcggcgtgctgtgggacactccttctcccccagaagtggagagagccgtccttgatgacgggatctacaggattatgcagcgtggattactgggtcgctcccaggtgggcgttggggtatttcaagaaaacgtgttccacaccatgtggcacgtcacacggggagcggtgctcatgtatcagggcaaaagattggagccgtcatgggctagtgttaagaaagacctgatcagctacggtgggggatggaggctccagggctcctggaataccggcgaggaagtgcaggtcattgccgtggagcctgggaagaaccccaaaaatgtacaaacagcaccaggaacttttaagacccccgaaggtgaggtcggcgccatcgctctggatttcaagcctgggacgtctggatcgccaatagtgaaccgagaaggcaaaatcgttggtctttacgggaatggagtggtcacaactagcggcacctatgtgtcagccattgcacaggctaaggcctcccaggagggccccctgcctgagatcgaagacgaggtttttcggaaacgcaacttgacaattatggatctacatccggggagtggaaagaccagaaggtacctgccagcgatcgtgcgggaagccataaaacgaaagctcagaactttaattctggcacccacccgcgtcgtggcttctgagatggccgaagctcttaagggtatgcctatcaggtatcaaacaacggcagtaaaaagcgagcacactggcaaggagatcgtggacctgatgtgccatgccaccttcacaatgcgtctcttgtccccagttcgggtccccaattacaacatgattatcatggatgaagcccactttaccgacccttcatctatagctgcgagagggtatattagcactagggtgggaatgggcgaggcagccgctatcttcatgacagccaccccgcccggtagtgtggaagcatttccacagtccaatgccgtcattcaggatgaggaacgcgacatccctgagcgaagctggaactctgggtacgagtggataacggatttccccggaaaaactgtatggtttgtgccatcaattaagtccggcaatgacatcgctaactgtctgaggaaaaatggcaagcgggttatccagctcagtaggaagacattcgataccgaatatcagaaaaccaagaacaacgactgggactacgtggtcactacagatattagcgagatgggggcgaatttccgcgccgaccgtgtgatcgatcctagacggtgcctgaaacccgttattcttaaggacggaccagaaagggtgatactagcaggtccgatgcctgtcaccgtggcttcggccgcacagcgccgaggcagaatcgggcggaaccataataaagagggagatcagtacatttatatgggccagcccctgaacaatgacgaggatcacgcccactggacagaagctaagatgttgttagacaacatcaatactccagagggtatcattcccgccctgtttgaacctgagagggaaaagtctgcggcaatagatggggagtaccgcctcagaggcgaggccaggaaaacgttcgtagaactgatgcggcgtggagaccttccagtgtggctgtcctataaggttgctagcgagggctttcaatactcagatcgccgatggtgcttcgacggggaaagaaacaatcaggtcctcgaggaaaacatggatgtggagatctggaccaaagagggagaaaggaagaaattgcggccccgctggctggacgccagaacatatagtgaccctctagctctgagggagtttaaggagttcgcagccggtcggcgatctgtgtccggcgatctcattcttgagatcgggaaactgccgcagcatttaactcagagagctcaaaatgccttggacaacctggtcatgctccacaatagcgaacagggaggccgcgcatacaggcatgcgatggaggagctgccagataccattgaaacacttatgctgctcgccttgatcgctgttctgaccggtggggtgactttatttttcctatcaggccggggactgggcaagacgagtatagggctcctttgtgtaatggccagctccgtgctgttgtggatggcatctgtcgagccccactggatcgctgccagcattatcctggaatttttcctcatggtgctgcttattcctgagcccgaccgtcagagaaccccacaggataaccaactcgcatatgttgtgatcggactgttgtttatgatactgacagtcgccgctaatgagatgggtttactagaaactaccaagaaagacctgggcattgggcacgtagcggtggagaaccatcaccatgccgcaatgctcgatgttgaccttcaccctgcttccgcctggacactgtacgccgtggcaaccactatcattacacccatgatgaggcatacgatcgaaaacaccactgctaatatatcattgacagccatcgcgaaccaggctgccattctgatgggactcgataagggctggccaatctctaaaatggacattggtgtccctctgcttgcattagggtgctacagtcaggtgaatccgctgaccctcaccgccgctgtcttgatgctggtggcacactatgccatcataggccccggactacaagcgaaggctacacgcgaggcccagaaacggactgcagccggcattatgaagaacccaacggttgatgggatcgtggctatcgacctggatcctgtagtgtacgacgccaagttcgaaaaacagctcggacagattatgcttctgatcttgtgtacctcgcaaatactgctcatgcgaacaacttgggcactgtgcgagagcattaccttagctacaggcccccttaccactctgtgggagggttccccagggaagttttggaatacgacaatcgccgtctctatggcgaacattttcagaggatcatatctcgccggcgcaggtctagctttcagcctgatgaaatccttgggcgggggaaggcgcggcaccggggcccagggagaaactctgggcgagaagtggaaacggcagctcaatcagcttagtaagtctgaatttaacacctacaagagaagcggtatcatggaggttgaccgttcagaagcaaaagaggggctgaagaggggagagacaactaaacacgctgtgtcccggggcaccgccaagttgcgctggttcgtcgaacgaaatctggtgaaacctgagggtaaggtaatagatctcggctgtgggagaggaggctggagttattactgcgccgggttaaagaaagtgacagaagttaagggatatacgaaaggcggtcccgggcatgaggaaccgatcccaatggcgacctacggatggaacctggtgaaacttcacagcggcaaagacgtctttttcattcctcccgagaagtgtgatactctgctatgcgacatcggcgagtcttccccaaatcccacaattgaagaggggaggaccctccgggtgctgaaaatggtcgaaccttggttgcgcggaaaccaattttgtatcaagattctgaatccgtacatgccctcagtggttgagactctcgagcagatgcagagaaagcatggtggcatgcttgtaaggaacccactgagccgaaattcgacacacgaaatgtattgggtgtcttgcgggaccggaaacatcgtcagtgctgtgaatatgacgtcccggatgttactgaaccgtttcaccatggcacacagaaaacctacatacgagcgcgatgttgacttgggcgccggtactaggcatgtggctgtcgaacccgaggtggccaacctcgatataattgggcagcggatcgaaaatatcaagcacgagcataaaagcacctggcactatgacgaggataacccttacaagacatgggcatatcatggatcatacgaagtaaaaccatccggctctgccagcagtatggtgaatggcgttgtcaagctgctaactaagccctgggacgtgattcctatggtgacccaaatagctatgacagataccactccatttgggcagcagagagtcttcaaagagaaggttgacacgcgcacacccaaagcgaagaggggaaccgcccaaatcatggaagtgactgcaaaatggctttggggttttctgtcccgaaacaagaagccgcggatttgtaccagagaggagttcacaaggaaagtacgcagcaatgctgccatcggcgcagtgtttgtcgacgagaaccagtggaactctgccaaggaggctgtggaagatgagcgtttctgggacctcgttcaccgggaaagagagctgcacaaacaggggaagtgcgccacgtgcgtgtataacatgatgggaaaaagggaaaagaagttgggcgagtttggtaaagcgaaggggtcacgcgcaatttggtacatgtggctgggagcccgattcctcgagttcgaagctcttggctttatgaatgaggatcattggttcagtcgggaaaactccctgagcggcgtcgagggggagggattacacaaactgggttacatcttgagagacatatctaagatccctggcgggaatatgtatgccgatgacaccgcaggatgggatactaggattacagaagacgatctccagaacgaggctcgcatcaccgacattatggaaccagagcatgccctgctagctaaatcgatctttaaacttacttaccaaaataaagtggtaagagttcagcggcccgccaagaacggcacagtgatggatgtcatatcaaggcgtgaccagcgaggtagcggacaggtgggaacctatggcctgaatacattcactaacatggaagcacaactcattcgccagatggagtccgagggcatctttagtccttctgaactggagaccccaaacttggcggaaagagtgttagattggctggagaagtacggggtcgaacggctcaaaaggatggccatcagcggagacgactgtgttgtgaagcccattgatgaccgcttcgctacggcccttaccgcactgaatgatatgggtaaagtaagaaaggacataccgcagtgggagccttccaaaggctggaacgattggcagcaagtgcccttttgctcacaccacttccatcagctaatcatgaaggacgggcgggagattgtcgtgccatgtaggaatcaggatgaactggttggacgagctcgtgtgagtcagggcgccggttggtctctcagagagacagcatgcttgggaaagagctatgcccaaatgtggcagctgatgtactttcaccgccgggaccttaggctggcggctaacgccatctgttccgcagtccctgtggattggattcccacttcaagaaccacatggagcatccatgcccaccatcagtggatgactaccgaagacatgctctctgtatggaatcgcgtttggatagaggaaaacccatggatggaggataaaacgcacatctccagttggggagacgtgccctatttaggcaagcgggaggaccaatggtgcggcagcctgattgggttgacagctagggccacctgggcaactaatatccaggtcgctattaaccaggtgcgaagactgatcggaaatgaaaactacctcgattacatgacatcgatgaaacggttcaagaatgagggtgaccctgaaggcgccctttggtga

SEQ ID NO: 14061 - RNA, 9879 nt, synthetic construct
  misc_feature 1..9879: note = derived and/or modified CDS sequence (opt3) from DENV-1__EU482531__SS-prME
  source 1..9879: mol_type = other RNA
agcgtgaccatgctgctcatgcttatgcccacagcactggctttccacttgactacgagaggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgtgggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgccacgcggctggaaaacattatgtggaaacagatctctaacgagctcaatcatattctgttagaaaacgacatgaagttcacagtagtcgtgggcgatgttgtggggatcctggcacagggcaaaaagatgatacgccctcaacccatggagcacaaatactcgtggaaaagctggggcaaggctaagatcattggggccgacgtccagaataccacttttatcattgatggaccaaacacccctgaatgtcccaatgaccagagagcgtggaacatctgggaggtggaggattatggcttcggtatatttacaactaatatttggcttaagttgagggactcctacacccaggcctgcgatcaccgtctcatgtcagctgcaatcaaagacagtaaggccgttcatgctgatatggggtattggattgaatctgagaaaaacgaaacatggaagctggcccgggcatccttcatcgaggtgaagacgtgtatatggccaaaatcccacaccctatggtcaaatggagtactggaaagcgagatggtcatccccaagatttacggcggtcctatctctcaacataactatcgaccaggctacttcactcagacagcggggccgtggcacctcggaaaactggagcttgactttgatttgtgcgaaggcaccactgtggtggtcgacgagcactgcgggaatagaggaccctccctgaggacaaccacggttactggcaagattatccatgaatggtgttgccgcagttgtaccttacctccactccggttcaaaggtgaggatgggtgctggtacggaatggagataagacccgtgaaggaaaaggaggaaaacctggtaaaaagcatggtgtctgccggctccggtgaggtcgactcatttagtcttggcctgttgtgtattagcatcatgatcgaagaggtgatgaggtcgcgctggtcccgaaagatgctcatgacagggaccctggctgttttcctactgctcattatgggacagctgacttggaatgaccttatccggttgtgcattatggtgggcgccaacgcatctgatcgtatggggatgggaacaacctatctggctttaatggccacatttaaaatgagacctatgttcgcagtcggcctcctgtttaggcgccttactagccgggaggtgctgctactcaccataggtctgtcattggttgccagtgtggaactgccaaattccttagaggaactcggggacggactggctatgggcatcatgattcttaagctgttgacggatttccaatctcaccagctctgggcgacactgctaagcctgacctttatcaaaactaccctttccctccattacgcctggaagacaatggcaatggtcctgtcaattgtcagcttgttccccctgtgtttaagtactacctctcagaagacgacatggctcccggtgctgcttggctccctggggtgcaaacctttgaccatgtttctcatcgctgagaacaagatatggggaagaaaaagctggccactgaacgaaggtatcatggccgttggcgtggtctcgattctactgtcatctcttctcaagaatgacgtgcccctggccgggcctttgatcgctggaggcatgttaattgcatgttatgtaatcagtggttccagcgccgatctgtctctcgagaaagcggctgaggtgagctgggaagaggaagccgagcactccggggcatcacataacatactggtcgaagttcaggacgatggaactatgaagattaaagacgaggagagggatgacacacttaccatcctgttgaaggccactctactggctgtgagtggcgtgtaccccctcagcatcccagcaacactgttcgtctggtatttttggcaaaagaaaaagcagcgatctggcgtgctttgggataccccttcacccccagaagttgagcgcgccgtattagacgatgggatttaccggataatgcagagaggactgctcggtaggagccaggtgggcgtcggggtgttccaagaaaatgttttccacacgatgtggcacgtgactcgtggagcggtcttgatgtatcagggcaaacgcctggagccgagttgggctagcgtgaagaaagacctcatctcctacggtgggggatggcggctgcagggctcttggaacaccggcgaggaagtacaggtcattgccgtggagcctgggaagaatcccaagaacgttcaaacagcaccaggaacctttaaaacacccgaaggtgaggtgggcgccatcgctcttgacttcaagcctgggacttcgggaagcccaattgtcaatagagaaggcaaaatcgtgggtctgtacgggaacggagttgtgaccacgtcaggcacatatgtctccgccatagcacaggctaaggccagtcaggagggccccttgcctgagatcgaagatgaggtgtttaggaaacgaaatctaactattatggacctgcatccggggtctggaaagacccggcgctacctcccagcgatcgtaagagaagccattaagaggaaattacggacactgatccttgcacccacccgagtggttgctagcgagatggccgaagctctgaagggtatgcctataagatatcaaactaccgcagtcaaatccgagcacacaggcaaggagattgtggatctcatgtgccatgccacgttcactatgcgcttgctgtcaccagtgagggtccccaactacaatatgatcatcatggacgaagcccactttaccgatccttctagcattgctgcgcgtgggtatatcagtacacgggtaggaatgggcgaggcagccgctatattcatgaccgccactccgcccggttccgtggaagcatttccacagagcaacgccgttattcaggacgaggaaagagatatccctgagaggtcttggaactcagggtacgagtggattacagacttccccggaaaaaccgtgtggtttgtcccatccatcaagagtggcaacgatatagctaattgtctccgcaagaacggcaaacgagtgattcagctgagcagaaagacgttcgacactgaatatcagaaaaccaagaacaatgattgggactacgttgtgaccaccgacatctcggagatgggggcgaactttcgggccgatagggtcatcgaccctcgccgttgccttaaacccgtgattctaaaggatggaccagaaagagtaatcctggcaggtccgatgcctgtgactgttgcttctgccgcacagcggaggggccgcattgggcgaaatcataacaaggagggagaccagtacatatatatgggccagcccttgaataacgatgaggaccacgcccactggacagaagctaaaatgttactggataatatcaacaccccagagggtattatccccgccctcttcgaacctgagagagaaaagtccgcggcaatcgacggggagtaccggctgaggggcgaggcccgcaaaacattcgtcgaacttatgagaaggggagatctgccagtgtggctcagctataaggtggcttcagagggctttcaatacagtgaccggcgttggtgcttcgatggggaacgcaataaccaggtcttggaggaaaatatggacgttgagatttggactaaagagggagaacgaaagaaactgagacccaggtggctagatgcccggacgtattctgaccctctggctctccgcgagtttaaggagttcgcagccggtagaaggtccgtgagcggcgaccttatactggagatcgggaagttaccgcagcatttgacccagcgggctcaaaacgccctggataatctcgtaatgctgcacaactcagaacagggaggccgagcatacagacatgcgatggaggagcttccagacacaattgaaactctgatgctcttggccctgatcgctgtgttaaccggtggggtcacactatttttcctgagtggccgcggactcggcaaaaccagcattgggcttctgtgtgtgatggcctcctctgttttgctgtggatggcaagcgtggagccccactggatcgctgcctccataatcctcgaatttttcctgatggtccttctcattcctgagcccgataggcagcggactccacaggacaatcaactggcatatgtagtgatcggattgctgtttatgattttaacggttgccgctaacgagatgggtctactggaaaccacaaagaaagatctcggcatcgggcacgtggcggtcgagaaccatcaccatgccactatgcttgacgtggatctgcaccctgcatcagcttggaccttgtacgccgtcgccacaaccataattactcccatgatgcgtcatacaatcgaaaatacgaccgcaaacatttctctgactgctatcgccaatcaggcggctatactcatgggactggacaagggctggccaatcagtaaaatggatattggtgtgcctcttttagccctggggtgctactcgcaggttaacccgctcacattgaccgcagccgtgctgatgctagtagctcactatgcaatcattggccccggactgcaagccaaggcgaccagagaggctcagaagaggacagccgcaggcatcatgaaaaatccaactgtggacgggatagtcgccattgatctcgaccctgttgtgtacgatgctaagttcgaaaaacagcttggacagatcatgctgttgatcctgtgtacgagccaaattctcctgatgcgcaccacatgggccttatgcgagtccatcactcttgcaaccggccccctgacaaccctctgggagggttctccagggaagttttggaacactacgatagctgtctcaatggccaatattttccggggaagctatctagcgggcgccggtctggcattttccttgatgaaaagtctgggcgggggacgaagaggcacaggggctcagggagaaaccctcggcgagaagtggaagaggcagcttaaccagctgtctaaaagcgagttcaatatctacaagcgctcaggtattatggaggtggaccggtccgaagccaaagaggggttgaagagaggagagactacccgtcacgcagtaagtaggggcacagctaaactgcggtggttcgtggaacgcaacctcgttaagcctgagggtaaggtgatcgacttaggctgtgggcgaggaggctggagctattactgcgccgggctgaaaaaggtcactgaagtgaaaggatataccaagggcggtcccgggcatgaggaaccgataccaatggccacatacggatggaatcttgtcaaactgcactctggcaaggatgtgtttttcacgcctcccgagaaatgtgacaccctactctgcgatatcggcgagtcctcaccaaaccccactattgaagaggggagaacactgagggttttgaagatggtagaaccttggctgcggggaaatcaattttgtatcaagattctcaacccgtacatgcccagcgtggtcgagacccttgagcagatgcagcgcaaacatggtggcatgctggtgagaaatccattatcgaggaactctactcacgaaatgtattgggttagttgcgggacaggaaatatcgtgtccgcggtcaacatgaccagccgaatgctgttgaaccggttcacgatggctcaccgtaagcctacctacgagagagacgtggatctcggcgcaggtacacgccatgtagccgtggaacccgaggttgctaatctggacattatcgggcagaggatagaaaacattaaacacgagcataagtcaacttggcactatgatgaggacaatccttacaaaacctgggcctatcatggatcctacgaagtcaagccatctggcagcgcaagttccatggtgaacggcgtggtcaagctacttacaaaaccctgggatgttatccctatggtgactcaaatcgccatgaccgacacaaccccatttgggcagcagcgggtattcaaggagaaagtggatactagaacgcccaaggctaaacgcggaacagcgcaaattatggaagtcaccgccaggtggctgtggggttttctcagccgaaataagaagccgcggatatgtactagagaggagttcaccaggaaagtgcgctctaacgcagctatcggcgccgtttttgtggacgagaatcagtggaactcagcaaaggaggccgtcgaagacgagcgtttctgggatctggtgcagaaagaacgggagttgcacaagcaggggaaatgcgctacatgcgtatataatatgatgggaaagagagaaaagaaactgggcgagtttggtaaggccaaagggagtagggcgatttggtacatgtggctcggagcacgcttccttgagtttgaagccctgggcttcatgaacgaggaccactggttctcccgagaaaatagcttatctggcgttgagggggagggactgcataagttgggttacatcctccgggatatttcgaaaatccctggcgggaacatgtatgctgacgatacggccggatgggacaccagaataactgaagatgacctgcaaaatgaggcaaagatcacagatattatggaaccagagcacgctctacttgccacctcaatctttaaactgacttaccagaacaaggtggtcagggtgcagcgccccgctaagaatggcacagtgatggacgtcattagcagacgggatcagaggggttccgggcaagttggaacctatggcctcaacacattcactaacatggaagcccagctgatccgtcagatggagagtgagggcatatttttgccttctgaattagagaccccaaatctggcagaacgagtgctcgactggcttgagaaacatggggtagaacgcctgaagagaatggcgattagcggagatgactgtgtggtcaaacccatcgacgatcggttcgccacggctctaaccgccctgaacgacatgggtaaggtgaggaaagatatcccgcagtgggagccttccaagggctggaatgactggcaacaggttcccttttgctcacaccacttccatcagctcattatgaaggatgggcgcgagatagtggtcccatgtagaaaccaggacgaattggtgggacgggcaagggtaagtcaaggcgctggttggtctctgcgagagacagcctgccttgggaaaagctacgcacagatgtggcagctgatgtattttcaccgtagagatctccgcttagccgcgaatgctatctgttccgccgttcctgtggactgggtccccacttcacggaccacatggagcattcatgcacaccatcaatggatgactaccgaagatatgctgtctgtgtggaacagggtttggatcgaggaaaatccatggatggaggacaagacgcacgtgtccagttggggagatgtcccctacttgggcaaaagagaggaccagtggtgcggcagcctgattgggctcacagcccgcgctacctgggcctcgaacatccaggtggcaataaatcaggtacggaggcttatcggaaacgaaaattatctggactacatgacttccatgaagcgattcaaaaacgagggtgatcctgaaggcgctctatggtga

SEQ ID NO: 14062 - RNA, 9879 nt, synthetic construct
  misc_feature 1..9879: note = derived and/or modified CDS sequence (opt3) from DENV-1__EU482532__SS-prME
  source 1..9879: mol_type = other RNA
agcgtgaccatgctgctaatgcttatgcccacagcactggctttccacttgactacgcgaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaagcggaaccggacgatgtggactgttggtgcaatgctaccgatacttgggtgacatatgggacctgtagtcagacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctacgacacggttggaaaacatcatgtggaagcagatttcgaacgagctgaatcatatcctcctggaaaacgacatgaaatttaccgtagtcgtgggcgatgttgcagggattttagctcagggaaagaaaatgatccgccctcagcccatggagtacaagtatagctggaagtcctggggcaaagccaagataatcggggcggacgtgcaaaatactaccttcattatcgatggaccaaacacacctgaatgtcccgacgatcagagagcctggaatatttgggaggtcgaggactacggctttggtatcttcactaccaacatatggctgaaacttagggattcacacacacaggtgtgcgaccaccgtttgatgagtgctgcaattaaggattctaaagccgttcatgctgacatggggtattggatcgaaagcgagaagaatgaaacgtggaagctcgcccgggcatccttcattgaggtgaaaacctgtatctggccaaagtcacacactctgtggagcaacggagtactagaatctgagatgataatccccaaaatttacggcggtcctatctcccagcataattatcgaagtggctactttacacaaaccgcggggccatggcacctgggaaagctcgagctggatttcgacctttgcgaaggcactacagtcgtggtggatgagcactgcgggaacagaggaccgagcttgaggaccacgactgtcaccggcaaaattatccatgaatggtgttgccgctcttgtacactgccccctttacggtttaagggtgaggacgggtgctggtacggaatggagataagaccagttaaggaaaaagaggaaaatctcgtgaagtccatggtatcagccggcagtggtgaggtggacagcttctcgctgggccttctgtgtatttccatcatgatcgaagaggtcatgaggtctcgctggagccgaaaaatgttgatgaccgggactctcgctgtgtttttcctgctaattatgggacagctgacatggaacgatctcatccggctgtgcattatggttggcgccaatgcatcagaccgtatggggatgggaaccacatatcttgctttgatggccacttttaagatgagacccatgttcgcagtgggcctgttatttaggcgcctcaccagtcgggaggtcctgcttctgacgataggtctatccctcgtggcctctgttgaactgcctaacagcttggaggaactgggggatggattagctatgggcatcatgattctcaaactgcttacagacttccagtcccaccaactgtgggcgaccttgctctcactgacttttatcaagaccacattcagcctacattacgcctggaagactatggcaatggtgctgagtattgtctctctttttccactctgtctgtccaccacgagccagaaaacaacctggttgcccgtactgttaggctcgctcgggtgcaagccgctgactatgttccttatcgctgagaataaaatatggggaagaaagtcatggcctctgaacgaaggtatcatggccgtgggcattgtttctatcttgctcagttccctgctcaagaacgatgtgccactggccgggccccttattgctggaggcatgctcatcgcatgttatgtcataagcggttctagcgccgacctgtccttggagaaggcggctgaggtgtcatgggaagaggaagccgagcacagtggggcaagccataatattttagtagaagtgcaggatgacggaacaatgaaaatcaaggatgaggagagggacgataccctgactatcctcctgaaggccacacttctggctgtctctggcgtttaccctttgtccattcccgcaaccctattcgtgtggtatttttggcagaaaaagaaacaacgatcaggcgtgctgtgggacacgccaagtcctcccgaagtcgagcgcgccgtgctcgatgacgggatataccggatcatgcagagaggactgcttggtaggagccaggttggcgtaggggtgttccaggaaaacgtctttcacactatgtggcacgtgacccgtggagcggttttaatgtatcaaggcaagcgcctggagccatcctgggcttctgtgaaaaaggacctcatttcgtacggtgggggatggcggttgcagggcagctggaatacaggcgaggaagtccaggtgatcgccgtagagccggggaagaaccctaaaaatgtccagaccgcacccggaacattcaagacttcagaaggtgaggtgggcgccattgctctggattttaaaccagggacctccggaagtcccatcgttaacagagaaggcaagatagtgggtctctacgggaatggagtcgtgacgacatctggcacttatgttagcgccatcgcacaagctaaagcctcccaggagggccctctgccagagattgaagacgaggtgttcaggaagcgaaaccttaccatcatggatctgcatcccgggtcaggaaagacacggcgctacttgcctgcgattgtcagagaagccatcaaaaggaagctacggaccctgatactcgcaccgactcgagtggtagcttctgagatggccgaggctttaaaaggtatgccaattagatatcagaccacagcagtaaagagcgagcacacgggcaaagagatcgttgacctgatgtgccatgccacttttaccatgcgccttctgagtcccgtcagggtgcctaattacaacatgatcattatggatgaagcccacttcacagacccatccagcatcgctgcgcgtgggtatatatctacccgggtgggaatgggcgaggcagccgctatttttatgactgccacaccccctggttcagtcgaagcattcccgcaatccaatgccgtaatccaggatgaggaaagagacattcccgagaggagttggaacagcgggtacgagtggatcaccgattttccaggaaagacggtgtggttcgttccttcgataaagtctggcaatgacattgctaactgtctccgcaaaaatggcaagcgagtgatccagttgtccagaaaaactttcgatacagaatatcagaagaccaaaaacaacgactgggactacgtcgtgaccactgatatcagcgagatgggggcgaattttcgggccgacagggttattgatccccgccgttgcctgaagccagtgatcctcaaggacggacctgaaagagtcattctggcaggtcccatgccagtgacagtagcttcagccgcacaacggaggggccgcatagggcgaaaccataataaagagggagatcagtacatctatatgggccagccgcttaacaatgacgaggatcacgcccactggaccgaagctaagatgctactggacaacattaatacacctgagggtatcatccccgccttgttcgaaccagagagagagaaaagtgcggcaattgatggggagtaccggttaaggggcgaggcccgcaagacttttgtggaactgatgagaaggggagacctccccgtttggctgtcttataaagtcgcttccgagggcttccagtacagcgatcggcgttggtgctttgacggggaacgcaacaatcaagtgcttgaggaaaacatggatgtggagatatggacgaaggagggagaaaggaaaaagctgagacctagatggctcgacgcccggacctattcagacccattggctctgcgcgagttcaaggaatttgcagccggtagaaggagtgtcagcggcgatctaatcctggagattgggaaactcccccagcatcttacacagcgggctcagaatgccctggacaacttagttatgttgcacaattccgaacaaggaggccgagcatacagacatgcgatggaggagctgcctgatactatcgaaaccctcatgctgcttgccctgattgctgtgctcacaggtggggtaaccttgttctttctgtctggccgcggattaggcaagactagcatcgggctactgtgtgtgatggcctcctcagtcctcctttggatggcatctgtggagccgcactggatagctgccagtatcattctggagttctttttgatggttctgctcatcccagagcccgacaggcagcggacgcctcaggataaccagctggcatatgtggtcattggacttctcttcatgatcctgaccgtagccgctaatgagatgggtttgctggaaacaactaaaaaggacttaggcatagggcacgtggcggccgagaaccatcaccatgcagctatgctagatgttgacctgcaccccgcctcggcctggaccctctacgcagtggctacaaccattatcactccaatgatgcgtcatacaattgaaaacacgaccgccaatatcagccttactgcgatagctaaccaagccgcaatcctgatgggattggataaaggctggcctatttccaagatggacatcggtgtccccctgctcgccctggggtgctactctcaggtgaatccacttacattaaccgctgcagtcctgatgctcgtggcccactatgcgattatcggccctggattgcaggctaaggccaccagagaggcacagaaaaggacagccgctggcataatgaagaacccgactgttgatgggattgtggccatcgacctggatcccgtagtgtacgacgcaaaatttgaaaagcagctaggacagatcatgctgctcattctttgtacgtcacagatcctgttgatgcgcaccacatgggctctgtgcgagagcataactctcgccaccggcccactgacaaccttatgggagggttcccctgggaaattctggaatactacgattgcggtcagtatggccaacatcttccggggatcttatcttgcaggcgctggtctggcctttagcctcatgaagtcactaggcgggggacgaagaggcacaggggcacaaggagaaaccctgggcgagaagtggaaaaggcagttgaatcagctgtccaagagtgagttcaacacttacaaacgcagcggtattatggaggttgaccggtctgaagctaaggaggggctcaaaagaggagagaccacaaagcacgccgtgtcccgtggcactgccaaacttaggtggtttgtcgaacggaatctggtgaaacccgagggtaaggtaatcgatttgggctgtgggcgcggaggctggtcatattactgcgcggggctgaaaaaggtgaccgaagttaaaggatatacaaagggcggtccagggcatgaggaacctatacccatggctacgtacggatggaacctcgtgaaattacacagcggcaaggacgtcttctttatcccgccagagaagtgtgataccctgctttgcgacattggcgagtcgtctcctaatcccactatcgaagaggggcgaacactgagagtgctaaaaatggtcgaaccatggctcaggggaaaccagttctgtattaagatcctgaatccctacatgcctagtgtggttgagaccttggagcaaatgcagcggaaacatggtggcatgctggtacgcaacccgctctccagaaatagcactcacgaaatgtattgggtgtcatgcgggacaggaaacattgtctccgcagtgaatatgacctctaggatgcttctgaaccgatttacgatggcccaccggaagcccacctacgagcgtgatgttgacttaggcgctggtacaagacatgtggccgtcgaaccagaggtggcaaacctggatatcatagggcagcgcattgaaaatatcaaacacgagcataagagcacttggcactatgacgaggataacccttacaagacctgggcctatcatggaagttacgaagtaaaaccctccggcagcgcttcttcaatggtgaatggcgttgtcaagttgctcacaaaaccttgggacgtgatcccaatggtgactcagattgcgatgaccgatacaacccccttcgggcaacagagggtctttaaggagaaagttgacactcggacgcctaaggccaagagaggaacagcacagataatggaagtgaccgctaaatggctgtggggtttcctaagtcgcaacaagaaaccaaggatctgtactcgagaggaatttacccggaaggtaagatccaatgccgcaattggcgccgtgttcgtcgacgagaaccaatggaatagcgctaaagaggccgtggaagatgagaggttttgggaccttgttcaccgcgaacgtgagctgcacaagcaggggaagtgcgcgacatgcgtgtataacatgatgggaaaacgggaaaagaaactcggcgagttcggtaaggcaaaagggtctagagccatctggtacatgtggctgggagctaggttcttggagtttgaagccctgggcttcatgaatgaggatcattggttttcgcgcgaaaactcactcagcggcgtcgagggggagggacttcacaagctgggttacattttacgagacatctccaaaatacccggcgggaatatgtatgcagatgacacggctggatgggatacccggatcactgaagacgatctgcagaacgaggccaagattacagacatcatggaaccggagcatgctttgctcgccaagagtattttcaaactgacctaccagaataaggtggtaagagttcaaaggcctgccaaaaacggcactgtgatggatgtcatctctcgcagagaccagcggggtagcggacaggtgggaacatatggcctaaatacctttacaaacatggaagcgcagcttataaggcaaatggagtccgagggcattttctcaccaagtgaactggagactcccaacctcgccgggcgtgtgctggattggttggaaaagcacggagtcgagcgattaaaacgcatggctatctctggtgacgactgtgttgtgaagcctatcgatgacagatttgccaccgcactgacggctctcaatgatatgggcaaggtacggaaagacattccacagtgggaacccagcaaggggtggaacgattggcaacaggtgccgttctgctcccaccattttcaccaacttataatgaaagacggaagggagatcgtcgtgccttgtcgcaatcaggatgagctggttggcagagcccgggtgtcacagggtgcagggtggagcctaagggaaaccgcctgcctgggaaagtcttacgcgcagatgtggcaactcatgtatttccatcgacgtgacttgagactggctgccaacgcaatttgttccgccgtccccgtggattgggtaccaacaagtcgcactacctggagcatccacgctcatcaccagtggatgacaactgaggacatgctttcggtttggaatcgggtgtggattgaagagaacccttggatggaagataaaacccacatctcctcttggggcgacgtcccctacctgggcaagagggaggaccagtggtgcgggtcactcataggattaacggccagagcaacatgggctaccaatatccaagtggccattaaccaggttcgccggctgatcggtaatgagaactatttggattacatgactagcatgaagaggtttaaaaatgaaagtgacccagagggcgcgctgtggtga

SEQ ID NO: 14063 - RNA, 9879 nt, synthetic construct
  misc_feature 1..9879: note = derived and/or modified CDS sequence (opt3) from DENV-1__EU482533__SS-prME
  source 1..9879: mol_type = other RNA
agcgtgacaatgctgctaatgcttatgcccacagcactggctttccacttgactacgagaggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttatcgtgttgggttctcaggagggggctatgcacactgccctcaccggcgcaacggaaatccaaacctccggaacaactaccattttcgccggccatctgaagtgccgtttaaaaatggataagctgacactaaaagggatgagctatgtcatgtgtactggatcgttcaagctcgagaaggaagtggctgagacccagcacggtacggtcctggtgcagataaaatacgagggcacagacgcgccttgcaagatcccattttctacccaggatgaaaaaggggttactcaaaacggacgccttattacagcaaatcccatcgtgaccgacaaggagaaacctgtaaacatagaagccgagccacccttcggcgagtcctatattgtcatcggtgctggggaaaaggccttgaagctgtcatggtttaaaaagggcagtagcatcggaaaaatgttcgaggcaactgccagaggcgctaggcggatggccattctcggggataccgcatgggactttggatccatcggtggcgtgttcacatctgttgggaagctggtgcatcagatttttggaacggcgtacggcgtccttttcagcggtgtgtcatggaccatgaaaatagggatcggcgtactgttgacttggctcggactgaatagtcgatccactagcttatctatgacctgtattgctgtgggcctggttacactatacctcggggtcatggtgcaggccgattcaggatgcgtgatcaactggaagggccgcgaactgaagtgtggtagtgggatctttgtcactaatgaggttcacacctggacggaacagtataaattccaagcagacagcccgaagagactttccgccgctattggaaaagcctgggaggagggcgtgtgcggtataaggtctgcaacacggttggaaaacatcatgtggaagcagatttcgaacgagctgaatcatatcctcctggaaaacgacatgaaatttaccgtggtagtcggcgatgtggctgggattttagcccagggaaagaaaatgatccgccctcagcccatggagtacaagtatagctggaagtcctggggcaaagcgaagataatcggggccgacgttcaaaatgctactttcattatcgatggaccaaacacccctgaatgtcccgacgatcagagagcatggaatatttgggaggtggaggactacggctttggtatcttcacaactaacatatggctgaaacttagggattcatatacccaggtctgcgaccaccgtttgatgagtgccgctattaaggattctaaagccgtgcacgcagacatggggtactggatcgaaagcgagaagaatgaaacatggaagctcgcgcgggcctccttcattgaggttaaaacgtgtatctggccaaagtcacataccctgtggagcaacggagtgctagaatctgagatgataatccccaaaatttatggcggtcctatctcccagcacaattaccgaccaggctactttactcaaacagctgggccgtggcatctgggaaagctcgagctggatttcgacctttgcgaaggcaccactgtagtcgtggatgagcactgcgggaacagaggacccagtttgaggacaaccacggtgactggcaaaattatccacgaatggtgttgccgcagctgtaccctgcctccattacggtttaagggtgaggacgggtgctggtatggaatggagataagacccgtcaaggaaaaagaggaaaatctcgttaagtctatggtgtccgccggctcaggtgaggtagacagtttcagcctgggccttctgtgtatttcgatcatgatcgaagaggtgatgaggtcccgctggtctcgaaaaatgttgatgacagggaccctcgcagtctttttcctgctaattatgggacagctgacttggaacgatctcatccggctgtgcattatggtgggcgctaatgccagcgaccgtatggggatgggaacaacctaccttgcattgatggccacatttaagatgagacctatgttcgctgttggcctgttatttaggcgcctcacttcacgggaggtgctgcttctgaccataggtctaagtctcgtcgcgtccgtggaactgccaaactctttggaggaactgggggatggattagccatgggcatcatgattctcaaactgcttacggacttccagagccatcaactgtgggcaacattgctctccctgacctttatcaagactaccttctcactacactatgcttggaagacaatggccatggttctgagcattgtgagtctttttcccctctgtctgtctactacctcccagaaaacgacatggttgccggtcctgttaggcagcctcgggtgcaagcctctgaccatgttccttatcgccgagaataaaatatggggaagaaagtcgtggccactgaacgaaggtatcatggctgtaggcattgtgtcaatcttgctctctagtctgctcaagaatgatgttcccctggcagggcctcttattgccggaggcatgctcatcgcgtgttacgtgatatccggtagctctgctgacctgagcttggagaaggccgcagaggtctcctgggaagaggaagccgagcattcaggggctagtcacaatattttagtggaagtacaggatgacggaactatgaaaatcaaggatgaggagagggacgatacactgaccatcctcctgaaggcaactcttctggccgtgagcggcgtctatcccttgtctattccagcgacactattcgtttggtacttttggcagaaaaagaaacaacgatccggcgtgctgtgggacaccccttcacccccagaagtggagcgcgctgtcctcgatgacgggatatatcggatcatgcagagaggactgcttggtaggagtcaggtgggcgttggggtattccaggaaaacgtgtttcatacgatgtggcacgtcactcgtggagccgtgttaatgtaccaaggcaagcgcctggagccgagctgggcatccgttaaaaaggacctcatttcttacggtgggggatggcggttgcagggctcgtggaataccggcgaggaagtgcaggtcatcgccgtggagcctgggaagaaccccaaaaatgtacagacagctccaggaaccttcaagacaagcgaaggtgaggtcggcgccattgcactggattttaaacccgggacttcaggatcccctatcgtgaacagagaaggcaagatagttggtctctatgggaatggagtggtcaccacgagtggcacatacgtgtctgctatcgcccaagcgaaagccagccaggagggcccactgcccgagattgaagacgaggttttcaggaagcgaaaccttactatcatggatctgcaccctgggtccggaaagacccggcgctatttgccggcaattgtgagagaagctatcaaaaggaagctacggacactgatactcgccccaacccgagtcgtggcttcagagatggcagaagccttaaaaggtatgcccattagataccagactaccgccgtaaagtctgagcatacaggcaaagagatcgtggacctgatgtgccacgctacgtttactatgcgccttctgagccctgttagggtcccaaattataacatgatcattatggatgaagcgcatttcaccgaccccagttccatcgcagcccgtgggtacataagcacacgggtgggaatgggcgaggctgccgcaatttttatgaccgccactcctccgggttctgtggaggctttcccccaatcaaatgcggtcatccaggatgaggaaagagacattccagagaggtcctggaacagtgggtatgagtggatcacagattttcctggaaagaccgtatggttcgtgcccagcataaagtcgggcaatgacattgccaactgtctccgcaaaaatggcaagcgagttatccagttgtctagaaaaacgttcgatactgaataccagaagaccaagaacaacgactgggactacgtggtcaccaccgatatctccgagatgggggcaaattttcgggctgacagggtgattgatccacgccgttgcctgaagcctgttatcctcaaggacggacccgaaagagtgattctggccggtccaatgccggtcactgtggcaagcgccgctcaacggaggggccgcatagggcgaaaccacaataaagagggagatcagtatatctacatgggccagcctcttaacaatgacgaggatcatgcccactggacagaagcgaagatgctactggacaacattaatacccccgagggtatcatcccagcattgttcgaacccgagagagaaaaatcagccgctattgatggggagtatcggttaaggggcgaggcccgcaagacatttgtagaactgatgagaaggggagacctccctgtgtggctgagttacaaagttgcttctgagggcttccagtattccgatcggcgttggtgctttgacggggaacgcaacaatcaagtccttgaggaaaacatggatgtggagatatggactaaggagggagaacgaaagaaactgagaccaaggtggctcgacgcacggacgtacagcgaccccttggccctgcgcgagttcaaagaatttgctgccggtagaaggtcagtgagtggcgatctaatcctggagattgggaaactccctcagcaccttacccagcgggcacagaatgcgctggacaacttagtcatgttgcataatagcgaacaaggaggccgagcctatagacacgctatggaggagctgccggatacaatcgaaactctcatgctgcttgccctgattgcagttctcaccggtggggtgacattgttctttctgtccggccgcggattaggcaagacctctatcgggctactgtgtgtaatggctagctccgtgctcctttggatggcctcagtcgagccacattggatagcagcctctatcattctggagttctttttgatggtgctgctcatccccgagcctgacaggcagcggactccccaggataaccagctggcttacgttgtgattggacttctcttcatgatcctgacggtcgcggccaatgagatgggtttgctggaaaccaccaagaaggacttaggcatagggcacgtagcagtggagaaccaccatcacgctgccatgctagatgttgacctgcatccagccagtgcatggactctctacgctgtggccaccacaattatcacccctatgatgcgtcacactattgaaaacacaacggcgaatatctcgcttaccgctatagccaaccaagcagccatcctgatgggattggataaaggctggcccattagcaagatggacatcggtgtcccactgctcgctctggggtgctattcccaggtgaatcctcttactttaacagcagccgtcctgatgctcgtggcgcattacgctattatcggcccgggattgcaggccaaggcaaccagagaggcccagaaaaggaccgctgccggcataatgaagaaccccacagttgatgggattgtggcaatcgacctggatccagtagtgtatgacgctaaatttgaaaagcagctaggacagatcatgctgctcattctttgtacttctcagatcctgttgatgcgcacgacctgggccctgtgcgagtcaataacactcgcgactggccctctgaccacattatgggagggtagccccgggaaattctggaataccactattgccgtctccatggcaaacatcttccggggaagttaccttgctggcgccggtctggcattttctctcatgaaaagcctaggcgggggacgaagaggcacgggggctcaaggagaaacactgggcgagaagtggaaaaggcagttgaatcagctgtcaaagtccgagttcaacacctataaacgcagtggtattatggaggttgaccggagcgaagccaaggaggggctcaaaagaggagagactaccaagcacgccgtgtctcgtggcacagcgaaacttaggtggtttgtcgaacggaatctggtgaaaccagagggtaaggtaatcgatttgggctgtgggcgcggaggctggtcctactattgcgctgggctgaaaaaggtgactgaagttaaaggatacaccaagggcggtcctgggcacgaggaacccataccgatggcaacatacggatggaacctcgtgaaattacattcaggcaaggacgtcttctttatcccacctgagaagtgtgatacgctgctttgcgacattggcgagagctcgcccaatccaaccatcgaagaggggcgaactctgagagtgctaaaaatggtcgaaccctggctcaggggaaaccagttctgtattaagatcctgaatccttatatgccgtctgtggttgagacattggagcaaatgcagcggaaacacggtggcatgctggtacgcaaccccctcagtagaaattccacccatgaaatgtactgggtgagctgcgggactggaaacattgtctcagccgtgaatatgacatccaggatgcttctgaaccgatttaccatggctcaccggaagccaacgtatgagcgtgatgttgacttaggcgccggtaccagacacgtggcagtcgaacctgaggtggccaacctggatatcatagggcagcgcattgaaaatatcaaacatgagcacaagtctacatggcattacgacgaggataacccctataagacttgggcttaccacggaagctatgaagtaaaacctagtggctccgcgagctctatggtgaatggcgttgtcaagttgctcaccaaaccatgggacgtgatccccatggtgacacagattgccatgactgataccacacctttcgggcaacagagggtctttaaggagaaagttgacacccggactccaaaggcaaagagaggaacggctcagataatggaagtgacagccaaatggctgtggggtttcctatcacgcaacaagaaacccaggatctgtacccgagaggaatttactcggaaggtaagaagtaatgcagccattggcgctgtgttcgtcgacgagaaccaatggaactccgccaaagaggcggtggaagatgagaggttttgggaccttgttcatcgcgaacgtgagctgcacaagcaggggaagtgcgcaacctgcgtgtacaacatgatgggaaaacgggaaaagaaactcggcgagttcggtaaggccaaagggagcagagctatctggtacatgtggctgggagccaggttcttggagtttgaagcactgggcttcatgaatgaggatcactggttttctcgcgaaaactcgctctcaggcgtcgagggggagggacttcataagctgggttatattttacgagacatcagcaaaataccgggcgggaatatgtacgctgatgacacagccggatgggatacgcggatcaccgaagacgatctgcagaacgaggctaagattactgacatcatggaacctgagcacgccttgctcgcaaagtccattttcaaactgacatatcagaataaggtggtaagagttcaaaggccagcgaaaaacggcaccgtgatggatgtcatcagtcgcagagaccagcggggttctggacaggtgggaacttacggcctaaatacatttaccaacatggaagcccagcttataaggcaaatggagagcgagggcattttctccccctcagaactggagacacctaacctcgctgggcgtgtgctggattggttggaaaagcatggagtcgagcgattaaaacgcatggccatcagtggtgacgactgtgttgtgaagccaatcgatgacagatttgcaactgctctgaccgccctcaatgatatgggcaaggtacggaaagacattccccagtgggaaccgtctaaggggtggaacgattggcaacaggtgcctttctgcagccaccactttcatcaacttataatgaaagacggaagggagatcgtcgtgccctgtcgcaatcaggatgagctggttggcagagcacgggtgtcccagggtgccgggtggtcactaagggaaacggcgtgcctgggaaagagctatgctcagatgtggcaactcatgtacttccaccgacgtgacttgagactggccgcaaacgccatttgttctgctgtcccagtggattgggtacctacctcccgcacaacttggagtatccatgcccaccatcagtggatgaccacagaggacatgcttagcgtttggaatcgggtgtggattgaagagaacccctggatggaagataaaactcacatctcgtcctggggcgacgtcccatatctgggcaagagggaggaccagtggtgcgggtctctcataggattaaccgcaagagctacgtgggccacaaatatccaagtggcgattaaccaggttcgccggctgatcggtaatgagaactacttggattacatgacctcaatgaagaggtttaaaaatgaaagcgaccccgagggcgctctgtggtga

SEQ ID NO: 14064 - RNA, 9879 nt, synthetic construct
  misc_feature 1..9879: note = derived and/or modified CDS sequence (opt3) from DENV-1__EU482534__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatgctagcgaccgtatggggatgggaacaacctacttggccctgatggcaacattcaaaatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaagcttctgacggactttcaaagccatcagttgtgggccacactcctgtccctaaccttcgtgagaactaccttttcactgcactatgcatggaaaacaatggctatggtccttagcatcgtaagtctcttccccctgtgtttgtctactacctcccagaagacgacatggctgccggtgttactcggcagcctggggtgcaagcctcttaccatgtttctgattgccgagaataaaatctggggaaggaagtcgtggccattgaacgaaggtataatggccgttggcatcgtgtcaattctcctgtctagtctactgaaaaacgatgtcccccttgctgggcctctcatcgcaggaggcatgctgattgcctgttacgtgatctccggtagctctgcggacttgagcttagagaaggctgccgtagtgtcctgggaggaagaggcagaacattcaggggccagtcacaatatactggtcgaggttcaggatgacggaactatgaaaattaaggatgaagagcgagacgatacactcaccatcctgcttaaagctactctgttggcagtgagcggcgtgtatcccctatctatcccagccacactgttcgtctggtacttctggcaaaagaagaaacagcgctccggcgtgctctgggacaccccttcacccccagaggttgaacgggcggtactggatgacgggatttatagaataatgcagaggggacttttaggtcgtagtcaggtgggcgtcggggtgtttcaagagaacgttttccatacgatgtggcacgtgactcgcggagctgtcctgatgtaccagggcaagcggctcgaaccgagctgggcctccgtgaaaaaggacttgatctcttacggtgggggatggagactgcagggctcgtggaataccggcgaggaggtacaggtcattgcagtggaacctgggaaaaaccccaagaatgttcaaacagccccaggaacctttaagacaagcgagggtgaagtgggcgctatcgccctcgatttcaaacccgggacttcaggatcccctattgtcaacagggagggcaagatcgtgggtctgtatgggaatggagttgtgaccacgagtggcacatacgtctctgcaatagctcaggccaaagcgagccaggaaggcccacttcccgagatcgaggacgaagtgtttcgaaagcggaacctgactattatggatttgcaccctgggtccggaaaaacccgcagatatctaccggccatcgtaagggaggcaattaagcggaagctgcgaacactcatcttagctccaaccagagtggttgcctcagaaatggctgaggcactgaaaggtatgcccatacgctaccaaactaccgccgtcaagtctgaacatacaggcaaagagattgtggaccttatgtgccacgccacgttcactatgaggctgctcagccctgtgcgtgtcccaaattataacatgatcatcatggatgaggctcattttaccgaccccagttccattgcggcacgggggtacatcagcacaagagtaggaatgggcgaagccgctgccatattcatgaccgcaactcctccgggttctgtggaggcctttccccagtcaaatgctgttattcaggatgaagagagggacatcccagaacgctcctggaacagtgggtatgagtggattacagatttccctggaaagaccgtgtggtttgtccccagcatcaaatcgggcaatgacatagcgaactgtttgcgaaagaatggcaagagagtgattcagctgtctcggaaaacgttcgatactgagtaccaaaagacaaaaaacaacgactgggactacgttgtgaccaccgatatctccgaaatgggggccaatttcagggcagaccgcgtcatcgatccacgtagatgcctcaagcctgtgattctgaaagacggacccgagcgggtaatccttgctggtccaatgccggtgactgttgccagcgcagcccagaggcgcggccgaattgggagaaaccacaataaggaaggagatcagtatatatacatgggccagcctctaaacaatgacgaggatcatgctcactggacagaggccaagatgctgttggacaacatcaatacccccgaaggtattatcccagcgttatttgagcccgaacgggagaaatcagcagccatcgatggggaatataggctgcgcggcgaggctagaaagacattcgtcgagctcatgaggcggggagacctgcctgtgtggcttagttacaaagtggcctctgaaggctttcaatattccgatcgtcgctggtgcttcgacggggagcgaaacaatcaggtcctggaagagaacatggatgttgaaatttggactaaggagggagagagaaaaaagctcaggccacggtggttggacgctcgcacgtacagcgaccccctggcactaagagaatttaaagagttcgccgctggtaggcggtcagtgagtggcgatctgatactcgaaatcgggaagcttcctcagcacctgacccagcgagcccaaaatgcattagacaacttggtaatgctgcataatagcgagcagggaggcagagcgtatcgccacgccatggaagagctcccggatacaattgagactctgatgcttctggctctcatcgccgtgttgaccggtggggtcacactgtttttcttatccggcaggggactaggcaagacctctattgggctgctctgtgtgatggcaagctccgttcttctgtggatggcttcagtggaaccacattggatcgccgcatctataatcttggagtttttcctgatggtcctcctgattcccgaacctgaccggcagcgtactccccaggataaccaacttgcctacgtagtgatcggactcctgtttatgattttgacggttgctgcgaatgagatgggtctgttagagaccacaaaaaaggacctaggcatcgggcacgtggccgtcgaaaaccaccatcacgcagctatgctggatgtggacctccatccagccagtgcctggactctttacgcagtcgctaccacaataattacccctatgatgagacacactatcgagaacacaacggccaatatttcgctgaccgcgatcgctaaccaggccgcaatattgatgggactggataaaggctggcccatcagcaagatggacattggtgtgccactcctggcccttgggtgctattcccaggttaatcctttaactctgacagctgcagtgctcatgttggtagcccattacgcgatcattggcccgggactgcaagctaaagccaccagggaagcacagaagcgcaccgccgctggcatcatgaagaaccccacagtggatgggatagtcgccattgacctagatccagttgtgtatgacgcaaaattcgagaagcagctgggacagatcatgctccttatcctgtgtacttctcaaattttgctgatgcggacgacctgggctctctgcgaatcaatcacactggccactggccctttaaccacactttgggagggtagccccgggaaattttggaataccactatagcggtctccatggccaacattttccgaggaagttacctggcaggcgctggtctcgccttctctctaatgaagagcctgggcgggggaagaaggggcacgggggcacagggagagacattgggcgaaaaatggaagcgccagctgaatcagctctcaaagtccgagtttaacacctataaacggagtggtatcatggaagtggacagaagcgaggctaaggaagggcttaaacgtggagagactaccaagcacgccgtatctaggggcacagccaaactgcggtggttcgtggagcgcaatttggttaagccagaaggtaaggtgattgatctgggctgtgggcgaggaggctggtcctactattgcgcggggctcaaaaaggtcactgaggtgaaaggatacaccaagggcggtcctgggcacgaagagcccatcccgatggctacatacggatggaacttagtcaaactgcattcaggcaaggacgtgtttttcataccacctgaaaaatgtgatacgcttctgtgcgacatcggcgagagctcgcccaatccaaccattgaggaagggagaactctaagggttctcaagatggtagagccctggctgcggggaaaccaattttgtatcaagattttgaatccttatatgccgtctgtggtcgaaacactggagcagatgcagcgcaaacacggtggcatgctcgtgagaaacccccttagtaggaattccacccatgagatgtactgggttagctgcgggactggaaacatcgtgtcagcagtcaatatgacatcccgaatgctgttaaaccggttcaccatggcccaccgtaagccaacgtatgaaagagatgtggacctgggcgctggtacccgccacgtagccgtggagcctgaagttgcaaacttggatattatcgggcagaggatagagaatattaaacatgaacacaagtctacatggcattacgacgaggataacccctataaaacttgggcctaccacggaagctatgaggtcaagcctagtggctccgctagctctatggtgaatggcgtggtcaagctcctgaccaaaccatgggacgttatccccatggtgacacaaatcgcgatgactgataccacaccttttgggcagcagcgggtattcaaggaaaaagtggacaccagaactccaaaggccaaacgcggaacggcacaaattatggaggtcacagctaagtggctatggggttttctttcaaggaacaagaaaccccgaatatgtacccgggaagagttcactagaaaggtgaggagtaatgccgcaatcggcgccgtttttgtggacgaaaaccagtggaattccgctaaagaggccgtcgaggatgaacgcttctgggacctggtgcatcgtgagcgggaactccacaagcaggggaaatgcgcgacctgcgtatacaacatgatgggaaagagagagaagaaactgggcgaatttggtaaggcaaaagggagcagggccatttggtacatgtggttgggagctcgcttcctggagttcgaggccctcggctttatgaatgaagatcactggttctctcgagagaactcgctttcaggcgttgaaggggagggactgcataagttaggttatatcctgcgggacattagcaaaatcccgggcgggaatatgtacgcagatgacacagctggatgggatacgagaataaccgaggacgatttgcagaacgaagccaagatcactgacattatggagcctgaacacgctctcctggccaaatccatctttaagctaacatatcaaaataaggtggtcagggtgcagcgcccagcaaaaaacggcaccgtgatggatgtcattagtagacgggaccagaggggttctgggcaggttggaacttacggccttaatacattcaccaacatggaggcgcaactgatccgtcagatggaaagcgagggcatattttccccctcagagctcgaaacacctaacctggccgggcgagtgttggattggttagagaagcatggagtagaacgcctgaaaagaatggctattagtggtgacgactgtgtggtcaagccaatcgatgaccggttcgccactgcactcaccgctcttaatgatatgggcaaagtgaggaaggacatcccccagtgggagccgtctaaggggtggaacgattggcagcaagttcctttttgcagccaccacttccatcagctgattatgaaagacggacgcgaaatagtggtcccctgtagaaatcaggatgagctagtgggccgggccagggtatcccagggtgcagggtggtcactgcgagagacggcctgcctcggaaagagctatgcgcaaatgtggcagttgatgtactttcaccgtagagacctgcgccttgctgccaacgcaatctgttctgccgttccagtggattgggtccctacctcccggacaacttggagtattcatgctcaccatcagtggatgaccacagaagacatgctgagcgtgtggaatagggtttggatcgaggaaaacccctggatggaggataaaactcacatttcgtcctggggcgacgtgccatatctcggcaagagagaagaccaatggtgcgggtctttaatcggactgaccgcccgcgcaacgtgggctacaaatatacaggtcgccatcaaccaggtgcggaggttgctgggtaatgagaactacctcgattacatgacctcaatgaaacgattcaagaatgagagcgaccccgaaggcgcgctttggtga

SEQ ID NO: 14065 - RNA, 9879 nt, synthetic construct
  misc_feature 1..9879: note = derived and/or modified CDS sequence (opt3) from DENV-1__EU482535__SS-prME
  source 1..9879: mol_type = other RNA
agcgtgaccatgctgctcatgcttatgcccaccgcactggctttccacttgactacgagaggaggggagcctcatatgatcgtcaccaagcaggaaaggggaaaatccttactgtttaagacatctgccggtgttaatatgtgcactttaattgccatggacctcggagagctgtgtgaagataccatgacatacaaatgcccacggataaccgaggcggaaccggacgatgtggactgttggtgcaatgctactgatacatgggtaacctatgggacgtgttcacagactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggtcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccattgggaaacttgttcatcagatattcggaacggcgtacggcgtgctgttttctggtgtcagctggaccatgaagatcgggattggcgtgttgctcacttggctgggattaaattcacgaagtacatccctgagcatgacctgtatcgctgtaggcctagtgacactctacctgggggttatggtccaggccgattctggatgcgtgatcaactggaaaggccgcgaacttaagtgtggttcagggattttcgtgactaatgaggtccacacctggacggaacaatataagtttcaggcagacagtccgaaaagattgagcgccgctataggaaaggcctgggaggagggcgtttgcggtatcaggtccgcaacacggctggaaaacattatgtggaaacagatctctaacgagctcaatcatattctgttagaaaacgacatgaagttcaccgtggtggtaggcgatgtcgtggggatcctggctcagggcaagaagatgatacgccctcaacccatggagcacaaatactcgtggaaaagctggggcaaggccaaaatcattggggcggacgttcagaatactacctttatcattgatggaccaaacacacctgaatgtcccgacgatcagagagcctggaatatctgggaggtggaggactatggcttcggtatatttactaccaacatttggcttaagatgagggattcctacacacaggtctgcgaccaccgtttgatgtcagctgcaatcaaagatagtaaggccgtgcatgctgacatggggtattggattgaatctgagaaaaatgaaacgtggaagctcgcccgggcatccttcatcgaggttaagacctgtatatggccaaaatcccacactctgtggtcaaacggagtgctagaaagcgagatgatcattcccaagatctacggcggtcctatttctcaacataattatcgaccaggctacttcacacagaccgcggggccgtggcacctgggaaaactcgagctggattttgacctttgcgaaggcactacagtagtcgtggatgagcactgcgggaacagaggaccctccttgaggaccacgactgtgaccggcaagatcatacatgaatggtgttgccgcagttgtacactgcctccattacggttcaaaggtgaggacgggtgctggtacggaatggagattagacccgtcaaggaaaaggaggaaaatctcgttaaaagcatggtgtctgccggctccggtgaggtagactcatttagtctgggccttctgtgtatcagcatcatgattgaagaggtgatgaggtcgcgctggtcccgaaagatgttgatgaccgggactctcgctgtcttcctgctactgatcatgggacagctcacatggaacgatctgattcggctttgcataatggtgggcgccaatgcatctgaccgtatggggatgggaaccacatatttggctctgatggccacttttaaaatgagacctatgttcgcagttggcttactctttaggcgcctgaccagccgggaggtgcttctgctaacgatcggtctctcactggtcgccagtgtggaattgccaaactccctggaggaattaggggatggactcgctatgggcattatgatcctgaaacttctgacagacttccaatctcaccagttgtgggcgaccctcctgagcctaacttttattaaaaccacactgtcccttcattacgcctggaagactatggcaatggttctctcaatcgtgagcctgatacccttgtgtctgagtaccacgtctcagaagacaacctggttaccggtcctcctgggctcccttgggtgcaaacctctgactatgttcttgatcgctgagaataagatttggggaagaaaaagctggccactcaacgaaggtatcatggccgtaggcgtggtttcgattctgctatcatctctgcttaagaacgatgtgcccctcgccgggcctctgatcgctggaggcatgttgatagcatgttatgtcattagtggttccagcgccgacttatctctggagaaagcggctgaggtgagctgggaagaggaagccgagcactccggggcatcacataatatcctcgtagaagtgcaggatgacggaacaatgaagatcaaagatgaggagagggacgataccctgactattcttctgaaggccacattgctagctgtcagtggcgtttaccccctgagcataccagcaaccctctttgtgtggtatttctggcaaaagaaaaagcagcgatctggcgtgctgtgggacacgccttcacccccagaagtcgagcgcgccgtgcttgatgacgggatctaccggattatgcagagaggattactgggtaggagccaggttggcgtaggggtgtttcaagaaaacgtcttccacactatgtggcacgtgacccgtggagcggttctcatgtatcagggcaaacgcttggagccgagttgggctagcgtgaagaaagacctgatctcctacggtgggggatggcggctccagggctcttggaatacaggcgaggaagtccaggtgattgccgtagagcctagaaagaaccccaagaatgtccaaaccgcaccagggacattcaaaactcccgaaggagaggtgggtgccatcgctctggattttaagcctggcacctcggggagcccaatagttaacagggaaggaaaaatcgtgggcctttacggtaatggggtcgtgacgacatcaggaacttatgtttccgccattgcacaggctaaggccagtcaggagggccccctgcctgagatcgaagacgaggtgttccgaaaacggaacttgaccattatggatctacatccgggctctgggaagacacgcagatacctgccagcgatcgtcagggaagccataaagcggaaactccgaaccttaattctggcacccactagagtggtagctagcgagatggccgaagctcttaagggaatgcctatccgctatcaaaccacagcagtgaaatccgagcacacgggtaaggagatcgttgacctgatgtgccatgccacttttaccatgaggctcttgtcaccagtccgtgtgcccaattacaacatgattatcatggatgaagcccacttcacagacccttctagcatagctgcgcggggctatattagtaccagagtggggatgggagaggcagccgctatctttatgactgccacaccgcccggctccgtcgaagcattcccacagagcaatgccgtaattcaggatgaggaaagggacatccctgagcgctcttggaactcaggttacgagtggataaccgattttcccgggaaaacggtgtggttcgttccatccattaagagtggaaatgacatcgctaactgtctgcgaaagaatggcaaaagagtgatccagctcagccggaagacttttgatacagaatatcagaagaccaagaacaacgactgggactacgtcgtgaccactgatatttcggagatgggcgcgaatttcagggccgaccgcgttatcgatcctcgtagatgcctgaaacccgtgattcttaaggacgggccagaacgggtcatactagcaggaccgatgcctgtgacagtagcttctgccgcacagaggcgcggtcgaatcggcagaaaccataataaggagggggatcagtacatttatatgggacagcccctgaacaatgacgaggatcacgcccactggaccgaagctaaaatgttgttagacaacatcaatacaccagagggcatcattcccgccctgtttgaacctgagcgggaaaagtccgcggcaatagatggtgagtacaggctccgcggggaggccagaaaaactttcgtggaactgatgaggcggggcgaccttccagtttggctgagctataaggtcgcttcagagggattccaatacagtgatcgtcgctggtgctttgacggcgaacgaaacaatcaggtgctcgaggaaaacatcgatgtggagatttggacgaaagagggggaaagaaagaaattgaggccccggtggctggacgcccgcacctattctgaccctctagctctgagagagttcaaggaatttgcagccggaaggcggtccgtcagcggtgatctcatccttgagattggcaagctgccgcagcatttaacacagcgagctcaaaatgccttggacaacctggttatgctccacaattcagaacaagggggcagagcataccgccatgcgatggaggagctgccagatactatcgaaacccttatgctgctcgccttgatagctgtgctgacaggcggtgtaaccttattctttctaagtgggaggggcctgggaaaaactagcatcggcctcctttgtgtgatggcctcctctgtcctgttgtggatggcaagcgtggagccccactggattgctgcctccatcattctggagttctttctcatggttctgcttatccctgagcccgaccggcagcgtacgccacaggataaccaactcgcatatgtggtcatagggctgttgttcatgattctgaccgtagccgctaatgagatgggattactagaaacaactaagaaagacctgggtatcggccacgcggccgtggagaaccatcaccatgcaaccatgctcgatgttgaccttcaccctgcttcagcctggacactgtacgccgtggcaaccactattatcacacccatgatgagacatacgatagaaaacaccactgctaatatctctttgacagccattgcgaaccaggctgccatcctgatggggctcgataagggatggccaattagtaaaatggacatcggcgtccctctgcttgcattaggttgctacagccaggtgaatccgctgaccctcaccgccgctgtcttgatgctggtggcacactatgccataattgggcccggcctacaagcgaaggctacaagggaggcccagaagcgcactgcagccggaatcatgaaaaacccaacggttgatggcatcgtggctattgacctggatcctgtagtgtacgacgccaagtttgaaaaacagctcgggcagatcatgcttctgatattgtgtaccagccaaattctgctcatgcggacaacttgggcactgtgcgagtccatcaccttagctacaggaccccttaccactctgtgggagggctctccaggtaagttctggaatacgacaattgccgtctcaatggcgaacatctttcgagggagctatctcgccggagcaggcctagctttctccctgatgaaaagtttgggtggcgggagaaggggaaccggcgcccagggggaaactctgggagagaagtggaagcgccagctcaatcagctttctaaaagcgaatttaacatatacaagcggtcaggcatcatggaggttgacagatccgaagcaaaagagggtctgaagcgtggggagaccacaaggcacgctgtgagtcggggaactgccaaattgcgctggttcgtcgaacgaaatctggtgaagcctgagggcaaggtaattgatctcggttgtggcagagggggatggagctattactgcgccggcctaaagaaggtgaccgaagttaaagggtatacaaagggaggccccggtcatgaggaaccgatcccaatggcgacgtacgggtggaacctggtgaaacttcactctggaaaggacgtcttctttacccctcccgagaaatgtgatactctgctatgcgacattggcgagtcctcaccaaatcccacaatcgaagagggcaggaccctccgggtgctgaagatggtcgaaccttggttgcgcgggaaccaattctgtattaagatcctgaatccgtacatgcccagcgtggttgagactctcgagcagatgcagagaaaacatggaggtatgcttgtaaggaacccactgtcgcgaaattctacacacgaaatgtattgggtgagttgcggcaccgggaacatagtctccgctgtgaatatgacgagccggatgttactgaaccgttttaccatggcacacagaaagcctacatacgagaaagatgttgacttgggagccggcactcgccatgtggctgtcgaacccgaggtggccaacctcgatattatcggtcagaggatcgaaaatattaagcacgagcataaatcaacctggcactatgacgaggataacccttacaagacatgggcatatcatgggtcctacgaagtaaagccatctggaagcgccagttccatggtgaatggcgttgtcaaactgctaactaagccctgggacgtgatacctatggtgacccaaatcgctatgacagataccactccattcggccagcagcgggtctttaaagagaaggttgacacgagaacacccaaagcgaagcgcgggaccgtgcaaattatggaagtaactgccaggtggctttggggattcctgagccgaaacaagaaaccgcggatctgtaccagagaggaatttacaaggaaggtgcgctctaatgcagctattggtgccgtcttcgtggacgagaaccagtggaactcagcaaaagaggccgttgaagatgagcgtttttgggacctcgtgaagaaagaacgggagctgcacaagcagggcaagtgcgctacgtgcgtctataacatgatggggaaaagagaaaagaaattgggagagttcggcaaggccaaaggtagtagggcgatctggtacatgtggctgggggcacgctttctcgagttcgaagcccttggatttatgaatgaggatcactggttctcccgagaaaacagcctgtctggcgtggagggcgaggggttacataagctgggatacatattgcgggacatctcgaaaattcctggtggcaatatgtatgctgatgacaccgccgggtgggatactagaatcacagaagacgatctccagaacgaggcaaagattaccgacatcatggaaccagagcacgctctgctagccacttcaatattcaaacttacataccaaaataaagtagttagggtgcagcgccccgctaagaacggaaccgtcatggatgtgattagcagacgggaccagaggggctccggtcaggtggggacatatggactgaatacttttaccaacatggaagcccaactcatccgtcagatggagagtgagggcatcttcctgccttctgaattggagacgccaaacttagcagaacgagtcctggattggctcgagaaatacggcgttgaacgccttaagagaatggcgattagcggggacgactgtgtggtaaaacccatagatgaccggtttgccaccgctctgacagccctaaatgatatgggaaaggtgaggaaggacatcccgcagtgggagccttccaaaggttggaacgattggcagcaagtccccttctgctcacatcactttcaccagctgattatgaaggacggccgcgagatcgtggttccatgtagaaatcaggatgaactcgtggggcgggcaagggtcagtcagggagctggctggtctttgcgagagactgcctgcctgggtaaaagctatgcacaaatgtggcagcttatgtacttccatcgtagagacctgcgcctcgccgcgaacgctatttgttccgccgtgcctgtaaattgggttcccacctcacggacaacttggagcatccacgcacatcaccagtggatgaccacggaagatatgttatctgtgtggaacagggtctggatagaggaaaatccatggatggaggacaagacacatgtgtccagttggggagatgttccctatctgggaaaaagagaggaccaatggtgcggcagcttgatcggcctgaccgcccgcgctacttgggcctcgaacattcaggtggcaatcaatcaggtccggaggctcattgggaacgaaaattaccttgactacatgacatccatgaagcgatttaagaacgagggagatcctgaaggtgctctgtggtga

SEQ ID NO: 14066 - RNA, 9879 nt, synthetic construct
  misc_feature 1..9879: note = derived and/or modified CDS sequence (opt3) from DENV-1__EU482536__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatgctagcgaccgtatggggatgggaacaacctacttggccctgatggcaacattcaaaatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaagcttctgacggactttcaaagccatcagttgtgggccacactcctgtccctaaccttcatcagaactaccttttcactgcactatgcatggaaaacaatggctatggtgcttagcattgtcagtctcttccccctgtgtttgtctactacctcccagaagacgacatggctgccggtattactcggcagcctggggtgcaagcctcttaccatgtttctgatcgccgagaataaaatatggggaaggaagtcgtggccattgaacgaaggtatcatggccgtgggcattgtttcaatcctcctgtctagtctactgaaaaacgatgtgccccttgctgggcctctcattgcaggaggcatgctgatcgcctgttacgtcatatccggtagctctgcggacttgagcttagagaaggctgccgaggtgtcctgggaagaggaagcagagcattcaggggccagtcacaatattctggtagaagtgcaggatgacggaactatgaaaatcaaggatgaggagcgagacgatatgctcacaatcctgcttaaagctaccctgttggcagtcagcggcgtttatcccctatctattccagccactctgttcgtgtggtacttctggcaaaagaagaaacagcgctccggcgtgctctgggacacaccttcacccccagaagtcgagcgggcggtgctggatgacgggatatatagaatcatgcagaggggacttttaggtcgtagtcaggttggcgtaggggtgtttcaagaaaacgtcttccataccatgtggcacgtgacgcgcggagctgttctgatgtaccagggcaagcggctcgagccgagctgggcctccgtgaaaaaggacttgatttcttacggtgggggatggagactgcagggctcgtggaatactggcgaggaagtccaggtgatcgcagtagagcctgggaaaaaccccaagaatgtccaaaccgccccaggaacatttaagaccagcgaaggtgaggtgggcgctattgccctcgatttcaaacccgggacatcaggatcccctatcgttaacagggaaggcaagatagtgggtctgtatgggaatggagtcgtgactaccagtggcacgtacgtttctgcaatcgctcaggccaaagcgagccaggagggcccacttcccgagattgaagacgaggtgtttcgaaagcggaacctgacaatcatggatttgcaccctgggtccggaaaaactcgcagatatctaccggccattgtcagggaagcaatcaagcggcgactgagaaccctcatattagctccaacacgcgtggtagcctcagagatggctgaagcactgaagggtatgcccattaggtaccaaaccactgccgtgaaatctgagcataccggcaaggagatcgttgaccttatgtgccacgccacattcacgatgcgtctgctcagccctgtccgggtgccaaattataacatgatcattatggatgaagctcattttactgaccccagttccatcgcggcaagagggtacataagcaccagggtgggaatgggcgaggccgctgccattttcatgacagcaacccctccgggttctgtcgaagcctttccccagtcaaatgctgtaatccaggatgaggaacgcgacattccagagcgatcctggaacagtgggtatgagtggatcactgatttccctggaaaaacagtgtggtttgttcccagcataaagtcgggcaatgacattgcgaactgtttgagaaaaaatggcaagcgggtgatccagctgtctaggaagaccttcgatacggaataccaaaaaactaagaacaacgactgggactacgtcgtgacaaccgatatctccgagatgggggccaatttccgcgcagaccgtgttattgatccaagacggtgcctcaaacctgtgatcctgaaggacggacccgaaagggtcattcttgctggtccaatgccggtgaccgtagccagcgcagcccagcgccgaggcagaatagggcggaaccacaataaagagggagatcagtatatctacatgggccagcctctaaacaatgacgaggatcatgctcactggactgaagccaagatgctgttggacaacattaatacacccgagggtatcatcccagcgttatttgaacccgagagggaaaagtcagcagccattgatggggagtatcgcctgagaggcgaggctaggaaaaccttcgtggaactcatgcggcgtggagacctgcctgtttggcttagttacaaggtcgcctctgagggctttcaatattccgatcgccgatggtgcttcgacggggaaagaaacaatcaggtgctggaggaaaacatggatgtggagatatggacaaaagagggagaaaggaagaaactccggccacgctggttggacgctagaacttacagcgaccccctggcactaagggagtttaaggaattcgccgctggtcggcgatcagtcagtggcgatctgatcctcgagattgggaaacttcctcagcacctgacgcagagagcccaaaatgcattagacaacttggttatgctgcataatagcgaacagggaggccgcgcgtataggcacgccatggaggagctcccggataccatcgaaacactgatgcttctggctctcattgccgtgttgactggtggggtaaccctgtttttcttatccggccggggactaggcaagacatctatcgggctgctctgtgtgatggcaagctccgtccttctgtggatggcttcagtggagccacattggatagccgcatctatcattttggaatttttcctgatggttctcctgatccccgagcctgaccgtcagagaaccccccaggataaccaacttgcctacgtggtcattggactcctgtttatgatcttgactgtagctgcgaatgagatgggtctgttagaaacgaccaagaaagacctaggcatagggcacgtggccgttgagaaccaccatcacgcagctatgctggatgtggacctccatccagccagtgcctggacactttacgcagtcgctactaccattatcacacctatgatgaggcacaccattgaaaacactacagccaatatctcgctgacggcgatagctaaccaggccgcaatcttgatgggactggataagggctggcccattagcaaaatggacatcggtgtgccactcctggcccttgggtgctattcccaggtcaatcctttaaccctgactgctgcagtgctcatgttggttgcccattacgcgattatcggcccgggactgcaagctaaggccacacgcgaggcacagaaacggaccgccgctggcataatgaagaaccccaccgtggatgggattgtagccatcgacctagatccagtggtctatgacgcaaagttcgaaaaacagctgggacagatcatgctccttattctgtgtacatctcaaatcttgctgatgcgaactacgtgggctctctgcgagtcaataaccctggccacaggccctttaactaccctttgggagggtagccccgggaagttttggaatacaaccattgcggtttccatggccaacatcttcagaggaagttacctggcaggcgctggtctcgccttctctctaatgaaaagcctgggcgggggaaggcgcggcactggggcacagggagaaacgttgggcgagaagtggaaacggcagctgaatcagctctcaaagtccgaatttaacacatataagagaagtggtattatggaggtggaccgtagcgaagctaaagaggggcttaagaggggagagaccactaaacacgccgtctctcggggcaccgccaagctgcgctggttcgtggaacgaaatttggtaaaaccagagggtaaggtgatcgatctgggctgtgggagaggaggctggtcctactattgcgcggggctcaagaaagttacagaagtgaagggatacactaaaggcggtcctgggcacgaggaacccataccgatggctacctacggatggaacttagtcaagctgcattcaggcaaagacgtgtttttcatcccacctgagaagtgtgatacacttctgtgcgacattggcgagagctcgcccaatccaacgatcgaagaggggaggaccctacgggtcctcaaaatggtggaaccctggctgcgcggaaaccaattttgtattaagatcttgaatccttatatgccgtctgttgtagagactctggagcagatgcagagaaagcacggtggcatgctcgtgaggaacccccttagtcgaaattccacacatgaaatgtactgggtcagctgcgggaccggaaacattgtgtcagcagttaatatgacttcccggatgctgttaaaccgtttcacaatggcccacagaaaaccaacctatgagcgcgatgtggacctgggcgctggtacgaggcacgtcgccgtggaacctgaggtagcaaacttggatatcatagggcagcggattgaaaatatcaagcatgagcacaaatctacctggcattacgacgaggataacccctataagacatgggcctaccacggaagctatgaagtgaaacctagtggctccgctagctctatggttaatggcgtcgtgaagctcctgactaagccatgggacgtgatccccatggtcacccaaattgcgatgacagatactaccccttttgggcagcagagagttttcaaagagaaggtggacacacgcaccccaaaagccaagaggggaactgcacaaataatggaagtaacggctaaatggctatggggttttctttcacgaaacaagaagccccggatctgtacaagagaggaattcaccaggaaagtgcgcagtaatgccgcaattggcgccgtctttgtggacgagaaccagtggaattccgctaaggaggccgttgaagatgagcgtttctgggacctggtgcatcgggaaagagagctccacaaacaggggaagtgcgcgacttgcgtctacaacatgatgggaaaaagggaaaagaagctgggcgagtttggtaaagcaaaggggagccgcgccatctggtacatgtggttgggagctcgattcctggagttcgaagccctcggctttatgaatgaggatcactggttctctcgggaaaactcgctttcaggcgtggagggggagggactgcataaattaggttatattctgagagacatcagcaagataccgggcgggaatatgtacgcagatgacaccgctggatgggatacaaggatcacggaagacgatttgcagaacgaggccaaaattaccgacatcatggaacctgagcacgctctcctggccaagtccatttttaaactaacttatcaaaataaggtagttcgcgtgcagagaccagcaaagaacggcacagtcatggatgtgatcagtcggagggaccagcgtggttctgggcaggtgggaacctacggccttaatactttcacaaacatggaagcgcaactgatacgacagatggagagcgagggcattttttccccctcagaactcgagacccctaacctggccgggcgcgtcttggattggttagaaaaacatggagttgagagactgaagcggatggctatcagtggtgacgactgtgtggtaaaaccaatcgatgacaggttcgccacagcactcactgctcttaatgatatgggcaaggtgcgcaaagacattccccagtgggaaccgtctaaggggtggaacgattggcagcaagtccctttttgcagccaccacttccatcagctgataatgaaggacggaagagagatcgtggttccctgtcggaatcaggatgagctagtgggcagggcccgagtctcccagggtgcagggtggtcactgcgtgaaaccgcctgcctcggaaaaagctatgcgcaaatgtggcagttgatgtactttcacagacgcgacctgcggcttgctgccaacgcaatttgttctgccgtgccagtagattgggttcctacgtccaggaccacatggagtatccatgctcaccatcagtggatgactaccgaggacatgctgagcgtgtggaatagagtctggattgaagagaacccctggatggaagataagacacacgtgtcgtcctggggcgacgttccatatctcggcaaacgcgaggaccaatggtgcgggtctttaatcggactgactgcccgggcaacctgggctacgaatatacaggtggccatcaaccaggtcaggcgattgctgggtaatgagaactacctcgattacatgacatcaatgaagagattcaaaaatgaaagcgaccccgagggcgcgctttggtga

SEQ ID NO: 14067 - RNA, 9879 nt, synthetic construct
  misc_feature 1..9879: note = derived and/or modified CDS sequence (opt3) from DENV-1__EU482537__SS-prME
  source 1..9879: mol_type = other RNA
agcgtgaccatgctgctcatgcttatgcccacagcactggctttccacttgactacgaggggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgtgggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgccacgcggctggaaaacattatgtggaaacagatctctaacgagctcaatcatattctgttagaaaacgacatgaagttcacagtagtcgtgggcgatgttgtggggatcctggcacagggcaaaaagatgatacgccctcaacccatggagcacaaatactcgtggaaaagctggggcaaggctaagatcattggggccgacgtccagaataccacttttatcattgatggaccaaacacccctgaatgtcccgacgatcagagagcgtggaatatctgggaggtggaggactatggcttcggtatatttacaactaacatttggcttaagttgagggattcctacacccaggcctgcgaccaccgtctcatgtcagctgcaatcaaagatagtaaggccgttcatgctgacatggggtattggattgaatctgagaaaaatgaaacatggaagctggcccgggcatccttcatcgaggtgaagacgtgtatatggccaaaatcccacaccctatggtcaaacggagtactggaaagcgagatggtcatccccaagatttacggcggtcctatctctcaacataattatcgaccaggctacttcactcagacagcggggccgtggcacctcggaaaactggagcttgattttgacttgtgcgaaggcaccactgtggtggtcgatgagcactgcgggaacagaggaccctccctgaggacaaccacggttactggcaagattatccatgaatggtgttgccgcagttgtaccttacctccactccggttcaaaggtgaggacgggtgctggtacggaatggagataagacccgtgaaggaaaaggaggaaaatctggtaaaaagcatggtgtctgccggctccggtgaggtcgactcatttagtcttggcctgttgtgtattagcatcatgatcgaagaggtgatgaggtcgcgctggtcccgaaagatgctcatgacagggaccctggctgttttcctactgctcattatgggacagctgacttggaacgatcttatccggttgtgcattatggtgggcgccaatgcatctgaccgtatggggatgggaacaacctatctggctttaatggccacatttaaaatgagacctatgttcgcagtcggcctcctgtttaggcgccttactagccgggaggtgctgctactcaccataggtctgtcattggttgccagtgtggaactgccaaactccttagaggaactcggggatggactggctatgggcatcatgattcttaagctgttgacggacttccaatctcaccagctctgggcgacactgctaagcctgacctttatcaaaactaccctttccctccattacgcctggaagacaatggcaatggtcctgtcaattgtcagcttgttccccctgtgtttaagtactacctctcagaagacgacatggctcccggtgctgcttggctccctggggtgcaaacctttgaccatgtttctcatcgctgagaataagatatggggaagaaaaagctggccactgaacgaaggtatcatggccgttggcgtggtctcgattctactgtcatctcttctcaagaacgatgtgcccctggccgggcctttgatcgctggaggcatgttaattgcatgttatgtaatcagtggttccagcgccgacctgtctctcgagaaagcggctgaggtgagctgggaagaggaagccgagcactccggggcatcacataatatactggtcgaagttcaggatgacggaactatgaagattaaagatgaggagagggacgatacacttaccatcctgttgaaggccactctactggctgtgagtggcgtgtaccccctcagcatcccagcaacactgttcgtctggtatttttggcaaaagaaaaagcagcgatctggcgtgctttgggacaccccttcacccccagaagttgagcgcgccgtattagatgacgggatttaccggataatgcagagaggactgctcggtaggagccaggtgggcgtcggggtgttccaagaaaacgttttccacacgatgtggcacgtgactcgtggagcggtcttgatgtatcagggcaaacgcctggagccgagttgggctagcgtgaagaaagacctcatctcctacggtgggggatggcggctgcagggctcttggaataccggcgaggaagtacaggtcattgccgtggagcctgggaagaaccccaagaatgttcaaacagcaccaggaacctttaaaacacccgaaggtgaggtgggcgccatcgctcttgatttcaagcctgggacttcgggaagcccaattgtcaacagagaaggcaaaatcgtgggtctgtacgggaatggagttgtgaccacgtcaggcacatatgtctccgccatagcacaggctaaggccagtcaggagggccccttgcctgagatcgaagacgaggtgtttaggaaacgaaacctaactattatggatctgcatccggggtctggaaagacccggcgctacctcccagcgatcgtaagagaagccattaagaggaaattacggacactgatccttgcacccacccgagtggttgctagcgagatggccgaagctctgaagggtatgcctataagatatcaaactaccgcagtcaaatccgagcacacaggcaaggagattgtggacctcatgtgccatgccacgttcactatgcgcttgctgtcaccagtgagggtccccaattacaacatgatcatcatggatgaagcccactttaccgacccttctagcattgctgcgcgtgggtatatcagtacacgggtaggaatgggcgaggcagccgctatattcatgaccgccactccgcccggttccgtggaagcatttccacagagcaatgccgttattcaggatgaggaaagagacatccctgagaggtcttggaactcagggtacgagtggattacagatttccccggaaaaaccgtgtggtttgtcccatccatcaagagtggcaatgacatagctaactgtctccgcaagaatggcaaacgagtgattcagctgagcagaaagacgttcgatactgaatatcagaaaaccaagaacaacgactgggactacgttgtgaccaccgatatctcggagatgggggcgaattttcgggccgacagggtcatcgatcctcgccgttgccttaaacccgtgattctaaaggacggaccagaaagagtaatcctggcaggtccgatgcctgtgactgttgcttctgccgcacagcggaggggccgcattgggcgaaaccataataaggagggagatcagtacatatatatgggccagcccttgaacaatgacgaggatcacgcccactggacagaagctaaaatgttactggacaacatcaataccccagagggtattatccccgccctcttcgaacctgagagagaaaagtccgcggcaatcgatggggagtaccggctgaggggcgaggcccgcaaaacattcgtcgaacttatgagaaggggagacctgccagtgtggctcagctataaggtggcttcagagggctttcaatacagtgatcggcgttggtgcttcgacggggaacgcaacaatcaggtcttggaggaaaacatggatgttgagatttggactaaagagggagaacgaaagaaactgagacccaggtggctagacgcccggacgtattctgaccctctggctctccgcgagtttaaggagttcgcagccggtagaaggtccgtgagcggcgatcttatactggagatcgggaagttaccgcagcatttgacccagcgggctcaaaatgccctggacaacctcgtaatgctgcacaattcagaacagggaggccgagcatacagacatgcgatggaggagcttccagatacaattgaaactctgatgctcttggccctgatcgctgtgttaaccggtggggtcacactatttttcctgagtggccgcggactcggcaaaaccagcattgggcttctgtgtgtgatggcctcctctgttttgctgtggatggcaagcgtggagccccactggatcgctgcctccataatcctcgaatttttcctgatggtccttctcattcctgagcccgacaggcagcggactccacaggataaccaactggcatatgtagtgatcggattgctgtttatgattttaacggttgccgctaatgagatgggtctactggaaaccacaaagaaagacctcggcatcgggcacgtggcggtcgagaaccatcaccatgccactatgcttgatgtggacctgcaccctgcatcagcttggaccttgtacgccgtcgccacaaccataattactcccatgatgcgtcatacaatcgaaaacacgaccgcaaatatttctctgactgctatcgccaaccaggcggctatactcatgggactggataagggctggccaatcagtaaaatggacattggtgtgcctcttttagccctggggtgctactcgcaggttaatccgctcacattgaccgcagccgtgctgatgctagtagctcactatgcaatcattggccccggactgcaagccaaggcgaccagagaggctcagaagaggacagccgcaggcatcatgaaaaacccaactgtggatgggatagtcgccattgacctcgatcctgttgtgtacgacgctaagttcgaaaaacagcttggacagatcatgctgttgatcctgtgtacgagccaaattctcctgatgcgcaccacatgggccttatgcgagtccatcactcttgcaaccggccccctgacaaccctctgggagggttctccagggaagttttggaatactacgatagctgtctcaatggccaacattttccggggaagctatctagcgggcgccggtctggcattttccttgatgaaaagtctgggcgggggacgaagaggcacaggggctcagggagaaaccctcggcgagaagtggaagaggcagcttaatcagctgtctaaaagcgagttcaacatctacaagcgctcaggtattatggaggtggaccggtccgaagccaaagaggggttgaagagaggagagactacccgtcacgcagtaagtaggggcacagctaaactgcggtggttcgtggaacgcaatctcgttaagcctgagggtaaggtgatcgatttaggctgtgggcgaggaggctggagctattactgcgccgggctgaaaaaggtcactgaagtgaaaggatataccaagggcggtcccgggcatgaggaaccgataccaatggccacatacggatggaaccttgtcaaactgcactctggcaaggacgtgtttttcacgcctcccgagaaatgtgataccctactctgcgacatcggcgagtcctcaccaaatcccactattgaagaggggagaacactgagggttttgaagatggtagaaccttggctgcggggaaaccaattttgtatcaagattctcaatccgtacatgcccagcgtggtcgagacccttgagcagatgcagcgcaaacatggtggcatgctggtgagaaacccattatcgagaaattctactcacgaaatgtattgggttagttgcgggacaggaaacatcgtgtccgcggtcaatatgaccagccgaatgctgttgaaccggttcacgatggctcaccgtaagcctacctacgagagagatgtggacctcggcgcaggtacacgccatgtagccgtggaacccgaggttgctaacctggatattatcgggcagaggatagaaaatattaaacacgagcataagtcaacttggcactatgacgaggataacccttacaaaacctgggcctatcatggatcctacgaagtcaagccatctggcagcgcaagttccatggtgaatggcgtggtcaagctacttacaaaaccctgggacgttatccctatggtgactcaaatcgccatgaccgatacaaccccatttgggcagcagcgggtattcaaggagaaagtggacactagaacgcccaaggctaaacgcggaacagcgcaaattatggaagtcaccgccaggtggctgtggggttttctcagccgaaacaagaagccgcggatatgtactagagaggagttcaccaggaaagtgcgctctaatgcagctatcggcgccgtttttgtggacgagaaccagtggaactcagcaaaggaggccgtcgaagatgagcgtttctgggacctggtgcagaaagaacgggagttgcacaagcaggggaaatgcgctacatgcgtatataacatgatgggaaagagagaaaagaaactgggcgagtttggtaaggccaaagggagtagggcgatttggtacatgtggctcggagcacgcttccttgagtttgaagccctgggcttcatgaatgaggatcactggttctcccgagaaaacagcttatctggcgttgagggggagggactgcataagttgggttacatcctccgggacatttcgaaaatccctggcgggaatatgtatgctgatgacacggccggatgggataccagaataactgaagacgatctgcaaaacgaggcaaagatcacagacattatggaaccagagcacgctctacttgccacctcaatctttaaactgacttaccagaataaggtggtcagggtgcagcgccccgctaagaacggcacagtgatggatgtcattagcagacgggaccagaggggttccgggcaagttggaacctatggcctcaatacattcactaacatggaagcccagctgatccgtcagatggagagtgagggcatatttttgccttctgaattagagaccccaaacctggcagaacgagtgctcgattggcttgagaaacatggggtagaacgcctgaagagaatggcgattagcggagacgactgtgtggtcaaacccatcgatgaccggttcgccacggctctaaccgccctgaatgatatgggtaaggtgaggaaagacatcccgcagtgggagccttccaagggctggaacgattggcaacaggttcccttttgctcacaccacttccatcagctcattatgaaggacgggcgcgagatagtggtcccatgtagaaatcaggatgaattggtgggacgggcaagggtaagtcaaggcgctggttggtctctgcgagagacagcctgccttgggaaaagctacgcacagatgtggcagctgatgtattttcaccgtagagacctccgcttagccgcgaacgctatctgttccgccgttcctgtggattgggtccccacttcacggaccacatggagcattcatgcacaccatcaatggatgactaccgaagacatgctgtctgtgtggaatagggtttggatcgaggaaaacccatggatggaggataagacgcacgtgtccagttggggagacgtcccctacttgggcaaaagagaggaccagtggtgcggcagcctgattgggctcacagcccgcgctacctgggcctcgaatatccaggtggcaataaaccaggtacggaggcttatcggaaatgaaaactatctggattacatgacttccatgaagcgattcaaaaatgagggtgaccctgaaggcgctctatggtga

SEQ ID NO: 14068 - RNA, 9879 nt, synthetic construct
  misc_feature 1..9879: note = derived and/or modified CDS sequence (opt3) from DENV-1__EU482538__SS-prME
  source 1..9879: mol_type = other RNA
agcgtgaccatgctgctcatgcttatgcccacagcactggctttccacttgactacgcggggcggggagcctcatatgatcgtctccaagcaggaaaggggaaagtctttactgtttaagacctcagccggtgttaatatgtgcacactcattgccatggacctcggcgagttctgtgaagatactatgacctacaagtgcccacggattacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacagagagaaacctgtcaacatagaagccgagccacccttcggcgagtcctatattgtgatcggtgctggggaaaaggccttgaaactgtcatggtttaagaagggcagtagcatcggaaaaatgttcgaggcaaccgccaggggcgctcggcgaatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgctccactagcttatctatgacatgtattgctgttggcctggtcaccctatacctcggggtgatggtgcaggccgattcaggatgcgtcatcaactggaagggcagagaactgaaatgtggtagtgggatctttgttacaaatgaggtgcacacttggaccgaacaatataagttccaggcagacagcccgaagaggctttccgccgctattggaaaagcctgggaggagggcgtgtgcggtatacggtctgcaacgcgcttggaaaacatcatgtggaagcagatttcgaacgagctgaatcatatcctcctggaaaacgacatgaaattaacagtagtcgtgggcgatgttgctgggattctggcccagggaaagaaaatgatcagacctcaacccatggagtacaagtatagctggaaatcctggggcaaggcgaagataatcggggccgacgtgcagaataccacttttattatcgatggaccaaacacccttgaatgtcctgacgatcagagggcttggaatatttgggaggtcgaggactacggcttcggtatctttacaactaacatatggttgaaactccgtgattcatatacccaggtgtgcgaccaccggctgatgagtgcagccattaaggattctaaagctgttcacgccgacatggggtactggatcgaaagcgagaagaatgaaacatggaaactagcacgagcgtccttcattgaggtgaagacgtgtatctggcccaagtcacataccctgtggagcaacggagtactcgaatctgagatgataatcccaaaaatttatggcggtcccatctcccaacacaattacagacctggctacttcactcagacagccgggccatggcatctgggaaaacttgagttggattttgacctgtgcgaaggcaccactgtcgtggtggatgagcactgcgggaacaggggaccgagtttacgcacaaccacggtcactggcaaaattatccacgaatggtgttgccggagctgtaccctaccccctctgagattcaagggtgaggacgggtgctggtatggaatggagataaggccagttaaagaaaaggaggaaaatcttgtgaagtctatggtatccgctggctcaggtgaggtggacagttttagcctgggcttgctctgtatttcgatcatgatcgaagaggtcatgcgctcccgatggtctcggaaaatgctgatgacagggaccctagccgtgttctttctgctcattatgggacagctgacttggaacgatcttatccgtttgtgcattatggttggcgcaaatgctagcgacagaatggggatgggaacaacctacctggccttaatggcaacattcaagatgaggcccatgtttgccgtgggcctcctgttccgccggcttacttcaagagaggtcctgctactcaccataggtctgagtttggtggcttccgttgaactgcctaactctttagaggaactcggggatggactggcgatgggcatcatgattcttaaactgttgacggactttcaaagccatcagctctgggccacactgctatccctgaccttcatcaggactaccttttcacttcactatgcatggaagacaatggctatggtgctcagcattgtcagtctgttcccattgtgtctgtctactacctcccagaaaacgacatggttacccgtactcctgggcagccttgggtgcaagccgctgaccatgtttttgatcgccgagaataagatatggggacgaaaatcgtggcctctcaacgaaggtatcatggccgtgggcattgtttcaatcctgctatctagtctgcttaagaacgatgtgccactcgctgggcccctgattgcaggaggcatgttgatcgcctgttacgtcatatccggtagctctgcggacttaagcctggagaaagctgccgaggtgtcctgggaagaggaagcagagcattcaggggccagtcacaatattctcgtagaagtgcaggatgacggaactatgaagatcaaagatgaggagcgcgacgatacactgaccatccttctgaaggctactttgctagcagtcagcggcgtttatcctctgtctattcccgccacactcttcgtgtggtacttctggcagaagaagaagcagcggtccggcgtgctgtgggacaccccatcacctcccgaagtcgagagagcggtgcttgatgacgggatatataggatcatgcagcgtggattactgggtcgcagtcaggttggcgtaggggtgtttcaagaaaacgtcttccatacgatgtggcacgtgactcggggagctgttctcatgtaccagggcaaaagattggagccaagctgggcctccgtgaagaaagacctgatttcttacggtgggggatggaggctccagggctcgtggaataccggcgaggaagtccaggtgatcgcagtagagccggggaagaaccctaaaaatgtccaaacagcccccggaacctttaagacaagcgaaggtgaggtgggcgctattgccctggatttcaagccagggacttcaggatcccccatcgttaaccgagaaggcaaaatagtgggtctttatgggaatggagtcgtgaccacgagtggcacatacgtttctgcaatcgctcagactaaggccagccaggagggccctctgccagagattgaagacgaggtgtttcggaaacgcaacttgaccatcatggatctacaccccgggtccggaaagacaagaaggtatctgcctgcgattgtccgggaagccatcaaacgaagactccgcaccttaatactggcaccgactagggtggtagcttcagagatggccgaagctcttaagggtatgccaattcgttaccaaaccacagcagtgaagtctgagcatacgggcaaagagatcgttgacctgatgtgccacgccactttcaccatgcggctcttgagccccgtcagagtgcctaattataacatgatcattatggatgaagcccattttacagacccaagttccatcgctgcgagggggtacataagcacccgcgtgggaatgggcgaggcagccgctattttcatgactgccacaccccctggttctgtcgaagcatttccgcagtcaaatgccgtaatccaggatgaggaacgagacattcccgagagatcctggaacagtgggtatgagtggatcaccgatttcccaggaaagacggtgtggtttgttcctagcataaaatcgggcaatgacattgctaactgtctgcggaagaatggcaaaagggtgatccagctctctcgcaagactttcgatacagaataccaaaagaccaaaaacaacgactgggactacgtcgtgaccactgatatctccgagatgggggcgaatttccgtgccgacagagttattgatccccggaggtgcctgaagccagtgatccttaaagacggacctgaacgcgtcattctagcaggtcccatgccagtgacagtagctagcgccgcacagcgaagaggccggatagggaggaaccacaataaggagggagatcagtatatctacatgggccagccgctgaacaatgacgaggatcatgcccactggaccgaagctaaaatgttgttagacaacattaatacacctgagggtatcatccccgccctgtttgaaccagagcgcgaaaagtcagcggcaattgatggggagtatagactcaggggcgaggcccggaagactttcgtggaactgatgcgtcgcggagaccttcccgtttggctgagttacaaagtcgcttctgagggctttcaatattccgatcgaagatggtgcttcgacggggaaaggaacaatcaggtgctcgaggaaaacatggatgtggagatatggacgaaggagggagaacggaaaaagttgcgccctagatggctggacgccaggacctacagcgacccactagctctgcgggagtttaaagagttcgcagccggtcgaagatcagtcagtggcgatctcatccttgagattgggaagctgccccagcacttaacacagcgcgctcaaaatgccttggacaacctggttatgctccataatagcgaacagggaggcagggcatatcggcacgcgatggaggagctgcctgatactatcgaaacccttatgctgctcgccttgattgctgtgctgacaggtggggtaaccttatttttcctatccggccgtggactgggcaaaacttctatcgggctcctttgtgtgatggccagctccgtcctgttgtggatggcatcagtggagccgcattggatagctgcctctatcattctggaatttttcctcatggttctgcttatcccagagcccgacagacagaggacgcctcaggataaccaactcgcatacgtggtcattggactgttgtttatgatcctgaccgtagccgctaatgagatgggtttactagaaacaactaagaaggacctgggcatagggcacgtggcggttgagaaccaccatcacgccgcaatgctcgatgtggaccttcatcccgctagtgcctggaccctgtacgccgtcgcaacaaccattatcactccaatgatgcgccacacaattgaaaacacgaccgctaatatctcgttgactgccatagcgaaccaggctgccatcctgatgggactcgataaaggctggcctattagcaagatggacatcggtgtgcccctgcttgcattagggtgctattcccaggtcaatccactgacactcaccgccgctgtgttgatgctggttgcacattacgccattatcggccctggactacaagcgaaagctacccgggaggcccagaagcgaacagcagccggcataatgaaaaacccgactgtggatgggattgtagctatcgacctggatcccgtggtctatgacgccaagttcgaaaagcagctcggacagatcatgcttctgattttgtgtacgtctcaaatcctgctcatgagaaccacatgggcactgtgcgagtcaataactttagctaccggcccacttacaaccctgtgggagggtagccctgggaaattttggaatactacgattgccgtttccatggcgaacatcttcaggggaagttacctcgccggcgcaggtctagctttctctctgatgaaatcattgggcgggggacgccggggcacaggggcccagggagaaaccctgggcgagaaatggaagagacagctcaatcagcttagcaaatccgaatttaacacttataagcgtagtggtattatggaggtggacaggagcgaagcaaaggaggggctgaaacggggagagaccacaaagcacgctgtctctcgcggcactgccaaattgcgatggttcgtggatagaaatctggtaaagcccgaaggtaaagtgatcgacctcggctgtgggaggggaggctggtcctactattgcgccgggttaaagaaggttaccgaggtgaaaggatacacaaagggcggtccagggcacgaggaacctatacccatggcgacgtacggatggaacctggtcaaacttcattcaggcaaggatgtgtttttcatcccgccagaaaaatgtgacaccctgctatgcgatattggcgagagctcgcctaatcccactatcgaggaagggcggacactccgcgtcctgaagatggtggagccatggttgagaggaaaccaattttgtattaaaatcctgaatccctatatgccttctgttgtagaaaccctcgagcagatgcagaggaagcacggtggcatgcttgtgcgaaacccgctgagtagaaattccactcatgagatgtactgggtcagctgcgggacaggaaacattgtgtcagctgttaatatgacctcccgtatgttactgaacagattcacgatggcacaccgcaagcccacctatgaaagggacgtggatttgggcgccggtacacggcacgtcgctgtggagccagaagtagccaacctcgacatcatagggcagagaattgagaatatcaaacatgaacacaagtctacttggcattacgatgaggacaacccttataaaacctgggcataccacggaagctatgaggtgaagcccagtggctccgccagctctatggttaatggcgtcgtgaaactgctaacaaagccttgggatgtgatcccaatggtcactcaaattgctatgaccgacacaaccccctttgggcagcagcgcgttttcaaggaaaaagtggacactaggacgcctaaggcgaaacgaggaacagcccaaataatggaggtaaccgcaaagtggctttggggttttctgtcacggaacaaaaagccaagaatctgtactagggaagagttcacccgcaaggtgcgtagtaatgctgccattggcgcagtctttgtggatgaaaaccagtggaactccgccaaagaggctgttgaggacgaacggttctgggatctcgtgcatagagagagggaactgcacaagcaggggaaatgcgccacatgcgtctacaacatgatgggaaagcgcgagaaaaagttgggcgaatttggtaaggcgaaagggagccgagcaatctggtacatgtggctgggagcccggttcctcgagttcgaggctcttggctttatgaatgaagaccactggttctctagagagaactcgctgtcaggcgtggaaggggagggattacataagctgggttatattttgagggatatcagcaaaatacccggcgggaatatgtacgccgacgatacggcaggatgggacacccgcatcactgaggatgacctccagaacgaagctaagattacagatatcatggagccggaacacgccctgctagctaaatccatttttaaacttacctatcaaaataaagtagttagagtgcagcggcctgccaagaacggcactgtcatggacgtgatcagtaggcgtgatcagcgaggttctgggcaagtgggaacatacggcctgaataccttcacaaacatggaggcacaactcatacgccagatggaaagcgagggcatattttccccatcagagctggaaactcccaacttggcggggagagtcttagactggctggagaagcatggagttgaacggctcaaaaggatggccatcagtggtgacgattgtgtggtaaagcctatcgacgatcgcttcgctaccgcccttacggcactgaatgacatgggcaaagtgagaaaggatattccacagtgggagccctctaaagggtggaacgactggcagcaagtcccgttttgcagccaccacttccatcagctaataatgaaggatggacgggaaatcgtggttccttgtaggaatcaggacgagctggtgggccgagctcgtgtctcccagggtgccgggtggtcactcagagagaccgcatgcttgggaaagagctatgcccaaatgtggcagctgatgtactttcaccgccgggatcttaggctggcggctaacgccatttgttctgcagtgcccgtagactgggttccaacatccagaactacctggagtatccatgcccaccatcagtggatgacaactgaagatatgctcagcgtgtggaatcgcgtctggattgaggaaaacccttggatggaggacaaaacccacgtgtcgtcctgggaagacgttccctatttaggcaagcgggaggatcaatggtgcggctctctgatcgggttgacggctagggccacatgggcaaccaatatacaggtggctatcaaccaggtccgaagactgctcggaaatgagaactaccttgactacatgacttcaatgaaacggttcaagaatgaaagcgatccagagggtgccctgtggtga

SEQ ID NO: 14069 - RNA, 9879 nt, synthetic construct
  misc_feature 1..9879: note = derived and/or modified CDS sequence (opt3) from DENV-1__EU482539__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgggagagccgtgctggatgacggaatatataggatcatgcagcgtggtcttttaggccgcagccaggttggggtaggagtgtttcaagagaacgtcttccataccatgtggcacgtgacacggggcgcggttctgatgtaccagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtatggaaatggcgtcgtgacaacttcaggcacctacgtttccgccatcgcacaggctaaggccagtcaggaagggccccttcctgagattgaggacgaagtgtttcggaaacgcaacctgacaatcatggatttgcacccgggatctggtaagaccagaaggtatctaccagcgattgtccgggaggccatcaaacgaaagctgagaactctcatattagcacccacccgcgtggtagctagcgaaatggccgaggctctgaagggcatgcctattaggtaccaaacaacggcagtgaaatccgaacatactgggaaggagatcgttgaccttatgtgccacgccaccttcacaatgcgtctgctctcaccagtccgggtgcccaattataacatgatcattatggatgaggcccattttaccgacccttctagcatcgctgcgagaggatacataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatatgagtggatcacggatttccccggcaaaactgtgtggtttgttccatccataaagagtggcaatgacattgctaactgtttgaggaaaaatgggaagcgggtgatccagctgagcaggaagacattcgataccgagtaccagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtatatctacatgggtcagcccctaaacaatgacgaggatcatgcccactggacagaggctaagatgctgttggacaacattaatactccagaagggatcatccccgccttatttgagcctgaaagggagaagtccgcggcaattgatggcgaatatcgcctgagaggagaggccaggaaaacgttcgtggagctcatgcggcgtggcgacctgccagtttggcttagctacaaggtcgcttcagaagggtttcaatatagtgatcgccgatggtgcttcgacggagagagaaacaatcaggtgctggaagagaacatggatgtggaaatatggaccaaagagggtgagaggaagaaactccggccccgctggttggacgccagaacatactctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatataggcacgcgatggaggaactcccagataccatcgagacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggaaccccattggatagctgcctccatcattttggagtttttcctgatggttctcctgatccctgaacccgaccgtcagagaaccccacaggataaccaacttgcatacgtggtcattggtctcctgtttatgatcttgacagtagccgctaatgagatgggcctgttagagactaccaagaaagacctagggataggacacgtggcggttgaaaaccaccatcacgccgcaatgctggatgtggacctccatcctgcttcagcctggacactttacgccgtcgcaaccactattatcacacccatgatgaggcacacgattgagaacaccactgctaatatctctctgacagccatagcgaaccaggctgccatcttgatgggcctggataagggttggccaattagtaaaatggacatcggggtgcctctcctggcacttggctgctattcgcaggtcaatccgttaaccctgaccgccgctgtgctcatgttggttgcacattacgccattatcggacccggcctgcaagcgaaggctacacgcgaagcccagaaacggactgcagccgggataatgaagaacccaacggtggatggaattgtagctatcgacctagatcctgtggtctatgacgccaagttcgagaaacagctgggccagatcatgctccttattctgtgtaccttgcaaatcctgctcatgcgaacaacttgggcactgtgcgaaagcataaccttagctacaggtccccttaccactctgtgggaggggtccccaggaaagttttggaatacgacaattgccgtttctatggcgaacatcttcagaggctcatacctcgccggtgcaggcctagctttcagcctgatgaaatccctagggggaggcaggcgcgggaccggagcccagggcgagactctgggtgaaaagtggaaacggcagctcaatcagcttagtaagtctgagtttaacacctataagagaagcgggattatggaagtggaccgttcagaggcaaaagaaggactgaagaggggcgagacaactaaacacgctgtctcccggggtaccgccaagttgcgctggttcgtggagcgaaatctggtaaaacctgaaggcaaggtgatcgatctcgggtgtggaagaggcgggtggagttactattgcgccggattaaagaaagttacagaggtgaagggctacacgaaaggtgggcccggacacgaggagccgataccaatggcgacctacggctggaacctggtcaaacttcatagcggcaaagacgtgtttttcatccctcccgaaaagtgtgatactctgctatgcgacattggggagtcttccccaaatcccacaatcgaggaaggaaggaccctccgggtcctgaaaatggtggagccttggttgcgcggtaaccaattttgtattaagatcctgaatccgtatatgccctcagttgtagaaactctcgagcagatgcagagaaagcacggcgggatgcttgtgaggaacccactgagccgaaattcgacacatgagatgtactgggtctcttgcggaaccggcaacattgtgagtgctgttaatatgacgtcccggatgttactgaaccgtttcaccatggcacacagaaaacctacatatgaacgcgatgtggacttgggtgccgggactaggcacgtcgctgtggagcccgaagtagccaacctcgatatcataggacagcggattgagaatatcaagcatgaacacaaaagcacctggcattacgacgaggataacccttataagacatgggcataccacggctcatatgaggtgaaaccatccggctctgccagcagtatggttaatggggtcgtgaagctgctaactaagccctgggacgtgatccctatggtcacccaaattgctatgacagataccactccatttggacagcagagagttttcaaagaaaaggtggacacgcgcacacccaaagcgaagaggggtaccgcccaaataatggaggtaactgcaaaatggctttggggctttctgtcccgaaacaagaagccgcggatctgtaccagagaagagttcacaaggaaagtgcgcagcaatgctgccattggggcagtctttgtggacgaaaaccagtggaactctgccaaggaggctgttgaggatgaacgtttctgggacctcgtgcatcgggagagagaactgcacaaacagggaaagtgcgccacgtgcgtctacaacatgatgggcaaaagggagaagaagttgggtgaatttgggaaagcgaagggatcacgcgcaatctggtacatgtggctgggcgcccgattcctcgagttcgaggctcttggctttatgaatgaagatcactggttcagtcgggagaactccctgagcggggtggaaggagagggtttacataaactgggctatattttgagagacatctctaatatacctgggggaaacatgtacgccgatgacaccgcaggctgggatactaggatcacagaggacgatctccagaatgaagctcgcattaccgacatcatggagccagaacacgccctgctagctaagtcgatttttaaacttacttatcaaaacaaggtagttagagtgcagcggcccgccaaaaatggtacagtcatggatgtgatctcaaggcgtgaccagcgagggagcggacaggtgggcacctacggcctgaacacattcactaacatggaggcacaactcatacgccagatggaatccgaggggatttttagtccttctgagctggaaaccccaaatttggcggagagagtcttagattggctggaaaagtatggagttgagcggctcaagaggatggccatcagcggtgacgactgtgtggtaaaacccatcgatgaccgcttcgctacggcccttaccgcactgaacgatatgggcaaggtgagaaaagacattccgcagtgggaaccttccaaggggtggaatgattggcagcaagtccccttttgctcacatcacttccaccagctaataatgaaagacggacgggagatcgtggttccatgtaggaaccaggatgagctggtgggccgagctcgtgtcagtcagggtgccgggtggtctctcagagaaacagcatgcttgggaaagagctacgcccaaatgtggcagctgatgtattttcatcgccgggaccttaggctggcggctaatgccatttgttccgcagtgcctgtagattggatccccacttcaagaaccacatggagcattcacgcccatcaccagtggatgactaccgaggacatgctctctgtttggaaccgcgtgtggatcgaagagaatccatggatggaagataagacgcatatatccagttggggcgacgtcccctacttaggcaaacgggaggaccaatggtgcgggagcctgatcggattgacagctagggccacctgggcaactaacattcaggtggctatcaatcaggttcgaagactgattggtaacgagaattacctcgattatatgacatcgatgaagcggttcaaaaacgaatccgaccctgagggcgccctttggtga

SEQ ID NO: 14070 - RNA, 9879 nt, synthetic construct
  misc_feature 1..9879: note = derived and/or modified CDS sequence (opt3) from DENV-1__KP188539__SS-prME
  source 1..9879: mol_type = other RNA
agcgtgaccatgctgctcatgcttctgcccacagccttggctttccacttaactacgagaggcggggagcctcatatgatcgtctccaagcaggaaagaggcaaatctctgctgtttaagacctcagttggtgtgaacatgtgcacactcattgcaatggacctgggcgagctttgtgaagatactatgacctacaaatgcccacggattacagaggccgaaccggacgatgtagactgttggtgcaatgcgaccgatacttgggtgacatatgggacctgtagtcaaacgggggagcaccgccgagacaagcgtagcgtcgctctggcaccacatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaggaacaagatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctattatcactccccaagcccctacctcagagatccagcttaccgactacggggcgctgacattggactgtagtccaagaaccggactagatttcaacgaaatggtgctgctcactatgaaagaaaagagctggctggtacataaacagtggtttcttgacctgccgttgccctggacatctggcgcctccacgtcacaagagacctggaataggcaggatctcctggttactttcaagacagcacacgctaagaaacaggaagtggtcgtgttaggtagccaagagggggccatgcacaccgctctgacaggcgccactgaaattcagaccagtggaacgaccacaatatttgcaggccatctaaagtgccggctcaaaatggacaagctgactcttaaagggatgtcttatgtcatgtgtaccggatccttcaagttggagaaggaagtggccgagacacagcacggtactgttctggtgcaggtaaaatacgagggcaccgatgctccttgcaagatcccattcctcacgcaagacgaaaaaggggtcacacagaacggacgtctgattaccgcgaatcccatcgtgactgataaggagaaacctgttaacatagaaacagagccaccctttggcgagagctatattgtggtcggtgcaggggaaaaggcccttaagctgtcgtggttcaaaaagggatcttccatcggaaaaatgtttgaggctaccgcccgcggcgcaagaaggatggccatcttgggggacactgcttgggatttcggatcaattggtggcctctttaccagtgtggggaagctgatccatcaggtattcggaacagcctacggcgtgttatttagcggtgtttcctggacgatgaaaattgggataggcatcctgctaacctggctcggactaaattctcggagcacttcacttagtatgacatgtattgcagtcggcatggtgaccttgtacctgggggtgatggtccaggcggactccggatgcgttatcaactggaagggccgagaactcaagtgtggtagcgggatcttcgtgacaaacgaggtgcacacttggaccgaacaatataaatttcaggctgattctccgaagcgcctgtcagccgcaattggaaaagcctgggaggagggcgtatgcggtataagaagtgctacgaggttagaaaatatcatgtggaagcagattagcaacgagctgaattacatccttttggaaaacgacatgaaattcacagtcgtggttggcgacgtgaatgggattctcgcccagggaaagaaaatgatccggcctcaacccatggagcataagtattcctggaagtcttggggcaaagcaaagataatcggggctgatattcagaacaccacttttatcattgacggaccagatacccctgaatgtcccgacgatcagcgcgcctggaatatctgggaggtcgaggactacggcttcggtatatttacaactaacatttggctgaaactaagagattcgcacacccagatgtgcgaccacaggctgatgagcgcggccatcaaggattccaaagctgtgcatgcagacatggggtattggattgaatcagagaagaatgaaacatggaagctcgcccgtgctagtttcatcgaggttaaaacgtgtatatggccaaagtctcacaccctgtggagcaacggagtgcttgaatccgagatggtaatccccaaaatttacggcggtcctatctcacaacataattatcggccaggctacttcactcagacagccgggccgtggcacttgggaaagctggagttagattttgacctctgcgaaggcaccactgtcgtggtggatgagcactgcgggtaccgaggacccagcctgagaacaaccacggtcactggcaaaattatccatgaatggtgttgcaggtcttgtacccttcctccactgcgcttccggggtgaggacgggtgctggtatggaatggagataagacccgttaaggaaaaggaggaaaacttggtgaggtccatggtaagtgcaggcagcggtgagatggactctttttccctcggcattctgtgtgtgtcaatcctaatcgaagaggtcatgcgcagtcgatggagccggaaaatgctgatgacagggaccctcgcggtgttcctgcttttgattatgggacagctgacttggaatgatttaatccgtctctgcattatggttggcgccaacgcttcggacagaatggggatgggaacaacctacctggcccttatggcaacatttaagatgaggcctatgttcgctgtgggcctgctatttcgccggctcacttccagagaggtcctgttgctgaccgtgggtttatctctcgttgccagcgtggaactgccaaattcacttgaggaactgggggatggattggcaatgggcataatgatgctcaaactgctaacggacttccaaccccaccagctgtggacaacccttctcagtctgacttttatcaggacctccttgtctctggattatgcctggaagacaatggctatggcgttaagcattgtctccctcttcccgctgtgtctttcaactaccagccagaaaacgacatggctgcctgtattgctcggcagttttgggtgcaagccactgaccatgttcctaatcactgagaacaagatttggggacgaaaatcttggcccatcaacgaaggtataatggccgtgggcatcgtttccattctgcttagctcgctcctgaaggacgatgtgcctttggcagggcccttaatcgctggaggcatgctgattgcctgttacgtcatctcaggttctagtgccgacctctccctggagaaagctgcagaggtgagctgggaagaggaagccgagcattctgggacaagccacaatatacttgtagaagtgcaggatgacggaaccatgaagattaaagatgaggagcgcgacgatactctgacaatcttgctaaaggcgaccctgctcgctgtctccggcgtttatccaatgtcaatccctgccacgctgtttgtgtggtacttctggcagaaaaagaagcagcggagtggcgtgctttgggacactcccagcccaccggaagtcgagagagcagtgttagacgatgggatttataggatactgcagcgtggactcttgggtcgctctcaggttggcgtaggggtgttccaagacggagtctttcataccatgtggcacgtgacacggggcgccgttctgatgtaccagggtaaaagactcgaaccttcctgggcttcagtgaagaaagatctgatcagttacgggggaggctggaggttccagggcagctggaacaccggggaggaggtccaggtgattgcagtagaacccggaaagaatcccaaaaacgtccaaacaactcccggtacctttaagacgcctgagggcgaagtgggggccatcgcgcttgacttcaagccaggaacatccggctctcccattgttaatcgagagggtaaaatcgtggggctgtatggaaacggcgtcgtgactacctcgggcacatacgttagcgctatagcccaggcaaaggccacccaggaagggcctttgccggagatcgaggatgaagtgtttaaaaagcggaatctaactattatggacctgcacccaggatcaggtaaaacccgcagatatctccccgctatcgtcagggaggccattaagcggaagttacgaacactgatccttgcacctacgagagtggtagcttccgaaatggccgaggcgctgaaaggcatgccaatacgctaccaaactaccgccgtgaagagtgaacatacagggagggagattgttgatctcatgtgccacgcaaccttcactatgcgtttgctgtctcccgtccgggtgcctaactataatatgatcatcatggacgaggctcattttacagatccggccagcattgctgcaagaggatacatctccaccagggtgggcatgggtgaagccgccgctatattcatgacggcgactcccccagggtcagtcgaggcatttcctcagtctaacgccgtaattcaggacgaggaacgcgatatccccgaacgaagctggaatagtggatatgactggattacagacttcccaggcaaaaccgtgtggtttgttccttccatcaagagcggcaacgatatagctaattgtctcaggaaaaacgggaagcgggtgattcagctgtctaggaagaccttcgacactgagtaccagaaaacaaagaataacgattgggactacgtcgtgaccacagatatctcagagatgggagccaacttccgcgcagaccgtgttatcgatcccagacggtgccttaaaccagtgattctaaaggaaggtccggagagggtcatcctggccggccctatgcccgtgactgtagcttccgcggcccagcgccgagggagaattggacggaatcagaacaaagaaggcgaccagtatatatacatgggtcaaccattgaataacgatgaggaccacgcacattggacggaggctaagatgttactggataatatcaacacccccgaagggattatccctgccctctttgagccagaaagggagaagagtgcagccatcgacggcgaatatcgcctgagaggagaggctaggaaaacattcgtggagcttatgcggcgtggcgatctgcccgtttggctcagctacaaggtcgcctcggaagggtttcagtattctgaccgccgatggtgcttcgacggagagagaaataaccaggtgttggaagagaatatggatgtggaaatttggactaaagagggtgagaggaagaaactgcggcctcgctggctagacgcgagaacctactccgatccgctggcactcagggaatttaaggagttcgccgctggccggcgaagcgtctcaagtgaccttatactggaaatcgggaaattaccacagcacttgacactgagagcccaaaacgctctcgataatctggttatgcttcacaactctgagcagggaggcaaggcatatcgccatgccatggaggagctgcccgacaccattgagactctcatgttgctggctttaatcgccgtgctaacgggtggggtaaccctgtttttcctctccggcaagggacttggcaaaacaagcattgggctgttgtgtgtgatggcatcaagtgcgctgctctggatggccagcgtcgaacctcactggatcgctgcctccataatcctggagtttttccttatggtgctcctgattcccgaaccagataggcagcggactcctcaggacaatcaattggcatacgttgtgatcggactgttatttatgattctaaccgtcgctgccaacgagatgggtctgctcgagacaaccaagaaagatcttggcatcgggcatgtagcagtggaaaatcaccaccatgccactatgctggacgttgatttgcgtcccgcttctgcgtggacactgtacgccgtggcaacgaccgtcataactccaatgatgagacacacaattgagaacaccaccgctaacatcagcctcacagccattgccaatcaggcagctatcctgatgggacttgacaagggctggcctatatccaaaatggatatcggtgtgccgttactggccctcgggtgctattcacaggtcaaccccttgactctgacggcggctgtgctaatgctggttgcccattacgcaattatcggcccaggactccaagccaaggctaccagggaagcacagaagcgcacagccgcgggcattatgaaaaatcctactgtggacgggatcgtaaccatagaccttgatcccgtggtctatgacgctaagttcgagaaacagctgggacagattatgttgctgatcctctgtacatctcaaatcctgttaatgcggaccacttgggccctttgcgaaagtattacgctggcaacaggcccactcaccactctatgggagggttcgcctgggaagttttggaacaccacaatcgccgttagcatggctaatatattccgaggatcctacctggccggcgcaggtttggctttctctctgatgaaatcactcggcgggggaagaaggggcactggggcccagggagagacccttggcgaaaagtggaagcgccagctgaaccagttgagcaaatccgagtttaatacatataagaaaagtggtattatggaagtggatcggtctgaggcgaaggaagggctgaaaagaggagagacgaccaagcacgccgtcagccgtggcactgcaaagctcaggtggttcgtggagcggaacttagtaaaacccgaaggtaaggtgatcgacctgggctgtgggcgcggaggctggtcatactattgcgctgggcttaaaaaggttacagaggtgaaaggatacaccaagggcggtccggggcatgaggagccaattcctatggccacttacggatggaatctggtcaaactacactccggcaaggatgtgtttttcacacccccagaaaagtgtgacaccctcctgtgcgatatcggcgagagtagccccaaccctacgatagaggaagggcgaaccttgagagtcctgaaaatggtggagccgtggctcaggggaaatcaattttgtatcaagattcttaacccctatatgccatctgttgtagaaacactggagcagatgcagcggaaacacggtggcatgttagtgcgcaatcctctgtccagaaactcaactcatgagatgtactgggtcagctgcgggaccggaaatatcgtgtcggcagttaacatgacatctaggatgttgctcaatcgattcactatggctcaccggaagcccacctatgaacgtgacgtggatctgggcgccggtacaagacatgtcgccgtggagcctgaagtagcgaacctagacattatcgggcagcgcattgagaacatcaaaaatgaacacaagagtacctggcactacgatgaggacaacccatataagacttgggcttaccatggatcctatgaggtgaaacccagcggctcagcatcctctatggttaatggcgtcgtgaggcttctgacgaagccttgggacgtgataccaatggtcacacaaattgccatgaccgatactaccccctttgggcagcagcgggttttcaaagaaaaggtggacacaagaacgccgcgcgctaaaaggggaaccgcccaaatcatggaggtaactgcaaagtggctctggggttttctgagccgaacaaagaaacctcggatctgtaccagagaagagttcactaggaaggtgcgcagtaacgccgctattggcgcggtctttgtggatgaaaatcagtggaactccgccaaagaggcagttgaggacgaacgtttctgggatttggtgcaccgggagagagaactgcataagcaggggaaatgcgctacatgcgtctacaatatgatgggaaagagggagaagaaactcggcgaatttggtaaggccaaagggagccgcgcaatatggtacatgtggcttggagcccgattcctggagttcgaggctttaggctttatgaacgaagaccactggttctctcgggaaaattcactgagtggcgtggaaggggagggattgcataagctcggttatatcctgagagatatttccaaaatcccaggcgggaacatgtacgccgacgataccgcgggatgggacacaaggattactgaggatgacctacagaatgaagcaaagatcaccgatataatggagcccgaacacgcccttctggctacgagcatctttaaactcacctatcaaaacaaggtagttcgcgtgcagagacctgccaagtctggcacagtcatggacgtgatttcgcggagggaccagcgtggttcaggacaggtgggaacttacggcctgaataccttcacaaacatggaggtccaattgatccgacagatggaaagcgagggcatattttccccaagtgagttagaaactcccaatctggccaaaaaggttctcgattggcttgagaaacacggggctgaacgcctgaagagaatggccatctctggagacgattgtgtggtaaaaccgatagacgatcggttcgctaccgccctaacggcactgaacgacatgggtaaggtgaggaaggatattcctcagtgggagcccagcaaaggctggaacgactggcagcaagtcccattttgctcccatcacttccatcagctcatcatgaaggatgggcgcgaaatcgtggttccttgtagaaatcaggacgagttggtgggacgggcgagggtctcacagggcgccggttggagtctgcgagagacagcttgccttgggaaatcttatgcccaaatgtggcagctgatgtactttcaccgtagagatctccgcttagcagctaacgccatttgtagcgcagtgcccgtagactgggttccaacctcccggactacatggtcaatacacgcccatcaccagtggatgaccactgaagacatgctgagcgtgtggaatagggtctggatcgaggaaaacccctggatggaggataagacccatgtgtcttcctgggaagaggttccttatttgggaaaaagagaggaccaatggtgcggcagtctgattggcctcacagcgcgcgctacgtgggccaccaatatccaggtggcaattaaccaggtccggaggcttatcgggaatgaaaactacctggattacatgactagcatgaagcgattcaagaatgagtcggacccagaaggagccctatggtga

SEQ ID NO: 14071 - RNA, 9879 nt, synthetic construct
  misc_feature 1..9879: note = derived and/or modified CDS sequence (opt3) from DENV-1__KP188540__SS-prME
  source 1..9879: mol_type = other RNA
agcgtgaccatgctgctcatgcttctgcccaccgcattggctttccacttaactacgaggggcggggagcctcatatgatcgtctccaagcaggaaaggggaaaatctctgctatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagggacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctttggtggccctataagccaacataattacagaccagggtatttcacccagactgcgggaccgtggcacctcggcaagctggaacttgattttgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagattcagaggggaagacggatgctggtacggcatggaaatccgccccgttaaggagaaagaagagaatctggtgcgaagtatggtaagcgccggttctggcgaagtggattccttttcacttgggatgctgtgtgtcagtattatgatcgaggaggtgatgcggagccgttggtcgagaaagatgttgatgactggaacactcgctgttttcctgctactgataatgggccagctcacctggaacgacctgattaggctttgcatcatggtgggggccaatgcatccgaccgcatgggaatgggcacaacttacttggctctgatggccacctttaagatgcggcctatgttcgcagtcggtttactctttagaaggctgacgtctcgagaagtgcttctgctaacaatcgggctcagcctggttgcctcagtggagttgccaaacagtctggaagagttaggagatggcctcgctatgggcattatgatgctgaaacttctgaccgagttccaaccccaccagttgtggactaccctcctgtccctaacatttgtcaagactaccctgtctcttgactatgcgtggaaaacgacagccatggtactcagcatcgtgtccctgttcccgttgtgtctgtcaaccactagccagaagacaacctggttacctgttctcctggggagttttggatgcaaaccacttactatgttcctgattacagagaacaagatatggggtcgcaagtcttggcccttgaatgagggcatcatggcaattgggatcgtgtccattctcctgagctcgctactgaaaaacgatgtccctcttgctggacccctcatcgccggcggtatgctgatagcctgttacgtgatctcagggtctagtgctgacttgtccttagaaaaggcagccgaggtaagctgggaacaggaggcggaacattctggagctagccacaatattctggtggaggtccaagatgacggcaccatgaaaatcaaggatgaggaacgggacgatacgctcactattctgcttaaagccaccctgttggcagtttccggcgtgtatccaatgtcaatccctgccacactattcgtgtggtacttttggcagaagaaaaagcagagaagtggggtcctgtgggacacccccagcccaccggaggtggaaagggctgttctcgatgacggaatatatcgtattctgcagcgcggtcttttaggccggtctcaagtaggggtgggagtcttccaggatggcgtgtttcatacaatgtggcacgttactagaggtgcagtgctgatgtaccaggggaagaggctcgagccttcctgggcctcagtcaaaaaggacttgatcagttatggaggcggctggcgattccaggggagctggaacaccggagaggaagtgcaagtaatcgcggtcgagcccggtaaaaatccaaagaacgtgcagacgacacccggcacttttaaaacccctgaaggggaggttggagctattgccctggacttcaagccaggcacatccggttctcccatagtgaatcgggaagggaagatcgtcggactctacggcaacggcgtggttaccacttcggggacctacgtgagcgcaattgcccaggctaaagcctcacaagagggacctctgccggagatcgaaaatgaggtctttaagaaacgcaaccttacaattatggatctgcacccaggttccggcaagacgagaaggtatttgcccgcaatcgtgcgggaagctataaaacgaaagctaagaactctgatcctcgcccctacccgcgtagtggcgagtgagatggccgaagcattaaaggggatgccaattaggtaccagacaaccgctgttaaatctgagcatactggacgtgagatcgtcgacctgatgtgccacgccacattcaccatgcggcttctgagccccgtgagagtgcctaattataacatgattatcatggatgaagctcattttacggacccggcatccatagccgccaggggctacatttcaactcgcgtcggtatgggggaggctgcggcaatcttcatgacagccacacccccaggatctgtagaggcttttcctcagagcaatgccgtgatccaggatgaggaacgagacattcccgagagaagttggaactccggctatgattggatcaccgacttcccaggcaagactgtttggttcgtgcctagcataaaatctgggaatgatattgcaaactgtctccggaagaacggaaaaagggtcatccaattgtcacgcaagacatttgacaccgagtaccagaagaccaaaaataacgattgggactatgtggttactacggacatttccgaaatgggtgccaatttccgtgctgatagagtgatcgacccccggaggtgcctgaagccagtcatactcaaagatggcccggagcgcgtgattctggcggggcctatgcccgtaaccgtggccagtgcagctcagcgaagaggacggatcggcaggaaccagaataaggaaggtgaccaatacgtttacatggggcagccacttaacaatgatgaggaccacgcccattggacagaggcaaaaatgctactggataacatcaatactcccgaaggcattatccctgccttgtttgagccagaacgcgagaaaagcgctgccattgacggagaatatagattaaggggcgaagcgcggaagaccttcgtcgagctgatgcgtcgcggggatctccccgtgtggctgtcgtacaaagtggcatctgaaggatttcagtattccgaccgaagatggtgcttcgatggtgagaggaacaatcaggtccttgaagagaacatggacgttgaaatatggacaaaggagggcgagcggaaaaagctgcgccctagatggctcgatgccaggacctacagcgacccgttggctctgcgggaatttaaagagttcgccgctgggcgaagatcagtgagtggagacctaatcctggaaattggcaagctcccacaacaccttactctgcgcgcacagaatgccttagataacttggtaatgctgcacaattctgagcagggtgggaaggcttataggcatgccatggaggaactccccgacacgatcgagaccctgatgcttctggcactcatcgcggtgttgacaggcggagccactctgtttttcttatccggcaaggggctaggaaagaccagcattggtctgctctgtgtcacagcttcaagtgcccttctgtggatggcaagcgtggaacctcactggatagctgcctccatcattttggagtttttcctgatggttctcctgatccccgaaccagatcggcagcgtacccctcaagacaaccagcttgcatacgtggtcattggcctcctgtttatgatcttgactgtagccgctaacgagatggggctgttagagacaacgaaaaaggatctaggaataggctatgtggcggccgaaaatcatcagcacgcaaccatgctggacgttgatctccaccccgcttctgcctggactctttacgccgtggcaacaaccgtcatcaccccaatgatgagacatacaattgagaacactacggctaatatcagcctgaccgccattgcgaaccaagctgccatcttgatgggtctggacaaagggtggcctatatccaagatggatattggcgtgccgctcctggcacttggatgctactcacaggtcaatcccttaacactgactgccgctgtgctcatgttggttgcacactatgccatcattggcccagggctgcaggcgaaagctaccagggaagcccagaagcgcacagcagccggaatcatgaagaaccctaccgtggacggcatagtagctatcgatctagaccccgtggtctacgatgccaaattcgagaagcaactgggtcagattatgctccttatcctgtgtacttctcagattttgctgatgcggacgacatgggcactctgcgaaagtatcaccctggctactgggccattaaccacactttgggagggatcgcctggcaaattctggaatactaccatagccgttagcatggcgaacatttttcgaggttcctatctggccggcgcagggctcgctttctctctaatgaagtcactgggaggcgggagaaggggaacaggcgcccagggtgagacgttgggggaaaaatggaagcgccaactgaatcagctcagcaagtccgagtttaacacctacaaacggagtggaatcatggaagtggacagatctgaggcaaaggaaggccttaaacgtggtgagactacaaagcatgctgtcagcaggggcaccgccaaactgcggtggttcgtggagcgcaatttggtaaagcccgaagggaaggtgatcgacctgggatgtggccgagggggatggtcatattactgcgccggcctcaaaaaggttactgaggtgaaaggttatacaaaagggggaccgggccacgaggaaccaattcctatggcgacctacggctggaacttagtcaaactgcattccgggaaggatgtgtttttcatgcccccagaaaaatgtgacacgcttctgtgcgatatcggagagagtagccccaatcctaccatagaggaaggtagaacactaagggtcctcaagatggtggagccgtggctgcggggcaaccagttttgtattaagatcttgaatccctacatgccatctgttgtagaaactctggagcagatgcaacgcaaacacgggggaatgctcgtgagaaaccctctttccagaaattcaacccacgagatgtattgggtcagctgcggcacaggtaacattgtgtcggctgttaacatgacttctcgaatgctgttaaatcggttcaccatggcacatcgtaagcccacatacgaaagagacgtggatctgggggccggaacccgccacgtcgctgtggagcctgaagtagccaacttggacatcataggccagaggatcgagaatattaaaaacgaacataagagtacttggcactatgatgaggacaatccatacaaaacgtgggcatatcacggctcctacgaggtgaagcccagcgggtcagcctcctctatggttaacggagtcgtgcggctcctgacaaagccttgggatgtgatcccaatggtcacccagattgctatgactgacaccacaccctttggtcaacagagagttttcaaagaaaaggtggatacgcgcaccccgagggcgaaacgaggcactacacagatcatggaggtaaccgccaagtggctatgggggtttcttagccggaataaaaagcctagaatttgtactagggaagagttcacacgcaaggtgcgtagtaacgcagctatcggagccgtctttgtggacgaaaatcagtggaactccgcaaaagaggccgttgaggacgaacggttctgggatctggtgcatagagagagggaactccacaagcaaggcaaatgcgctacctgcgtctataatatgatgggtaagcgcgagaaaaagctgggggagttcggaaaggccaaaggcagccgagcgatatggtacatgtggttgggcgcacggtttctggagttcgaggccctcgggtttatgaacgaagaccattggttctctagagaaaattcacttagtggagtggaaggtgagggcctgcacaagttagggtacattctgagggatatctccaaaatcccaggaggcaacatgtatgctgacgatacagccggttgggacactcgcattaccgaggatgacttgcagaatgaagcaaagataacggatatcatggagcccgaacatgctctcctggccaccagcatttttaaactaacataccagaacaaggtagttagagtgcagcggcctgctaaaaacgggactgtcatggacgtgatctctaggcgtgatcaacgaggatcgggccaggtgggcacctatgggcttaatacattcactaacatggaggtccagctgattcgccagatggaatcagagggaatctttctcccaagcgagctggaaacccccaatttggccgagagagcattagactggctggaaaagcacggtgcggagcggctcaagaggatggccatatccggcgatgactgtgttgtgaaaccgatcgacgatcgcttcgctacggcccttacagcactgaacgacatggggaaggtaagaaaagatattcctcaatgggaacccagtaagggatggaatgactggcaacaggtgccattttgctctcaccatttccaccagctaatcatgaaagatggccgggagattgtcgtgccttgtaggaaccaagacgagctggttggtcgagctcgtgtgagccagggggccggatggtccctcagagaaaccgcatgcttgggcaagtcatacgcccagatgtggcaactgatgtattttcatcgccgggatcttaggctggcggctaatgccatctgtagtgcagtccccgtggactgggtaccagcctctagaactacatggagcatacacgctcaccatcagtggatgaccactgaggatatgctctccgtttggaaccgcgtgtggattgaagagaatccctggatggaagacaagacccacgtctcaagctgggaggaggtgccttacttaggcaaacgggaagatcagtggtgcgggtctctgatcggattgacagccagggcaacgtgggctaccaacatccaggttgccattaatcaagtgcgaagactgataggtaacgagaattatctcgactacatgacttccatgaagcggttcaaaaacgaaagtgacccagagggcgcgctttggtga

SEQ ID NO: 14072 - RNA, 9879 nt, synthetic construct
  misc_feature 1..9879: note = derived and/or modified CDS sequence (opt3) from DENV-1__KP188541__SS-prME
  source 1..9879: mol_type = other RNA
agcgtgaccatgctgctaatgcttctgcccaccgccttggctttccacttaactacgaggggcggggagcctcatatgatcgtctccaagcaggaaaggggaaaatctctgctatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagggacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctttggtggccctataagccaacataattacagaccagggtatttcacccagactgcgggaccgtggcacctcggcaagctggaacttgattttgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagattcagaggggaagacggatgctggtacggcatggaaatccgccccgttaaggagaaagaagagaatctggtgcgaagtatggtaagcgccggttctggcgaagtggattccttttcacttgggattctgtgtgtcagtatcatgatagaggaggtgatgcggagccgttggtcgagaaagatgttgatgactggaacactcgctgttttcctgctactgattatgggccagctcacctggaacgacctgatcaggctttgcatcatggtgggggccaatgcatccgaccgcatgggaatgggcacaacttacttggctctgatggccacctttaagatgcggcctatgttcgcagtcggtttactctttagaaggctgacgtctcgagaagtgcttctgctaacaattgggctcagcctggttgcctcagtggagttgccaaacagtctggaagagttaggagatggcctcgctatgggcatcatgatgctgaaacttctgaccgagttccaaccccaccagttgtggactaccctcctgtccctaacatttgtcaagactaccctgtctcttgactatgcgtggaaaacgacagccatggtactcagcattgtgtccctgttcccgttgtgtctgtcaaccactagccagaagacaacctggttacctgttctcctggggagttttggatgcaaaccacttactatgttcttcataacagagaacaagatctggggtcgcaagtcttggcccctgaatgagggcattatggcaatcgggattgtgtccatcttgctcagctcgctgctcaagaacgatgtccctctggctggaccccttatagccggcggtatgctcatcgcctgttacgtgatttcagggtctagtgctgacctgtccttggaaaaggcagccgaggtaagctgggaacaggaggcggaacattctggagctagccacaatatcttagtggaggtccaagatgacggcaccatgaaaattaaggatgaggaacgggacgatacgctgactatcctcctgaaagccacccttctggcagtttccggcgtgtatccaatgtcaatacctgccacattgtttgtgtggtacttctggcagaagaaaaagcagagaagtggggtcctatgggacacccccagcccaccggaggtggaaagggctgttctggatgacggaatttatcgtatcctccagcgcggtctgcttggccggtctcaagtaggggtgggagtctttcaggatggcgtgttccatacaatgtggcacgttactagaggtgcagtgttaatgtaccaggggaagaggctggagccttcctgggcctcagtcaaaaaggacctcatcagttatggaggcggctggcgatttcaggggagctggaacaccggagaggaagtgcaagtaattgcggtcgagcccggtaaaaatccaaagaacgtgcagacgacacccggcactttcaaaacccctgaaggggaggttggagctatagccttggactttaagccaggcacatccggttctcccatcgtgaatcgggaagggaagattgtcggactgtacggcaacggcgtggttaccacttcggggacctacgtgagcgcaatcgcccaggctaaagcctcacaagagggacctctcccggagattgaaaatgaggtcttcaagaaacgcaacctgacaatcatggatcttcacccaggttccggcaagacgagaaggtatctgcccgcaatagtgcgggaagctatcaaacgaaagttgagaactctaattctggcccctacccgcgtagtggcgagtgagatggccgaagcactcaaggggatgccaatcaggtaccagacaaccgctgttaaatctgagcatactggacgtgagattgtcgacttaatgtgccacgccacatttaccatgcggctgcttagccccgtgagagtgcctaattataacatgatcataatggatgaagctcatttcacggacccggcatccattgccgccaggggctacatctcaactcgcgtcggtatgggggaggctgcggcaatctttatgacagccacacccccaggatctgtagaggctttccctcagagcaatgccgtgattcaggatgaggaacgagacatccccgagagaagttggaactccggctatgattggataaccgacttcccaggcaagactgtttggtttgtgcctagcattaaatctgggaatgatatcgcaaactgtctgcggaagaacggaaaaagggtcattcaactctcacgcaagacattcgacaccgagtaccagaagaccaaaaataacgattgggactatgtggttactacggacatctccgaaatgggtgccaattttcgtgctgatagagtgatagacccccggaggtgcttgaagccagtcattctgaaagatggcccggagcgcgtgatcctcgcggggcctatgcccgtaaccgtggccagtgcagctcagcgaagaggacggatcggcaggaaccagaataaggaaggtgaccaatacgtttacatggggcagccactgaacaatgatgaggaccacgcccattggacagaggcaaaaatgcttctagataacattaatactcccgaaggcatcattcctgccctgttcgagccagaacgcgagaaaagcgctgccatagacggagaatatagattgaggggcgaagcgcggaagacctttgtcgagttaatgcgtcgcggggatctgcccgtgtggctctcgtacaaagtggcatctgaaggattccagtattccgaccgaagatggtgctttgatggtgagaggaacaatcaggtcctggaagagaacatggacgttgaaatctggacaaaggagggcgagcggaagaaacttcgccctagatggctggatgccaggacctacagcgacccgctcgctttgcgggagttcaaagagtttgccgctgggcgaagatcagtgagtggagacctgattctagaaatcggcaaactgccacaacacctcactcttcgcgcacagaatgccctggataacttagtaatgttgcacaattctgagcagggtgggaaggcttataggcatgccgtggaggaactgcccgacacgatcgagaccctcatgctgcttgcactgattgcggtcctcacaggcggagtgactttgttctttctgtccggcaaggggttaggaaagaccagcataggtctactgtgtgttacagcctcaagtgctctcctttggatggccagcgtggaacctcactggatcgcagcttccattatcctggagttctttttgatggtcctgctcattcccgaaccagatcggcagcgtacccctcaagacaaccagctggcctacgtagtgatcggccttctcttcatgatactgactgttgcagccaacgagatggggttgctggagacaacgaaaaaggatttaggaatcggctatgtggctgcggaaaatcatcagcacgccaccatgctagacgtcgatctgcaccccgcatctgcttggactctctacgccgtggccacaaccgtcattaccccaatgatgagacatacaatcgagaacactacggcaaatattagccttaccgctatcgccaaccaagcggctatactgatgggtttggacaaagggtggcctatttccaagatggatatcggcgtgccgctgctcgccctgggatgctactcacaggttaatccccttacattaactgcagccgtgctgatgctcgtagctcactatgcaattatcggcccagggttgcaggccaaagcgaccagggaagctcagaagcgcacagccgcaggaataatgaagaaccctaccgtggacggcatcgtcgccattgatctggaccccgttgtgtacgatgctaaattcgagaagcaactaggtcagatcatgctgctcattctttgtacttctcagatcctgttgatgcggacgacatgggccctgtgcgaaagtataaccctcgcaactgggccactgaccacattatgggagggatcgcctggcaaattttggaatactaccattgctgtcagcatggccaacatcttccgaggttcctatcttgcgggcgccgggctggcattttctctcatgaagtcactaggaggcgggagaaggggaacaggcgctcagggtgagacgctgggggaaaaatggaagcgccaattgaatcagctgagcaagtccgagttcaacacctacaaacggagtggaatcatggaagtggacagatctgaggccaaggaaggcctcaaacgtggtgagactacaaagcatgcagtaagcaggggcaccgctaaacttcggtggtttgtggagcgcaatctggttaagcccgaagggaaggtgattgacttgggatgtggccgagggggatggtcatattactgcgccggcctgaaaaaggtcactgaggtgaaaggttatacaaaagggggaccgggccacgaggaaccaatccctatggccacctacggctggaacctcgtcaaattacattccgggaaggatgtgttctttatgcccccagaaaaatgtgacacgctgctttgcgatataggagagagtagccccaatcctaccattgaggaaggtagaacactgagggttctaaagatggtagagccgtggctccggggcaaccagttctgtatcaagattctgaatccctacatgccatctgtggtcgaaactttggagcagatgcaacgcaaacacgggggaatgctggtgagaaaccctctctccagaaattcaacccacgagatgtattgggttagctgcggcacaggtaacatcgtgtcggcggtcaacatgacttctcgaatgcttctgaatcggtttaccatggctcatcgtaagcccacatacgaaagagacgtggatttaggggcaggaacccgccacgtagccgtggagcctgaagttgctaacctggacataatcggccagaggattgagaatatcaaaaacgaacataagagtacttggcactatgatgaggacaatccatacaaaacgtgggcctatcacggctcctacgaggtcaagcccagcgggtcagcatcctctatggtgaacggagtggtccggttgctcacaaagccttgggatgttattccaatggtgacccagatcgccatgactgacaccacacccttcggtcaacagagagtatttaaagaaaaggtggatacgcgcaccccgagggctaaacgaggcactacacagattatggaggtcaccgcgaagtggctgtgggggttcctaagccggaataaaaagcctagaatctgtactagggaagagtttacacgcaaggtgcgtagtaacgccgcaataggagctgttttcgtggacgaaaatcagtggaactccgccaaagaggcagtcgaggacgaacggttctgggatcttgtgcatagagagagggaactgcacaagcaaggcaaatgcgcaacctgcgtatataatatgatgggtaagcgcgagaaaaagctcggggaatttggaaaggctaaaggcagccgagccatttggtacatgtggctgggcgcgcggttcttggagtttgaggcactggggttcatgaacgaagaccattggttttctagagaaaattcactcagtggagttgaaggtgagggccttcacaagctggggtacatcttaagggatatctccaaaattccaggaggcaacatgtatgccgacgatacagctggttgggacactcgcataaccgaggatgacctgcagaatgaagccaagatcacggatattatggagcccgaacatgcattgctcgctaccagcatcttcaaactgacataccagaacaaggtggtcagagtgcagcggcctgccaaaaacgggactgtgatggacgtcatttctaggcgtgatcaacgaggatcgggccaggttggcacctatgggctaaatacatttactaacatggaggtgcagcttatccgccagatggaatcagagggaatattcctgccaagcgagctcgaaacccccaatctggctgagagagccttggactggttagaaaagcacggtgcagagcggctgaagaggatggcgatctccggcgatgactgtgtagtgaaaccgattgacgatcgctttgccacggctctcacagcccttaacgacatggggaaggtcagaaaagatatccctcaatgggaacccagtaagggatggaatgactggcaacaggtgccattctgctctcaccattttcaccagctgattatgaaagatggccgggagatcgttgtgccttgtaggaaccaagacgagctagtcggtcgagcacgtgtgagccagggggctggatggtccctgagagaaaccgcctgcctcggcaagtcatacgcacagatgtggcaattgatgtatttccatcgccgggatctgaggcttgccgcgaatgctatatgtagtgccgtacccgttgactgggtgccagcatctagaactacatggagcattcacgcccaccatcagtggatgaccactgaggatatgctgtccgtctggaaccgcgtgtggatcgaagagaatccctggatggaagacaagacccacgtttcaagctgggaggaggtgccttacctcggcaaacgggaagatcagtggtgcgggtctttaatcggactgacagctagggccacgtgggcaaccaacattcaggtcgctataaatcaagtgcgaagattgatcggtaacgagaattatctggactacatgacttccatgaagcggtttaaaaacgaaagtgacccagagggcgccctctggtga

SEQ ID NO: 14073 - RNA, 9879 nt, synthetic construct
  misc_feature 1..9879: note = derived and/or modified CDS sequence (opt3) from DENV-1__KP188543__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggtagaaccggacgatgtggactgttggtgcaatgccaccgatacttgggtcacatatgggacctgtagtcaaacgggagagcaccgccgagacaagcgtagcgtggcgctggctccccatgttggcttgggtctcgagactagaaccgaaacatggatgtcctctgagggggcctggaaacagatccagaaggtggaaacttgggcactgaggcaccctggattcaccgtcattgccctgtttctcgctcatgcaatcggcacatcgattacccagaagggcatcatattcatcttactgatgcttgtgacgccatcaatggccatgcggtgcgtagggattggaaaccgcgattttgttgagggtttgagcggcgctacttgggtggacgtcgtgctggagcacgggagttgtgtgacaaccatggccaaaaataagcccactctagatatcgaactcctgaaaacagaggtcaccaaccctgcggttcttagaaagctgtgcattgaagcaaaaatctccaatacgaccacagactctaggtgtccaactcaaggagaggccaccttggtggaagagcaggatgctaacttcgtatgccggcgcacatttgtggaccgaggctggggtaatgggtgtggactcttcggcaagggcagcctgttaacttgcgccaagtttaaatgcgtcaccaagctggaggggaaaatagtgcagtacgaaaacctcaagtattccgttattgtgacagtccacaccggagatcagcatcaagtgggtaatgagactacggaacacggcacaatcgcaaccattactccccaggctcctacctcagagatccagcttacagactacggggccctgaccttggactgtagtccaagaactggactagatttcaacgaaatggtactgctcacaatgaaagagaagagctggctggttcataaacagtggtttcttgacctgccgttgccctggacgtctggcgcgtccacctcacaagagacttggaataggcaggatctcctggtgacattcaagaccgcccacgcaaagaaacaggaagtcgtggtcttaggtagccaagagggggctatgcacacagccctgactggcgctaccgaaatccagacgagtggaaccacaactatttttgccggccatctaaagtgccggctcaaaatggacaagctgacccttaaagggatgtcttatgtgatgtgtacaggatccttcaagttggagaaggaagttgcagagactcagcacggtaccgtgctggtacaggtcaaatacgagggcacggatgccccttgcaagataccattcctcacacaagacgaaaaaggggtgacccagaacggacgtctgatcactgctaatcccattgttacagataaggagaaacctgtgaacatcgaaaccgagccaccctttggcgagagctatatagtcgtgggtgcgggggaaaaggcacttaagctgtcgtggttcaaaaagggctcttccattggaaaaatgtttgaggccactgctcgcggcgccagaaggatggcaatcttgggggacaccgcctgggatttcggatcaatcggtggcctctttacaagtgtagggaagctgattcatcaggtgttcggaacggcttacggcgttttatttagcggtgtctcctggaccatgaaaatcgggattggcatactgctaacttggctcggactgaattctcggagcacatcacttagtatgacctgtatcgccgtgggcatggtgacattgtacctgggggtcatggttcaggcagactccggatgcgtgattaactggaagggccgagaactcaagtgtggtagcgggatcttcgtgactaacgaggtacacacctggacggaacaatataaatttcaggcggattctccgaagcgcctgtcagctgccatcggaaaagcatgggaggagggcgtctgcggtattagaagtgccacaaggttagaaaatataatgtggaagcagatcagcaacgagctgaattacattcttttggaaaacgacatgaaattcaccgtggttgtgggcgacgtcaatgggatcctcgctcagggaaagaaaatgattcggcctcaacccatggagcataagtattcctggaagtcttggggcaaagccaagatcataggggcagatatccagaacactacctttattatcgacggaccagatacacctgaatgtcccgacgatcagcgcgcttggaatatttgggaggtggaggactacggcttcggtatctttactaccaacatatggctgaaactaagagattcgcacacacagatgtgcgaccacaggctgatgagcgccgcgattaaggattccaaagccgttcatgctgacatggggtattggatcgaatcagagaagaatgaaacgtggaagctcgcacgtgccagtttcattgaggtgaaaacctgtatctggccaaagtctcacactctgtggagcaacggagtacttgaatccgagatggtcatacccaaaatctacggcggtcctatttcacaacataattatcggccaggctacttcacacagaccgctgggccgtggcacttgggaaagctggagttagattttgacctctgcgaaggcactacagtggtggtcgatgagcactgcgggtaccgaggacccagcctgagaaccacgactgttaccggcaaaatcattcatgaatggtgttgcaggtcttgtacacttcctccactgcgcttccggggtgaggacgggtgctggtatggaatggagatcagacccgtgaaggaaaaggaggaaaacttggtaaggtccatggtgagtgccggcagcggtgagatggactctttttccctcggcatactgtgtgtctcaattctaatcgaagaggtgatgcgcagtcgatggagccggaaaatgctgatgaccgggactctcgcagttttcctgcttttgatcatgggacagctgacatggaatgatttaattcgtctctgcatcatggtgggcgcgaacgcctcggacagaatggggatgggaaccacatacctggctcttatggccacttttaagatgaggcctatgttcgcagtcggcctgctatttcgccggctcacctccagagaggtgctgttgctgacggttggtttatctctcgtggctagcgtcgaactgccaaattcacttgaggaactgggggatggattggccatgggcattatgatgctcaaactgctaacagacttccaaccccaccagctgtggaccactcttctcagtctgacctttataaggacatccttgtctctggattatgcatggaagactatggccatggctttaagcatcgtatccctcttcccgctgtgtctttcaaccacgagccagaaaacaacctggctgcctgtgttgctcggcagttttgggtgcaagccactgactatgttcctaattacagagaacaagatctggggacgaaaatcttggcccattaacgaaggtatcatggcggttggcatagtgtccatcctgcttagctcgctcctgaagaatgacgtccctttggccgggcccttaattgcaggaggcatgctgatcgcttgttacgtgatttcaggttctagtgccgatctctccctggagaaagccgctgaggtaagctgggaagaggaagcagagcattctgggaccagccacaacatccttgtggaagtccaggacgatggaactatgaagataaaagacgaggagcgcgatgacacactgaccattttgctaaaggccacgctgctcgcggtttccggcgtgtatccaatgtcaatccctgctactctgtttgtgtggtacttctggcaaaaaaagaagcagcggagtggcgtcctttgggatacccccagcccaccggaagtggagagagccgttttagacgacgggatctataggattctgcagcgtggactcttgggtcgctctcaggtaggcgtgggggtcttccaagatggagtgtttcatacaatgtggcacgttacccggggcgcagtgctgatgtaccagggtaaaagactcgaaccttcctgggcctcagtcaagaaagacctgataagttacgggggaggctggaggttccagggcagctggaatacaggggaggaggtgcaggtaatcgctgtcgaacccggaaagaacccaaaaaatgtgcaaactacccccggtacgtttaagacacctgagggcgaagttggggcaattgcccttgatttcaagccaggaacttccggctctcccatcgtgaaccgagagggtaaaattgtcgggctgtatggaaatggcgtggttaccacatcgggcacctacgtgagcgcgatcgctcaggccaaggcaactcaggaagggcctttgccggagatagaggacgaagtctttaaaaagcggaacctaaccatcatggatctgcacccaggatcaggtaaaacacgcagatatctccccgccattgtgagggaggctatcaagcggaagttacgaacgctgattcttgcccctactagagtagtggcatccgaaatggctgaggccctgaaaggcatgccaatccgctaccaaaccacagcggttaagagtgaacataccgggagggagatagtcgacctcatgtgccacgccactttcacaatgcgtttgctgtctcccgtgcgggtgcctaattataacatgattatcatggatgaggcacattttaccgacccggctagcatcgccgctagaggatacatttccacgagggtcggcatgggtgaagcagccgccatcttcatgactgctacacccccagggtcagtagaggcgtttcctcagtctaatgcagtgatacaggatgaagagcgcgacattcccgaacgaagctggaacagtggatatgattggatcaccgacttcccaggcaaaaccgtttggtttgtgccttccattaagagcggcaatgacatcgccaactgtctcagaaaaaatgggaagcgggtcatacagctgtctaggaagactttcgatacagagtaccaaaaaaccaagaacaacgactgggattacgtggttacaactgacatttcagagatgggagctaatttccgcgccgatcgtgtgatcgaccccagacggtgccttaaaccagtcatcctaaaggaaggtccggagagggtgattctggcaggccctatgcccgtaacggtggcctccgctgcgcagcgccgagggagaatcggacggaaccagaataaagaaggcgatcagtatatttacatgggtcaaccattgaacaatgacgaggatcacgcccattggaccgaggcaaagatgttactggacaacataaatacacccgaagggatcattcctgctctctttgagccagaaagggagaagagtgccgcaatcgatggcgaatatcgcctgagaggagaggccaggaaaactttcgttgagcttatgcggcgtggcgacctgcccgtctggctcagctacaaggtggcttcggaagggtttcagtattctgatcgccgatggtgcttcgacggagagagaaacaatcaggtgttggaagagaacatggacgtcgaaatctggaccaaagagggtgagaggaagaaactgcggcctcgctggctagatgccagaacatactccgacccgctggcgctcagggaatttaaggagttcgcagccggccggcgaagcgtttcaggggatcttattctggaaataggaaaattaccacagcacttgaccctgagagctcaaaatgccctcgacaacctggtgatgcttcacaatagtgagcagggcggtaaggcttatcgccatgcaatggaagagctgcccgatactatcgagacgctcatgttgctggccttaattgctgtactaaccgggggcgtgacactgtttttcctctctggaaagggccttgggaaaacttccatcggactgttgtgtgtcatggccagctcagcactgctctggatggcgagtgtggaacctcactggattgccgctagcatcatactggagtttttccttatggttctcctgatccccgaaccagacaggcagcggacccctcaggataaccaattggcctacgtggtcattggtctgttatttatgatcctaacagtagcagctaatgagatgggcctgctcgagaccactaagaaagaccttgggattggacatgtggccgttgaaaaccaccaccatgcaacaatgctggatgtggacttgcgtcccgcctccgcttggacgctgtacgcggtcgccaccactgtgatcacaccaatgatgagacacaccatagagaacaccacagcaaatatttctctcactgctatcgccaaccaggccgcaattctgatgggccttgataagggttggcctatcagcaaaatggacataggggtcccgttactggctctcggctgctattcccaggtgaatcccttgacgctgaccgccgcggttctaatgctggtggctcattacgccatcattggaccaggcctccaagcaaaggccacaagggaagctcagaagcgcactgcagccgggatcatgaaaaaccctaccgtagatggaattgtgacaatcgaccttgaccccgtcgtttatgatgcgaagttcgagaaacagctgggccagataatgttgctgattctctgtacctcacaaatcctgttaatgcggactacgtgggctctttgcgaatctatcacactggccaccggtccactcactaccctatgggaggggagtcctggaaagttttggaatacaactattgcagtgtcgatggccaacatcttccgaggcagctacctggctggtgccggcttggcattctccctgatgaaatctctcgggggaggcagaagggggaccggagctcagggcgagacacttggtgaaaagtggaagcgccagctgaatcagttgtcaaaaagcgagtttaacacgtataagaaatccgggataatggaagtcgaccggagtgaggccaaggaaggactgaaaagaggcgagaccactaagcacgcggtgtctcgtggtacagccaagctcaggtggttcgtagagcggaatttagtgaaacccgaaggcaaggttgtggatctggggtgtggacgcggcgggtggagctactattgcgcaggacttaaaaaggtcaccgaggtgaaaggctacactaagggtgggccgggacatgaagagccaattcctatggctacatacggctggaacctggtcaaactacactcaggcaaggacgtgtttttcacccccccagaaaagtgtgatacgctcctgtgcgacatcggggagtccagtcccaatcctaccattgaggaaggacgaacattgagagttctgaaaatggtagagccgtggctcaggggtaaccaattttgtatcaagatacttaatccctatatgccaagcgtggtcgaaactctggagcagatgcagcggaaacacggcgggatgttagtgcgcaaccctctgtctagaaattccacccatgagatgtactgggtttcatgcggaacaggcaacatcgtgagcgccgtcaatatgacttcgaggatgttgctcaaccgattcaccatggcacaccggaagcccacatatgaacgtgatgtggacctgggtgctgggaccagacatgtagccgtggagcctgaagttgccaacctagatattatcggacagcgcattgagaatatcaaaaacgaacacaagtctacttggcactacgacgaggataatccatataagacgtgggcgtaccatggcagttatgaggtcaaaccctccggcagcgcttcatccatggtgaacggggtggtcaggcttctgacaaagccttgggacgttattccaatggtgacccaaatcgcaatgactgacaccacaccctttggacagcagcgggtattcaaagaaaaggtggatacgagaaccccgcgcgccaaaaggggtactgctcaaataatggaggtcacagccaagtggctctggggctttctgtctcgaaataagaaacctcggatttgtaccagagaagagttcactaggaaggtgcgcagcaacgcagccatcggggctgtttttgtggacgaaaatcagtggaacagtgcgaaagaggccgtcgaggatgaacgtttctgggacttggtgcaccgggagagagaactgcataagcagggaaaatgcgcaacatgcgtatacaatatgatgggcaagagggagaagaaactcggtgaatttgggaaggctaaaggatcccgcgccatctggtacatgtggcttggcgcacgattcctggagttcgaggccttaggctttatgaacgaagatcactggttcagccgggagaattctctgtcaggggttgaaggagagggtttgcataagctcggctatattctgagagacataagtaaaatcccagggggaaacatgtacgctgatgacaccgccggctgggatacaaggattactgaggacgatctacagaatgaagcgaagatcaccgacattatggagcccgaacacgcacttctggccacgtccatctttaaactcacctatcaaaacaaggtggtccgcgtgcagagacctgctaagagcggtacagtgatggatgtcatatctcggagggaccagcgtgggtcgggacaggttggcacttacggcctgaataccttcacaaacatggaggtgcaattgatccgacagatggaatcagaggggatttttagcccatccgagttagaaactcccaacctggccaaaaaggtactcgactggcttgagaaacacggagcagaacgcctgaagagaatggctatcagtggtgatgactgtgtggtcaaaccgattgatgaccggttcgccaccgctctaacggccctgaatgatatgggcaaggtgaggaaggacatccctcagtgggagccctctaaagggtggaacgattggcagcaagttccattttgcagccatcacttccatcagctcataatgaaggacggacgcgaaattgtggtcccttgtagaaatcaggatgagttggtgggccgggcaagggtatcccagggtgcggggtggtcactgcgagagacagcctgccttggaaaaagttatgctcaaatgtggcagctgatgtactttcaccgtagagacctccgcttagccgcaaacgctatctgttctgccgttcccgtggattgggtcccaaccagccggactacatggtccatccacgcacatcaccagtggatgaccactgaagacatgctgtcagtgtggaatagggtttggattgaggaaaacccctggatggagaataagacccatgtgagctcttgggaagaggtcccttatttgggcaaaagagaggaccaatggtgcggctccctgatagggctcacagcccgcgcgacgtgggctaccaacatccaggtggccattaatcaggtacggaggcttatcggaaacgaaaattacctggattacatgactagtatgaagcgattcaagaacgagagcgacccagaaggtgcactatggtga

SEQ ID NO: 14074 - RNA, 9879 nt, synthetic construct
  misc_feature 1..9879: note = derived and/or modified CDS sequence (opt3) from DENV-1__KP188544__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgtgaatgggatcctcgcccagggaaagaaaatgattcggcctcaacccatggagcataagtattcctggaagtcttggggcaaagcaaagatcataggggctgatatccagaacactacctttattatcgacggaccagatacacctgaatgtcccgacgatcagcgcgcctggaatatttgggaggtcgaggactacggcttcggtatctttactaccaacatatggctgaaactaagagattcgcacacacagatgtgcgaccacaggctgatgagcgcggccattaaggattccaaagctgtgcatgcagacatggggtattggatcgaatcagagaagaatgaaacgtggaagctcgcccgtgctagtttcattgaggttaaaacctgtatctggccaaagtctcacactctgtggagcaacggagtgcttgaatccgagatggtaatacccaaaatctacggcggtcctatttcacaacataattatcggccaggctacttcacacagaccgccgggccgtggcacttgggaaagctggagttagattttgacctctgcgaaggcactacagtcgtggtggatgagcactgcgggtaccgaggacccagcctgagaaccacgactgtcaccggcaaaatcattcatgaatggtgttgcaggtcttgtacacttcctccactgcgcttccggggtgaggacgggtgctggtatggaatggagatcagacccgttaaggaaaaggaggaaaacttggtgaggtccatggtaagtgcaggcagcggtgaggtggactctttttccctcggcatactgtgtgtctcaattctaatcgaagaggtgatgcgcagtcgatggagccggaaaatgctgatgaccgggactctcgcggttttcctgcttttgatcatgggacagctgacatggaatgatttaattcgtctctgcatcatggtgggcgccaacgcttcggacagaatggggatgggaaccacatacctggcccttatggcaacttttaagatgaggcctatgttcgctgtcggcctgctatttcgccggctcacctgtagagaggtgctgttgctgacggttggtttatccctcgtggcctctgtcgaactgccaaatagccttgaggaactgggggatggattggcaatgggcattatgatgctcaaactgctaacagacttccaaccccaccagctgtggaccactcttctctcactgacctttataaggacaagtttgtccctggattatgcctggaagactatggctatggcgttatctatcgtaagcctcttcccgctgtgcctttccaccacgtcacagaaaacaacctggctgcctgtgttgctcggcagctttgggtgtaagccactgactatgttcctaattacagagaacaagatctggggacgaaaaagttggcccattaacgaaggtatcatggccgttggcatagtgtctatcctgctttccagcctcctgaagaatgacgtccctttggcagggcccttaattgctggaggcatgctgatcgcctgctacgtgatttcgggttcatctgccgatctcagtctggagaaagctgcagaggtatcctgggaagaggaagccgagcatagcgggacctctcacaacatccttgtggaagtccaggacgatggaactatgaagataaaagacgaggagcgcgatgacacactgaccattttgctaaaggcgacgctgctcgctgttagcggcgtgtatccaatgtccatccctgccactctgtttgtgtggtacttctggcaaaaaaagaagcagcggtcaggcgtcctttgggatacccccagtccaccggaagtggagagagcagttttagacgacgggatctataggattctgcagcgtggactcttgggtcgcagccaggtaggcgtgggggtcttccaagatggagtgtttcatacaatgtggcacgttacccggggcgccgtgctgatgcaccagggtaaaagactcgaaccttcttgggcttccgtcaagaaagacctgatatcatacgggggaggctggaggttccagggcagttggaatacaggggaggaggtgcaggtaatcgcagtcgaacccggaaagaacccaaaaaatgtgcaaactacccccggtacgtttaagacacctgagggcgaagttggggccattgcgcttgatttcaagccaggaactagcggctcccccatcgtgaaccgagagggtaaaattgtcgggctgtacggaaatggcgtggttaccacatctggcacctatgtgtcggctatcgcccaggcaaaggccactcaggaagggcctttgccggagatagaggacgaagtctttaaaaagcggaacctaaccatcatggatctgcatccaggaagcggtaaaacacgcagatacctccccgctattgtgagggaggccatcaagcggaagttacgaacgctgattcttgcacctactagagtagtggcttcagaaatggccgaggcgctgaaaggcatgccaatccgctatcaaaccacagccgttaagtccgaacacaccgggagggagatagtcgacctcatgtgtcatgcaactttcacaatgcgtttgctgagtcccgtgcgggtgcctaattacaacatgattatcatggatgaggctcactttaccgacccggcctctatcgctgcaagaggatatattagcacgagggtcggcatgggtgaagccgccgctatcttcatgactgcgacacccccagggtccgtagaggcatttcctcagtcaaatgccgtgatacaggatgaagagcgcgacattcccgaacgatcttggaacagcggatacgattggatcaccgacttcccaggcaaaaccgtttggtttgtgcctagtattaagtccggcaatgacatcgctaactgcctcagaaaaaatgggaagcgggtcatacagctgagcaggaagactttcgatacagagtatcaaaaaaccaagaacaacgactgggattacgtggttacaactgacatttctgagatgggagccaatttccgcgcagatcgtgtgatcgaccccagacggtgccttaaaccagtcatcctaaaggaaggtccggagagggtgattctggccggccctatgcccgtaacggtggcttcagcggcccagcgccgagggagaatcggacggaaccagaataaagaaggcgatcagtacatttatatgggtcaaccattgaacaatgacgaggatcatgcacactggaccgaggctaagatgttactggacaacataaatacacccgaagggatcattcctgccctctttgagccagaaagggagaagtccgcagccatcgatggcgaataccgcctgagaggagaggctaggaaaactttcgttgagcttatgcggcgtggcgacctgcccgtctggctcagttataaggtggccagcgaagggtttcagtactcggatcgccgatggtgtttcgacggagagagaaacaatcaggtgttggaagagaacatggacgtcgaaatctggaccaaagagggtgagaggaagaaactgcggcctcgctggctagatgcgagaacatattctgacccgctggcactcagggaatttaaggagttcgccgctggccggcgatccgttagcggggatcttattctggaaataggaaaattaccacagcacttgaccctgagagcccaaaatgctctcgacaacctggtgatgcttcataattcagagcagggcggtaaggcataccgccacgccatggaagagctgcccgatactatcgagacgctcatgttgctggctttaattgccgtactaaccgggggcgtgacactgtttttcctcagtggaaagggccttgggaaaacttctatcggactgttgtgcgtcatggcatccagcgcgctgctctggatggcctcagtggaacctcattggattgctgccagtatcatactggagtttttccttatggttctcctgatccccgaaccagacaggcagcggacccctcaggataaccaattggcatatgtggtcattggtctgttatttatgatcctaacagtagctgccaatgagatgggcctgctcgagaccactaagaaagaccttgggattggacacgtggcagttgaaaaccaccatcacgccacaatgctggatgtggacttgcgtcccgctagcgcgtggacgctgtacgccgtcgcaaccactgtgatcacaccaatgatgagacataccatagagaacaccacagctaatatttccctcactgccatcgccaaccaggcagctattctgatgggccttgataagggttggcctatctctaaaatggacataggggtcccgttactggccctcggctgttacagccaggtgaatcccttgacgctgaccgcggctgttctaatgctggtggcccactatgcaatcattggaccaggcctccaagccaaggctacaagggaagcacagaagcgcactgccgcggggatcatgaaaaaccctaccgtagatggaattgtgacaatcgaccttgaccccgtcgtttacgatgctaagttcgagaaacagctgggccagataatgttgctgattctctgcacctcccaaatcctgttaatgcggactacgtgggccctttgtgaatcaatcacactggcaaccggtccactcactaccctatgggaggggtctcctggaaagttttggaatacaactattgccgtgagtatggctaacatcttccgaggctcgtatctggccggtgcaggcttggctttcagcctgatgaaatccctcgggggaggcagaagggggaccggagcccagggcgagacacttggtgaaaagtggaagcgccagctgaatcagttgtctaaatcagagtttaacacgtacaagaaaagcgggataatggaagtcgaccggtccgaggcgaaggaaggactgaaaagaggcgagaccactaagcatgccgtgagtcgtggtacagcaaagctcaggtggttcgtagagcggaatttagtgaaacccgaaggcaaggttattgatctggggtgcggacgcggcgggtggtcttattactgtgctggacttaaaaaggtgaccgaggtcaaaggctatactaagggtgggccgggacacgaagagccaatccctatggccacatacggctggaacctggtgaaactacacagcggcaaggacgtctttttcacccccccagaaaagtgcgatacgctcctgtgtgacattggggagtcatcccccaatcctaccatcgaggaaggacgaacattgagagtgctgaaaatggttgagccgtggctcaggggtaaccaattttgcataaagatccttaatccctacatgccaagtgtagtggaaactctggagcagatgcagcggaaacatggcgggatgttagtccgcaaccctctgagcagaaattctacccacgagatgtattgggtgtcctgtggaacaggcaacattgtttcagcagtgaatatgactagcaggatgttgctcaaccgattcaccatggctcatcggaagcccacatacgaacgtgatgtcgacctgggtgccgggaccagacacgtggccgtagagcctgaagtggcgaacctagatatcattggacagcgcatcgagaatattaaaaacgaacacaagtcgacttggcatcacgacgaggataatccatataagacgtgggcttaccatggctcttatgaggttaaacccagtggctccgcaagctcaatggtcaacggggtggtgaggcttctgacaaagccttgggacgtcatcccaatggttacccaaatagccatgactgacaccacaccctttggacagcagcgggtgttcaaagaaaaggtagatacgagaaccccgcgcgctaaaaggggtactgcccaaattatggaggtgacagcaaagtggctctggggctttctgtcccgaaataagaaacctcggatctgcaccagagaagagttcactaggaaggtccgctctaacgccgctatcggggcggtgtttgttgacgaaaatcagtggaacagcgccaaagaggcagtggaggatgaacgtttctgggacttggtccaccgggagagagaactgcataagcagggaaaatgcgctacatgtgtgtacaatatgatgggcaagagggagaagaaactcggtgaatttgggaaggccaaaggaagtcgcgcaatttggtatatgtggcttggcgcccgattcctggagttcgaggctttaggctttatgaacgaagatcactggttctcccgggagaatagcctgtctggggtagaaggagagggtttgcacaagctcggctacatactgagagacatctcaaaaattccagggggaaacatgtacgccgatgacaccgcgggctgggatacaaggatcactgaggacgatctacagaatgaagcaaagattaccgacatcatggagcccgaacatgcccttctggctacgagtatatttaaactcacctatcaaaacaaggttgtgcgcgtccagagacctgccaagtccggtacagtgatggatgtgatcagccggagggaccagcgtgggtctggacaggtcggcacttacggcctgaataccttcacaaacatggaggttcaattgattcgacagatggaatcggaggggatcttttcaccaagcgagttagaaactcccaacctggcaaaaaaggtgctcgactggcttgagaaacacggagctgaacgcctgaagagaatggccatttccggtgatgactgcgtagtgaaaccgatcgatgaccggttcgctaccgccctaacggcactgaatgatatgggcaaggtcaggaaggacatacctcagtgggagcccagtaaagggtggaacgattggcagcaagtgccattttgttctcatcacttccaccagctcattatgaaggacggacgcgaaatcgttgtgccttgcagaaatcaggatgagttggtcggccgggcgagggtgagccagggtgccgggtggtccctgcgagagacagcttgtcttggaaaatcatatgcccaaatgtggcagctgatgtactttcatcgtagagacctccgcttagcagctaacgccatctgcagtgcagtacccgttgattgggtgccaacctctcggactacatggagcattcacgcccatcaccagtggatgaccactgaagacatgctgtccgtctggaatagggtgtggatagaggaaaacccctggatggaggacaagacccatgtttcaagctgggaagaggtgccttatttgggcaaaagagaggatcaatggtgtggctctctgatcgggctcacagcgcgcgctacgtgggccaccaatattcaggtcgcaatcaaccaggtgcggaggcttattggaaatgaaaactacctggactatatgacttccatgaagcgattcaagaatgagagtgatccagaaggtgccctatggtga

SEQ ID NO: 14075 - RNA, 9879 nt, synthetic construct
  misc_feature 1..9879: note = derived and/or modified CDS sequence (opt3) from DENV-1__KP188547__SS-prME
  source 1..9879: mol_type = other RNA
agcgtgacaatgctgctcatgcttctgcccacagccttggctttccacttaactacgagaggcggggagcctcatatgatcgtctccaagcaggaaagaggaaaatctctgctgtttaagacatcagttggtgtgaacatgtgcacactcattgccatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggcaccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcaattcttagaaagctgtgcatcgaagccaaaatatccaatacgaccacagactctaggtgtccaactcaaggagaggctaccttggtcgaggaacaggatgccaacttcgtttgccggcgcacatttgtggaccgaggctggggtaatgggtgtggactcttcggcaagggcagcctgttaacttgcgcaaagtttaaatgcgtaaccaagctggaggggaaaattgtgcagtacgaaaacctcaagtattccgtcatcgtgacagttcacaccggagatcagcatcaagtgggtaatgagactacggaacacggcacaattgctaccatcactccccaggcccctacctcagagatccagcttacagactacggggcgctgaccttggactgtagtccaagaactggactagatttcaacgaaatggtcctgctcacaatgaaagaaaagagctggctggtgcataaacagtggtttcttgacctgccgttgccctggacgtctggcgcctccacctcacaagagacttggaataggcaggatctcctggtaacattcaagaccgcacacgctaagaaacaggaagttgtggtcttaggtagccaagagggggccatgcacacagctctgactggcgccaccgaaattcagacgagtggaaccacaactatatttgcaggccatctaaagtgccggctcaaaatggacaagctgacccttaaagggatgtcttatgtgatgtgtacaggatccttcaagttggagaaggaagtcgccgagactcagcacggtaccgtgctggttcaggtgaaatacgagggcacggatgctccttgcaagatcccattcctcacacaagacgaaaaaggggtaacccagaacggacgtctgattactgcgaatcccatcgtcacagataaggagaaacctgtgaacatagaaaccgagccaccctttggcgagagctatattgttgtgggtgcaggggaaaaggcccttaagctgtcgtggttcaaaaagggatcttccatcggaaaaatgtttgaggctactgcccgcggcgcaagaaggatggccatcttgggggacaccgcttgggatttcggatcaattggtggcctctttacaagtgtcgggaagctgatccatcaggtgttcggaacggcctacggcgtattatttagcggtgtgtcctggaccatgaaaattgggataggcatcctgctaacttggctcggactaaattctcggagcacatcacttagtatgacctgtattgcagttggcatggtcacattgtacctgggggtgatggtgcaggcggactccggatgcgtcatcaactggaagggccgagaactcaagtgtggtagcgggatcttcgttactaacgaggtgcacacctggacggaacaatataaatttcaggctgattctccgaagcgcctgtcagccgcaattggaaaagcctgggaggagggcgtgtgcggtataagaagtgctacaaggttagaaaatatcatgtggaagcagattagcaacgagctgaattacatccttttggaaaacgacatgaaattcaccgtagtcgtgggcgacgttaatgggattctcgcccagggaaagaaaatgatcaagcctcaacccatggagcataagtattcctggaaatcttggggcaaggcaaaaataatcggggctgatattcagaacactacctttatcattgacggaccagatacacctgaatgtcccgacgatcagcgggcctggaatatctgggaggtggaggactacggcttcggtatatttactaccaacatttggctgaagctacgcgattcgcacacacagatgtgcgaccacagactgatgagcgcggccatcaaagattccaaggctgtccatgcagacatggggtattggattgaatcagagaagaatgaaacgtggaaactcgccagggctagtttcatcgaggtgaagacctgtatatggccaaaatctcacactctgtggagcaacggagttcttgaatccgagatggtgatccccaagatttacggcggtcctatctcacaacataattatcgtccaggctacttcacacagaccgccgggccgtggcacttgggaaaactggagttagattttgacctctgcgaaggcactacagtagtcgtggatgagcactgcgggtaccggggacccagcctgcgaaccacgactgtgaccggcaagattatccatgaatggtgttgcagatcttgtacacttcctccactgaggttccgcggtgaggacgggtgctggtatggaatggagatacggcccgtcaaggaaaaagaggaaaacttggttagatccatggtgagtgcaggcagcggtgaggtagactctttttccctcggcattctgtgtgtgtcaatcctaatcgaagaggtcatgaggagtcgctggagccgaaagatgctgatgaccgggactctcgcggtgttcctgcttttgattatgggacagctgacatggaatgatttaatccggctctgcattatggttggcgccaacgctctggaccgtatggggatgggaaccacataccttgccctgatggcaacttttaaaatgagacctatgttcgctgtgggcctactctttaggcgcctgacctcgcgggaggtcttgctgttaacggtgggtctctccctggttgcctctgtggaacttccaagctcactggaggaattgggggatggactcgcaatgggcataatgatgctgaagctactgacagacttccaaccccaccagctttggaccactctcctgagtttgacctttatcagaacatccctgtctttagattatgcctggaaaactatggctatggcgctcagcattgtctccctgttcccgctttgtctgtcaaccacgagccagaagacaacctggttgcctgtactcctgggcagttttgggtgcaagccactaactatgttcctgatcacagagaataaaatttggggaaggaagtcttggcccatcaacgaaggtataatggccgtgggcatcgtttccattcttctcagctcgctgttgaaaaacgacgtgcctttagcagggcccctgatcgctggaggcatgctcattgcctgttacgtcatctcaggttctagtgccgatctgtcccttgagaaggctgcagaggtgagctgggaagaggaagccgagcattctgggaccagccacaatatactggtagaagtgcaggacgatggaactatgaaaattaaggacgaggagcgagatgacacattgaccatcctactgaaagcgacgctcctggctgtctccggcgtttatccaatgtcaatccctgccactctttttgtgtggtacttctggcaaaagaagaaacagcgcagtggcgtgttatgggatacccccagcccaccggaagtcgagcgggcagtgctggacgacgggatttatagaatactccagaggggattgctgggtcgttctcaggttggcgtaggggtgttccaagatggagtctttcatacaatgtggcacgtgacccgcggcgccgttctcatgtaccagggtaagcggctggaaccttcctgggcttcagtgaaaaaggaccttatcagttacgggggaggctggagattccagggcagctggaacacaggggaggaggtccaggtgattgcagtagaacccggcaagaatccaaagaacgtccaaactacccccggtacgtttaagacacctgagggcgaagtgggggccatcgcgctggatttcaaaccaggaacttccggctctcccattgttaatagggagggtaagatcgtggggttgtatggaaacggcgtcgtgaccacatcgggcacctacgttagcgctatagcccaggcaaaagccactcaggaagggaccctacctgagatcgaggacgaagtgtttaagaaacgaaatctgacaattatggatctccacccgggatcaggtaagacgcggcgctatttaccagctatcgtcagagaggccattaagaggaaactgcggactcttatcctggcacccacccgagtggtagcttccgaaatggccgaggcgctcaagggcatgcctataagataccaaacaaccgccgtgaaaagtgaacatactgggcgcgagattgttgacttgatgtgccacgcaacattcaccatgaggctgctctctccagtccgtgtgcccaactataatatgatcatcatggatgaggctcattttacggaccctgccagcattgctgcacggggatacatctccactagagtgggcatgggtgaagccgccgctatattcatgacagcgaccccgcccgggtcagtcgaggcatttccacagtctaacgccgtaattcaggatgaagagagggacatccctgaacgcagctggaatagtggatatgattggattaccgacttccccggcaagactgtgtggtttgttccatccatcaaaagcggcaacgacatagctaattgtctgcgaaagaacgggaagagagtgattcagctttctcggaaaacattcgataccgagtaccaaaagaccaaaaataacgactgggattacgtcgtgactacggacatctcagagatgggagccaacttcagggcagatcgcgttatcgaccctcgtagatgcctaaagcccgtgattctgaaagaaggtccagagcgggtcatcttggccggcccgatgcctgtgaccgtagcttccgcggcccagaggcgcgggcgaattggaagaaatcagaacaaggaaggcgatcagtatatatacatgggtcaacccttaaataacgacgaggatcacgcacattggacagaggctaagatgctgctcgacaatatcaacactccagaagggattatccccgccctgtttgagcctgaacgggagaaaagtgcagccatcgatggcgaatataggcttcgcggagaggctagaaagaccttcgtggagctgatgaggcggggcgacctcccagtttggttgagctacaaagtcgcctcggaagggtttcagtattctgatcgtcgctggtgcttcgacggagagcgaaataaccaggtgctggaagagaatatggacgtggaaatttggacaaaggagggtgagaggaaaaagctaaggccccggtggctggatgcgcgcacctactccgaccctctcgcacttagagaatttaaagagttcgccgctggcaggcggagcgtctcaggggatctgatattagaaatcggaaagttgccgcagcacctgactctccgagcccaaaacgctctggacaatcttgttatgctgcacaacagtgagcagggcggtaaggcatatagacatgccatggaggaactcccagatacgattgagaccttgatgctgttagctctaatcgccgtgctgacagggggcgtaactctctttttcctttctggaaaaggcctggggaagacctccattggattgctgtgtgtgatggcaagctcagcgctcctgtggatggccagtgtcgaaccccactggatcgctgccagcataatccttgagtttttcctcatggtgctgttgattcctgaacccgaccgccagaggacaccacaggataatcaactggcatacgttgtgatcggtttactatttatgattctgaccgtcgctgccaacgagatgggcctccttgagactaccaaaaaggacctggggatcggacatgtagcagtggaaaatcaccaccatgccacgatgttggatgttgacctgcggcctgcttccgcgtggaccctctacgccgtggcaactacagtcataacccccatgatgcgtcacaccattgagaacacaactgctaacatctctctgacggccattgccaatcaggcagctatccttatgggcttagataaaggttggccaataagcaagatggacatcggggtgcctctgctcgccttgggctgctattcccaggtcaacccgctgaccctaacagcggctgtgctgatgctcgttgcccattacgcaattatcggacccggccttcaagccaaggctactagagaagcacagaaaaggaccgccgcggggattatgaagaatccaacagtggatggaatcgtaaccatagacctggaccctgtggtctatgatgctaaattcgagaagcagttgggccagattatgctgctcatcctgtgtacttcacaaatcttacttatgcgcacgacatgggccctgtgcgaatctattaccctcgcaactggtcccctaaccacactgtgggaggggagtccaggaaaattttggaacactaccatcgccgtttcgatggctaatatattccggggcagctacttggccggtgcaggcctggctttctccctcatgaagtctcttgggggaggccgaagagggacaggagcccagggcgagacgctgggtgaaaagtggaaaaggcagttgaaccagctgtcaaagagcgagtttaatacctataaaaagtccgggattatggaagtggaccgcagtgaggcgaaagaaggactcaagcggggcgagactacaaagcacgccgtctctagaggtaccgcaaaattacgttggttcgtggagaggaacctggtaaagcctgaaggcaaagtgatcgatcttgggtgtggacggggcgggtggagctactattgcgctggactgaagaaagttactgaggtgaagggctacacaaaaggtgggcccggacatgaggagccgattccaatggccacctacggctggaatctagtcaagctccactcaggcaaggacgtgtttttcacgcctcccgaaaaatgtgataccctgttgtgcgacatcggggagtccagtccaaaccccacaatagaggaaggacgcactctgcgagtcctcaagatggtggagccttggcttagaggtaatcaattttgtatcaaaattctgaacccgtatatgcccagcgttgtagaaaccttagagcagatgcagaggaagcacggcgggatgctggtgcggaatccattgtctcgcaactccacacatgagatgtactgggtctcatgcggaactggcaatatcgtgagcgcagttaacatgacctcgagaatgctcctgaataggttcacaatggctcaccgaaaacctacctatgaacgggatgtggacctaggtgccgggactcgtcatgtcgccgtggagcccgaagtagcgaaccttgatattatcggacagagaattgagaacatcaagaatgaacacaagtctacgtggcactacgacgaggataacccttataaaacatgggcttaccatggcagttatgaggtgaagccatccggcagcgcatcatccatggttaatggggtcgtgcgcctgctcaccaaaccctgggacgtgatacctatggtcactcaaattgccatgaccgacacaacgccatttggacagcagagggttttcaaggaaaaagtggatacccggactcccagagctaagcgcggtacagcccaaatcatggaggtaaccgcaaagtggctgtggggctttttgtctaggaacaaaaagccgcgaatctgtactcgggaagagttcacaagaaaagtgaggagcaatgccgctattggggcggtctttgtggacgaaaaccagtggaatagtgccaaggaggcagttgaggatgaacgcttctgggacctggtgcaccgtgagcgggaactccataaacagggaaagtgcgctacctgcgtctacaacatgatgggcaagagagagaagaaacttggtgaatttgggaaagccaaaggatccagggcaatatggtacatgtggctgggcgcccgcttcttagagttcgaggctctgggctttatgaatgaagatcactggttcagccgagagaactctttgtcaggggtggaaggagagggtctccataaactgggctatatcctacgggacattagtaagatccctgggggaaatatgtacgccgatgacacagcgggctgggatactagaattaccgaggacgatcttcagaacgaagcaaaaatcacggacataatggagccagaacacgccctgctcgctacctccatctttaagctgacatatcaaaataaggtagttagggtgcagcgccccgccaaaagcggtactgtcatggatgtgatttctagacgggaccagagggggtcgggacaggtgggcacctacggcttgaacacattcactaatatggaggtccaattaatccgtcagatggaatcagaggggatttttagcccttccgagctggaaaccccaaacctcgcaaagaaagttcttgactggctggagaagcacggagctgaacgactaaaacgcatggccatcagtggtgatgactgtgtggtaaagcccatagatgacagattcgctacggccctgacagcactcaacgatatgggcaaggtgcggaaagacattccgcagtgggagccttctaaggggtggaatgattggcagcaagtccccttttgcagccatcacttccatcagttgatcatgaaagacggaagggaaatcgtggttccatgtcgcaaccaggatgagctggtgggcagagcgcgggtctcccagggtgccgggtggtcacttagggagaccgcttgcctgggaaagagttatgcccaaatgtggcagctcatgtactttcaccgacgtgacttaagactggcagctaatgccatttgttctgcagtgcctgtagattgggttcccactagccgcacaacctggtccatacacgcccatcaccagtggatgactaccgaagacatgttgtcagtgtggaaccgggtctggatcgaggaaaatccatggatggaggacaaaacacatgtgagctcttgggaagaggttccctatctgggcaagagggaggatcaatggtgcggctccctcattgggcttacggcgagagctacctgggccactaacatccaggtggcaattaatcaggtccgccggctgatcggaaacgaaaattacctagactacatgacaagtatgaagaggttcaaaaacgagagcgatcctgaaggtgccctgtggtga

SEQ ID NO: 14076 - RNA, 9879 nt, synthetic construct
  misc_feature 1..9879: note = derived and/or modified CDS sequence (opt3) from DENV-1__KP723473__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaagctttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggaaaaaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaagcttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtttttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccactagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcaaaaaaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaggaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcaaacaaccgccgtcaagagcgaacatactgggaaagagatcgtggatcttatgtgccacgcaacattcaccatgcggctgctctccccagtgagagtccccaattacaacatgataattatggacgaggctcattttacggatcctgcctcaatcgctgcaaggggatatatctctactcgcgtaggcatgggtgaagccgccgctattttcatgacagcgaccccgcccgggagcgtggaggcatttccacagagtaatgccgttatccaggacgaagagcgagatatacctgaaagatcctggaacagcggatacgactggattaccgatttccccggcaagactgtgtggtttgtcccatctatcaaatcaggcaatgacattgctaactgtttgcggaagaacgggaaaagggtgatccagctgtcccgcaagacattcgacaccgagtatcaaaagacaaaaaataacgattgggactacgttgtgactacggatataagtgagatgggagccaatttccgtgcagacagagtcattgatcctcggaggtgcctcaagcccgtgatcctgaaagacggtccagaacgcgtaatccttgccggcccgatgcctgtgaccgctgcgagcgccgcacagcgaagagggcggattggaaggaaccagaataaggagggcgatcagtacatctatatgggtcaacccctaaacaatgacgaagatcacgctcattggacagaggccaaaatgctgttggacaacattaatactccagaggggataatccccgcattatttgaacctgagcgcgaaaagtcggccgctattgatggcgagtacagactgaggggagaagcccggaagaccttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggacaaaggaaggtgagcggaaaaagtgtgattcacgctggctcgacgcaagaacctatagtgatcccttggccctgagggagtttaaagaattcgctgccggccggcgatctgtttccggggacctaatcctggagattggaaagctccctcagcaccttactctgagagctcaaaatgcattagataacttggtgatgctgcacaatagcgaacagggcggtaaagcctaccgccatgctatggaggaactcccggacacgatagagaccctgatgcttctggccctcatcgcagtattgacagggggcgtgactctgtttttcttatcaggaaagggcctagggaagaccagtattggactgctctgcgtcatggcgagctccgtgcttctgtggatggcctctgttgagccacactggatcgctgccagcattatcttggaatttttcctgatggtgctcctgatacccgagcctgataggcagcggacaccccaggacaaccaacttgcatatgtcgtaatcggtctcctgtttatgattttgaccgtggctgccaacgaaatgggcctgttagagactacaaaaaaggatctagggatcggacatgttgtggcagagaatcaccaccatgccacgatgctggacattgatctccacccagcttccgcgtggaccctttacgccgtcgcaactacaatcataacccctatgatgcgtcataccattgaaaacacaactgctaatatctcactgacggccattgccaaccaggcagctatcttgatgggcctggacaaaggttggcccatatctaagatggatatcggggtgccactcctggcccttggctgttacagtcaggtcaatcctttaaccctgacagcggctgtgctcatgttggttgcccactatgcaattatcggaccgggcctgcaagccaaagctactagagaggcacagaagaggaccgccgcggggattatgaagaaccccacagtggacggaatcgtagctatagacctagatccagtggtctacgacgccaaattcgaaaagcagctgggccagattatgctccttatcctgtgcacctcgcaaatcttgctgatgcgcactacgtgggcactctgtgagagcattacactggccaccggtcctttaactaccctttgggaagggtcccccggaaaattttggaatacaactatcgctgtttctatggccaacatattccggggctcatatctggcaggtgctggcctcgccttcagcctaatgaagtccctggggggaggccgaagagggaccggagcgcagggcgagacattgggtgagaaatggaagaggcagctgaatcagctcagtaagtctgaatttaacacgtacaaacgcagcgggattatggaggtggatcggtcagaagccaaggagggacttaaaagaggcgaaaccactaagcatgcagtctcccgtggtacagctaaactgaggtggttcgtggagcggaatttggtaaagccagagggcaaggtgatcgacctggggtgcggacgcggcgggtggagttattactgtgccggactcaaaaaggttaccgaagtgaaaggctatactaagggtgggcctggacacgaggaacccattccgatggcaacatacggctggaacatcgtcaaattacacagcggccgagatgtgtttttcaccccacctgagaagtgcgacacgctgctttgtgatataggggaatcttcccccaatccaaccatcgaggagggaagaacactgagggtcctaaaaatggtggaaccctggctccggggtattcaattttgcatcaagattctgaacccttacatgccgtcagttgtagagactttggaacagatgcagcgcaagcatggcgggatgctggtgagaaatcccctcagcaggaactcgacccacgagatgtattgggtctcttgtggaacaggcaatatcgtgagtgctgttaacatgacttcccgaatgcttctgaaccggttcaccatggcccatcgtaaaccaacatacgagagagacgtggatttaggtgccgggacccgccacgtcgcggtggaacctgagattgctaatctggacatcataggacagaggattgaaaacatcaagaatgagcacaaaagcacttggcattatgatgaagacaacccctacaagacgtgggcatatcacggctcatacgaggtaaaaccttccggcacagcctctagcatggtgaatggggttgtccggttgctcaccaagccatgggacgtgatccccatggtgactcaaattgctatgaccgatacaacgccttttggacagcagagagtcttcaaggagaaagttgacacccgcactccaaggcccaagcgaggtacagcccaaataatggaagtgaccgcaaaatggctgtggggctttctaagtcggaacaagaaaccgagaatctgcactagggaggaattcacacgcaaggtacgttccaatgccgctattggggcggtgtttgtcgatgagaaccagtggaatagcgccaaggaagcagtggaggacgagcggttctgggatcttgttcatagagaaagggagctgcacaaacagggaaagtgcgctacctgtgtgtataacatgatgggcaaacgcgaaaagaaactcggtgagtttgggaaggccaagggatctcgagcaatctggtacatgtggctgggcgcccggttcttggaattcgaggctctgggctttatgaatgaggaccattggttctcaagagaaaacagtctctccggggtcgagggagaaggtcttcacaaactgggctacattttaagggatatcagcaagatacctgggggaaatatgtatgccgacgatacagcgggctgggacactcgcatcaccgaggatgacctgcagaacgaggcaaaaattacggatatcatggaaccagagcacgccttgctcgctacctctatttttaagctgacataccaaaataaagtggtaagagttcagcggcccgccaagtcgggtactgtgatggacgtcatctcaaggcgtgaccagcgagggagcggacaggtgggcacctatggcctaaacacattcactaacatggaagtgcaacttatacgccagatggagtccgaagggatttttagtccttctgagctggagaatagcaacctcgcagaaagagtcctggattggttggagaaacatggagttgaacggttaaagaggatggctatctccggtgacgattgcgtggtaaagccaaccgacgatcgcttcgccacggctctgacagccctcaatgacatgggcaaagtgagaaaggatatcccccagtgggagccgtcaaaagggtggaacgactggcagcaagtccctttttgtagtcaccatttccaccagcttattatgaaggatggacgggaaatagtggttccctgcaggaatcaggacgagctggtgggccgagcacgtgtctctcagggtgcggggtggagcctaagagagaccgcctgtctgggaaaatcctacgctcaaatgtggcagctcatgtattttcaccgccgggatttgaggctggccgcaaacgctatctgctcagccgtgccagtaaattgggttcctactagcagaacaacctggtctattcatgcacaccatcagtggatgactaccgaagacatgctttccgtgtggaaccgcgtctggatcgaggaaaatccctggatggaggacaagacacacgtgagtagctgggaagatgttccatacctgggcaagcgggaggaccaatggtgtggctcgctcattgggttaacggccagggcgacctgggctactaacatccaggtggccataaatcaggtccgaagactgatcggaaacgagaattatttggattacatgacatccatgaaacggttcaagaacgaatctgaccccgagggtgcactgtggtga

SEQ ID NO: 14077 - RNA, 9879 nt, synthetic construct
  misc_feature 1..9879: note = derived and/or modified CDS sequence (opt3) from DENV-1__KT187564__SS-prME
  source 1..9879: mol_type = other RNA
agcgtgacaatgctgctcatgcttatgcccacagcactggctttccacttgactacgagaggaggggagcctcatatgatggtctccaagcaggaaaggggaaaatctttactgtttaagacatcagccggtgttaacatgtgcacactgatcgccatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatacagagggtggaaacttgggctctccggcaccctggattcaccgttatcgcactgtttctggcccatgctattggcacatcgatcacccagaagggcattatcttcatactcttaatgctggtgacgccatcaatggccatgcgctgcgtcgggatcggaagcagagattttgtggagggtcttagtggcgcgacttgggtagacgttgtgttggagcacgggtcctgtgtcacaaccatggcaaaggataaacccactctggacattgaactactcaagacagaggtgaccaaccctgccgtgctgaggaaactttgcatcgaagctaagatttctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcatcacttgcgctaagtttaagtgcgtaaccaaactggaggggaagatagtgcagtacgaaaacttaaaatattcagtcattgtgacagttcacaccggagaccagcatcaagtgggtaatgagagtactgaacacggcacgacagccaccatcactccccaggcgcctaccacagagattcagctgaccgactacggggccctcactcttgattgtagcccaaggacaggactggacttcaacgaaatggtcttgctaacgatgaagggcaaatcttggctggtgcataagcagtggtttctcgatctgccgcttccctggacctccggtgcatcaactagccaagagacatggaatcggcaggacctgttggtaaccttcaaaacagctcacgccaagaagcaggaggttgtggtcctcgggagtcaagaaggcgctatgcacactgccctgaccggagcaacggagatccagacctctggcacaactaccatctttgccgggcatttaaaatgccgtctgaagatggataaactaacactcaagggaatgtcctatgtgatgtgtactggtagcttcaaactggaaaaggaggtcgctgaaacccagcacggcacggtgcttgttcagattaagtacgaggggacagacgcgccttgcaaaataccattctcgacccaagatgagaagggagtgactcagaacggccgcttgatcacagcaaatcccattgtaaccgacaaagaaaagcctgtcaacatcgaggccgaaccaccctttggtgagtcttatatagtgattggggctggcgagaaagccctgaagctctcctggttcaagaaaggatcaagtatcggcaagatgtttgaagcaactgccagaggggctaggcggatggccatcctgggagataccgcatgggacttcggtagcattggcggggtttttacatccgtgggaaaacttgtccatcagatcttcggcacggcgtacggtgtgctgttttctggggtaagctggaccatgaagattggcataggagtgttgctcacttggctgggcttaaattcacgaagtacatccctgagcatgacctgtatcgctgttgggctagtcacactctacctgggagtgatggtgcaggccgattctggctgcgtcattaactggaaaggtcgcgagcttaagtgtgggtcaggaatcttcgttactaatgaagtgcacacctggacggagcaatataagtttcaggcagacagtccgaaaagattgagcgccgctatcggcaaggcctgggaagagggtgtgtgcggcattaggtccgcaacacggctggagaacataatgtggaaacagatctctaacgaactcaatcatattctgttagagaacgacatgaagttcaccgtagtcgtgggggatgttgctggaatcctggcccagggcaaaaagatgattcgccctcaacccatggaatacaaatattcgtggaaaagctgggggaaggcgaagatcataggagccgacgtgcagaatactacctttatcattgatggcccaaacacacctgagtgtcccgacgatcagagagcttggaatatctgggaagtcgaggactacggtttcgggatttttactaccaacatctggcttaagttgagggattcctatacacaggtgtgcgaccaccgtctcatgtcagcagccataaaagatagtaaggctgttcacgccgacatgggatactggattgagtctgagaagaatgagacgtggaagctggcacgggcgagcttcatcgaagtgaagacctgtatttggccaaaatcccatactctatggtcaaacggcgtactggagagcgaaatgatcatacccaagatctatggtggccctatttctcaacacaattaccgaccagggtacttcacacagaccgccggaccgtggcatctcggcaaactggagcttgattttgacttgtgcgaggggactacagtcgtggtggatgaacactgcggaaacagaggcccctccctgaggaccacgactgtcaccggtaagatcattcacgagtggtgttgccgcagttgtacattacctccactccggttcagaggggaagacggatgctggtatggcatggagatcaggcccgttaaagagaaggaagagaatctggtgaagtcgatggtatctgctggttccggcgaagtggactcatttagtcttgggctgttgtgtataagcattatgatcgaggaagtcatgcgctcgcgatggtcccggaaaatgctcatgatcggaaccctggccgtgttctttctactgattatgggccagctcacttggaacgatctgatccgtctttgcattatggttggggcaaatgcttctgacagaatgggaatgggcacaacctacttggccctgatggcaacattcaagatgaggcctatgtttgccgtgggtttactcttccgccggctgactagcagagaggtccttctgctaaccatagggctctcactggtggctagtgcggagttgccaaactccctggaagagttaggagatggcctcgccatgggcatcatgattctgaaacttctgacggactttcaatctcatcagttgtgggcaacactcctgagcctaaccttcatcaagactaccttttccctgcactatgcttggaaaacaatggccatggttctttcaattgtgagcctcttccccctgtgtttgagtactacctctcagaagacgacatggctgccggtcttactcgggtccctgggatgcaagcctcttaccatgtttctgatcgccgaaaataaaatatggggtagaaagtcctggccattgaacgagggcatcatggctgtagggattgtgtcgatcctcctgtcatctctactgaaaaacgatgttccccttgcaggacctctcattgccggcggtatgctgatcgcgtgttacgtgataagtgggtccagcgctgacttgtctttagaaaaggccgcagaggtcagctgggaggaagaggccgaacattccggagcttcacacaatattctggtggaggtacaggatgacggcactatgaaaatcaaggatgaagaacgagacgatacactcaccatcctgcttaaagcaactctgttggccgtgagtggcgtcttccccctaagcattccagcgacactgttcgtttggtatttttggcaaaagaagaaacagcgctctggggtgctctgggacaccccttcacccccagaggtggaacgggctgtcctggatgacggaatatacagaatcatgcagaggggtcttttaggccgtagccaggtgggggttggagtattccaagagaacgtgtttcatacgatgtggcacgtcactcgcggcgccgtgctgatgtatcagggtaagcggctcgaaccgagttgggcaagcgttaaaaaggacttgatttcctacgggggaggctggagactgcagggctcttggaataccggggaggaggtgcaggtcatcgccgtggaacctggcaaaaatcccaagaatgtacaaacagctccaggtaccttcaagacacccgagggcgaagtcggggccattgcactcgattttaaacctggaacttcgggcagcccaatcgtgaacagggagggtaagatagttgggctgtacggaaatggcgtggtcaccacgtcaggcacatatgtgtccgctatcgcccaggcgaaagccagtcaggaagggccccttcctgagattgaggacgaagttttccgaaagcggaacctgactatcatggatttgcacccgggatctggtaaaacccgcagatacctaccagcaattgtgagggaggctatcaagcggaagctgcgaacactcatattagcccccaccagagtcgtggctagcgaaatggcagaggccctgaaaggcatgcctattcgctatcaaactaccgccgtaaagtccgaacatacagggaaagagatcgtggaccttatgtgccacgctacgtttactatgaggctgctctcaccagttcgtgtccccaattacaacatgatcattatggatgaggcgcatttcaccgacccttctagcatcgcagcccggggatatataagtacaagagtgggcatgggtgaagctgccgcaatttttatgaccgccactccgcccgggtccgtggaggctttcccacagagcaatgcggtcatccaggatgaagagagggacattcctgaacgctcttggaactcaggatacgagtggatcacagattttcccggcaagaccgtatggttcgtgccatccataaaaagtggcaatgacattgccaactgtttgcgaaagaatgggaagagagttatccagctgagccggaaaacgttcgatactgagtatcaaaagaccaaaaacaacgactgggactacgtggtcaccaccgatatctcggaaatgggagcaaattttagggctgaccgcgtgattgatcctcgtagatgcctcaagcccgttatcctgaaagacggtccagagcgggtgattcttgccggcccgatgcctgtcactgtggcatctgccgctcagaggcgcgggcgaataggaagaaaccacaataaggaaggcgatcagtacatctatatgggtcagcccctaaacaatgacgaggatcatgcccactggacagaggcgaagatgctgttggacaacattaataccccagaagggatcatccccgcattattcgagcctgaacgggagaaatccgccgctattgatggcgaatacaggctgcgcggagaggccagaaagacatttgtagagctcatgaggcggggcgacctgccagtgtggcttagctataaagttgcttcagaagggttccaatacagtgatcgtcgctggtgctttgacggagagcgaaacaatcaggtcctggaagagaacatggatgtggaaatatggactaaggagggtgagaggaaaaagctcaggccccggtggttggacgcacgcacgtattctgaccctctggccctaagagagttcaaagagtttgctgccggcaggcggtccgtgagcggggatctgatcctcgaaattggaaaacttccgcagcacctgacccagcgagcacaaaatgcgttagacaacttggtcatgctgcataattcagagcagggcggtagagcctaccgccacgctatggaagaactcccagatacaatcgagactctgatgcttctggccctcattgcagttttgaccgggggcgtgacactgttctttttaagtggaaggggcctagggaagaccagcatcggactgctctgtgtaatggcttcctctgtgcttctgtggatggccagcgtcgaaccccattggatagcagcctccatcattttggagttctttctgatggtgctcctgatccctgaacccgaccggcagcgtactccacaggataaccaacttgcttatgttgtgattggtctcctgttcatgatcttgacggtcgcggccaatgagatgggcctgttagagaccaccaaaaaggacctagggataggacacgtagcagtggaaaaccaccatcacgctgccatgctggatgttgacctccatcctgcctcagcatggactctttacgctgtggccaccacaattatcacccccatgatgagacacactattgagaacacaacggcgaatatctctctgaccgctatagccaaccaggcagccatcttgatgggcctggataaaggttggccaattagtaagatggacatcggggtccctctcctggctcttggctgctacagccaggtgaatccgttaactctgacagcagccgtcctcatgttggtggcgcattatgctattatcggacccggcctgcaagccaaagcaaccagggaagcccagaagcgcaccgctgccgggataatgaagaacccaacagttgatggaattgtggcaatcgacctagatcctgtagtgtacgacgctaaatttgagaagcagctgggccagatcatgctccttattctgtgtactagccaaatcttgctgatgcggacgacctgggccctctgcgaatccataacactggcgactggtcccttaaccacactttgggaggggtctccaggaaaattctggaataccactattgccgtctcaatggcaaacatcttccgaggcagctatctggctggtgccggcctcgcattttccctaatgaagagtctagggggaggcagaagggggacgggagctcagggcgagacattgggtgaaaaatggaagcgccggctgaatcagctctctaagagcgagttcaacacctacaaaagatcagggattatggaagttgaccgttccgaggccaaggaaggacttaaaaggggcgagactaccaagcacgccgtgagtcggggtacagcgaaactgcgctggtttgtcgagcgaaatttggtgaagcctgaaggcaaggtaatcgatctggggtgtggaagaggcgggtggagctattactgcgctggactcaaaaaggtgactgaggttaaaggctataccaagggtgggcccggacacgaggaaccgataccaatggcaacatacggctggaacttagtgaaactgcattctggcaaggacgtcttctttatccctcccgaaaaatgtgatacgcttctgtgcgacattggggagtcctcaccaaatcccaccatcgaggaaggaaggactctacgggtgctcaagatggtcgagccttggctgcgcggtaaccagttctgtattaagatcttgaatccgtacatgcccagcgtggttgaaacactggagcaaatgcagagaaaacacggcgggatgctcgtaaggaacccactttcgcgaaattctacccatgagatgtattgggtgagttgcggaactggcaacattgtctccgccgtgaatatgacaagccggatgctgttaaaccgttttaccatggctcacagaaagcctacgtacgaacgcgatgttgacctgggtgccgggaccaggcacgtggcagtcgagcccgaagtggccaacttggatatcataggacagcggattgagaatatcaaacatgaacacaagtcaacatggcattatgacgaggataacccttacaaaacttgggcttatcacggctcctacgaggtaaagccatctggcagcgcgagttccatggtgaatggggttgtcaagctcctgaccaaaccctgggacgtgatccctatggtgacacagattgccatgactgataccacaccattcggacaacagagagtctttaaggaaaaagttgacacccgcactcccaaggcaaaaaggggtacggctcagataatggaggtgacagcccgatggctatggggcttccttagccggaacaagaagccgagaatctgtaccagggaagagtttactcgcaaagtacgttctaatgcagccattggggctgtgttcatcgacgaaaaccaatggaactcagccaaggaggcggtcgaggatgaacggttttgggacctggtgcatagagagagggaactccacaaacagggaaagtgcgcaacctgcgtttataacatgatgggcaaacgcgagaagaagctgggtgagttcgggaaagccaagggaagtcgagctatttggtacatgtggttgggcgcccggttcctggagtttgaggcactcggcttcatgaatgaagatcactggttttccagagagaacagcctttctggggtggaaggagagggtctgcataaattaggctacatcctgagggacatatcgaagatccctgggggaaatatgtatgctgatgacacagccggctgggatacgcgcattaccgaggacgatttgcagaacgaagctaaaatcactgacattatggagccagaacacgccctcctggcaaaggcgatcttcaaactaacataccagaataaggtcgtgagagtacaacggcccgccaagaacggtaccgttatggatgtgatatcaaggcgtgaccagcgagggagcggacaggtcggcacttatggccttaatacatttaccaacatggaggctcagctgattcgccaaatggaatccgaggggatcttcagtccttctgagctcgaaacaccaaacctggccgagagagtgttggattggttaggaaaatacggtgtggaacggctgaagaggatggcaatcagcggcgacgactgtgtcgttaaacccattgatgaccgctttgctactgccctcaccgcacttaatgatatggggaaggtgagaaaagacataccgcagtgggagccttccaagggatggaacgattggcagcaggtacccttctgctcacatcactttcaccaactgatcatgaaggacggccgggaaattgtggtcccatgtaggaatcaggatgagctagtgggtcgagcccgtgttagtcagggggcgggatggtctctgagagagacggcttgcctcggcaaaagctatgcccagatgtggcaattgatgtacttccatcgccgggacctgaggcttgcagccaacgctatctgttccgccgtgcctgtcgattgggtgcccacctcaagaacaacttggagcattcacgcacatcaccagtggatgaccacagaagacatgctgtctgtatggaatcgcgtttggatcgaggaaaacccatggatggaggataagactcatatatccaattgggaagacgtgccctatctcggcaaacgggaggaccagtggtgcgggagtttaatcggactgaccgctagggccacgtgggcgacaaacattcaagtcgctatcaatcaggtgcgaagattgattggtaacgagaattacctggattacatgaccagcatgaagcggtttaaaaacgaatcggaccctgagggcgccctctggtga

SEQ ID NO: 14078 - RNA, 9879 nt, synthetic construct
  misc_feature 1..9879: note = derived and/or modified CDS sequence (opt3) from DENV-1__KT187560__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaagctttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggaaaaaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaagcttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtttttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccactagtcagaagacaacctggctcccggttctgcttggctctctggggtgcaaacctttgactatgtttctcattacagagaataagatctggggacgcaagtcctggccactgaacgaaggtattatggcggtgggcatcgtcagcatactactgtcgtcacttctcaaaaatgatgtgcccctggccgggcctttgatcgcaggaggcatgttaattgcttgttatgtaatctctggtagttccgccgacctgagcctcgagcgggccgctgaggtgtcttgggaagaggaagcagagcatagcggggcctcccacaacattctggtcgaagttcaggatgacggaaccatgaagatcaaagatgaggagagagacgatacgcttactatactgttgaaggcgaccctactggctgtgtcaggcgtgtaccccatgagtattccagccacactcttcgtctggtatttttggcaaaaaaagaaacagaggagcggcgtgctgtgggacaccccttctcccccagaagttgagcgtgcagtacttgatgacgggatctaccgcatcttacagcggggactgctcggtagatcccaggtgggcgtcggggtgttccaagacggagttttccatacaatgtggcacgtgactaggggcgccgtcttgatgtatcagggtaagcgactggaaccgtcatgggctagtgtgaagaaagatctcattagctacgggggaggctggcggtttcagggctcctggaataccggggaggaggtacaggtcatagcagtggaacctggaaagaaccccaaaaatgttcaaacgacaccaggtactttcaagacccccgagggcgaagtgggggccatcgcgctggactttaaacctggaacatctggctcgccaattgtcaaccgcgagggtaagatcgtggggctttacggaaatggcgttgtgaccactagcggcacctatgtctcagctattgcccaggcaaaggcctcccaggaagggcccctgcctgagatcgaggatgaagtgttcaaaaagagaaacttgacaataatggacctacacccgggaagtggtaaaacgaggcggtacctgccagctatcgtacgagaggccattaagagaaaactccgcactttaatcctggcacccaccagggtggttgcttctgaaatggccgaggcgcttaagggcatgcctattcgttatcaaacaaccgccgtcaagagcgaacatactgggaaagagatcgtggatctgatgtgccacgcaacatttaccatgcggctcttgtccccagtgagagtccccaattacaacatgataattatggacgaggctcatttcacggatcctgcctcaatcgctgcaaggggatatatctctactcgcgtaggcatgggtgaagccgccgctatttttatgacagcgaccccgcccgggagcgtggaggcattcccacagagtaatgccgttatccaggacgaagagcgagatatacctgaaagatcctggaacagcggatacgactggattaccgattttcccggcaagactgtgtggttcgtcccatctatcaaatcaggcaatgacattgctaactgtctgcggaagaacgggaaaagggtgatccagctctcccgcaagacatttgacaccgagtatcaaaagacaaaaaataacgattgggactacgttgtgactacggatataagtgagatgggagccaatttccgtgcagacagagtcattgatcctcggaggtgcctgaagcccgtgatccttaaagacggtccagaacgcgtaatcctagccggcccgatgcctgtgaccgctgcgagcgccgcacagcgaagagggcggattggaaggaaccagaataaggagggcgatcagtacatctatatgggtcaacccctgaacaatgacgaagatcacgctcattggacagaggccaaaatgttgttagacaacattaatactccagaggggataatccccgcactgttcgaacctgagcgcgaaaagtcggccgctattgatggcgagtacagactcaggggagaagcccggaagacctttgttgagctgatgcgtcgcggcgaccttccagtctggctgtcttataaagtggcgtccgaggggttccagtacagcgatcgaagatggtgctttgacggagaaaggaacaatcaggtgctcgaggaaaacatggacgtcgagatctggacaaaggaaggtgagcggaaaaagttgcgccccagatggctggatgcaaggacctattcagaccctctagccctgcgggagttcaaagaatttgctgccggccgaagaagtgtttctggggatctcatccttgagattggaaagctgccgcagcacttaactttgcgcgctcaaaatgcactggacaacctcgtgatgctgcacaattccgaacagggcggtaaagcctacaggcatgctatggaggaacttccagatacgatagagaccctgatgctcttggccctgatcgcagtattaacagggggcgtgactctattctttctgagcggaaagggcctcgggaagacctcaattggacttctgtgtgtcatggcgagtagcgtgttgctgtggatggcctccgttgagccccactggatcgctgcctctattatcctcgaattctttctgatggtgcttctcatacctgagcccgaccggcagcgtacaccacaggataaccaactggcatatgtcgtaatcggtttgctgttcatgattttaaccgtggctgccaacgaaatgggcctactggagactacaaaaaaggacctcgggatcggacatgttgtggcagagaatcaccaccatgccacgatgcttgatattgacctgcaccctgctagcgcgtggaccttgtacgccgtcgcaactacaatcataacccccatgatgagacataccattgaaaacacaactgctaatatctccctgacggccattgccaaccaggcagctatcctcatgggcctggataaaggttggccaatatcaaagatggacatcggggtgcctcttttagccctgggctgctactctcaggtcaatccgctcaccttgacagcggctgtgctgatgctagttgcccactatgcaattatcggacccggcctgcaagccaaagctactagggaggcacagaagcgcaccgccgcggggattatgaagaacccaacagtggatggaatcgtagctatagacctcgaccctgtggtctacgatgccaaatttgaaaagcagcttggccagattatgctgttgatcctgtgtaccagtcaaatcctcctgatgcggactacgtgggcattatgcgagtcgattacacttgccaccggtcccctgactaccctctgggaagggagcccaggaaaattctggaatacaactatcgctgtttccatggccaacatatttcgaggctcttatctagcaggtgctggcctggccttctcattgatgaagagcctggggggaggcagaagggggaccggagcgcagggcgagacactcggtgagaaatggaagcgccagcttaatcagctgtccaagagtgaattcaacacgtacaaacggtctgggattatggaggtggacagaagcgaagccaaggagggattgaaacgtggcgaaaccactaagcatgcagtctcaaggggtacagctaaactgcggtggtttgtggagcgcaatctcgtaaagcctgagggcaaggtgatcgatttagggtgtggacgaggcgggtggtcctattactgcgccggactgaaaaaggttaccgaagtgaaaggctatactaagggtgggcccggacacgaggaaccgattccaatggcaacatacggctggaacatcgtcaaacttcacagtggcagagacgtgttctttacccctcccgagaagtgtgatacgctgctatgcgacataggggaaagctctccaaatcccaccatcgaggagggaaggacactccgggtcctgaaaatggtggaaccttggttgcgcggtaaccaattctgtattaagatcctgaatccgtacatgccctccgttgtagagactctcgaacagatgcagagaaagcatggcgggatgcttgtgaggaacccactgtcacgaaatagcacccacgagatgtattgggtctcgtgcggaacaggcaacattgtgtctgctgttaacatgactagtcggatgttactgaatcgttttaccatggcccatagaaaacctacatacgagcgcgatgtggacttgggtgccgggaccaggcacgtcgcggtggaacccgagatcgctaacctcgatattatcggacagcggatagaaaatattaagaacgagcacaaatccacttggcattatgacgaagataatccttacaagacgtgggcatatcacggcagctacgaggtaaaaccatcaggctccgcctctagcatggtgaacggggttgtcagactgctaacaaagccctgggacgtgatccctatggtgacccaaatcgctatgactgacaccacaccattcggacagcagcgcgtctttaaggagaaagttgatacgaggaccccccgaccgaagcggggtactgcccaaattatggaagtgacagcaaaatggctttggggcttcctgagtagaaataagaaacctaggatatgtacccgcgaggaatttactcgtaaggtacggtccaacgccgctatcggggcggtgttcgtcgacgagaatcagtggaacagcgccaaggaagcagtggaggatgagagattttgggacctcgttcatagggaacgcgagctgcacaaacagggaaagtgcgctacatgcgtgtataatatgatgggcaaacgagaaaagaaattgggtgagttcgggaaggccaagggatctcgggcaatttggtacatgtggctgggcgccagatttctcgaattcgaggctcttggcttcatgaacgaggatcattggttttcaagggaaaatagtctgtccggggtcgagggagaaggtttacacaaactgggctacatcttgcgcgacattagcaagatcccagggggaaacatgtatgccgatgacaccgcgggctgggatacaagaataactgaggacgatctccagaatgaggcaaaaatcaccgacattatggaacccgagcacgccctgctagctacgtctatcttcaagcttacctaccaaaacaaagtggtacgggttcagaggcctgccaagtcgggtacagtgatggatgtcatttcacgtcgagaccagcgcgggagcggacaggtgggcacttatggcctgaacacctttacaaatatggaagtgcaactcatcagacagatggagtccgaagggatattcagtccatctgagctggagaacagcaatttggcagaacgggtcttagactggctggagaaacatggagttgaaaggctcaagcgcatggctatttccggtgatgactgtgtggtaaagcccactgatgacagatttgccaccgctcttacggccctgaacgatatgggcaaagtgcggaaggacatcccgcagtgggagccttcaaaagggtggaatgattggcagcaagtccccttctgcagtcaccattttcaccagctaatcatgaaggacggaagggaaattgtggttccatgtcgaaaccaggatgagctggtgggccgtgcaagagtctctcagggtgcggggtggagcctccgcgagacagcctgcttgggaaaatcctacgctcaaatgtggcagctgatgtatttccaccggagggaccttagactggccgcaaatgctatatgttcagccgtgcctgtaaactgggttcccaccagccgcactacatggtctatccatgcacaccatcagtggatgaccactgaagatatgctctccgtgtggaatcgggtctggattgaggaaaacccatggatggaggacaagacccacgtgagtagctgggaagacgttccctacttaggcaagagggaggatcaatggtgcggctcgctgatcgggttgacagcccgagcgacgtgggctaccaatattcaggtggccatcaaccaggtcagacggctgataggaaatgagaactatctcgactacatgacttccatgaaaaggtttaagaatgaatctgatcctgagggtgcactttggtga

SEQ ID NO: 14079 - RNA, 9879 nt, synthetic construct
  misc_feature 1..9879: note = derived and/or modified CDS sequence (opt3) from DENV-1__KT187561__SS-prME
  source 1..9879: mol_type = other RNA
agcgtgaccatgctgctcatgcttctgcccaccgcattggctttccacttaactacgagaggaggggagcctcatatgatcgtctccaagcaagaaaggggaaaatctctgttatttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagatttcgtggagggtcttagcggcgcgacttgggtagacgttgtgttggagcacgggagttgtgtcacaaccatggcaaagaataaacccactctggatatcgaattgctcaagacagaggtgaccaaccctgccgtgctgaggaaactttgcattgaagctaagatctccaatacgaccacagactctcggtgtccaactcaaggagaggccaccctggtcgaagaacaggatgcaaactttgtttgccgccgaacattcgtggacagaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcagcatcaagtgggtaatgagactacggaacacggcacaatcgccaccattactccccaggcgcctacctcagagatccagctcacagactacggggcccttaccctggactgtagtccaaggactggattggattttaacgaaatggtcctactgacaatgaaggagaaaagctggctcgtgcataagcagtggttcctggaccttccgctgccctggacgtctggcgcatccacctcacaagagacttggaatcggcaggatttgctcgtaacatttaaaaccgctcacgccaagaagcaggaagttgtggtcctgggtagccaagagggggctatgcacacagccttaactggcgcaaccgaaatccagacgagtggaaccacaactattttcgccggccatctgaaatgccgtctaaagatggacaaactcaccctgaagggggtgtcttatgtcatgtgtacaggatccttcaaacttgagaaggaagtggctgagactcagcacggtaccgttttggtgcaggtaaagtacgagggcacggatgcgccttgcaaaataccaatcagcacacaagacgaaaagggggtcacccagaacggacgcctgattactgcaaatcccatcgtgacagataaagagaagcctgttaacatagaaaccgagccaccctttggcgagtcgtatattgtgatcggtgccggggaaaaagctctcaagctgtcttggttcaagaaaggctcctcaatcggaaagatgtttgaggccactgcaagaggcgccaggcggatggctattcttggggacaccgcctgggatttcggaagtatcggtggcgtctttacaagcgtggggaaactggtacatcaggtgttcggaacggcatacggcgttttgttttccggtgtctcttggaccatgaagattgggataggcatcctcctgacttggttaggactgaatagccgatcaacaagtctatccatgacctgtattgcggtgggcatggtgacactctacctgggggtcatggttcaggctgacagcggatgcgtgatcaactggaaaggccgcgaacttaagtgtggttctgggatcttcgtgactaacgaggtacacacctggacggaacaatataagtttcaggccgattcaccgaaaagattgagtgcagccattggaaaggcttgggaggagggcgtctgcggtataaggagcgccacacggctggaaaatatcatgtggaaacagatttccaacgagctcaatcatatcctgttagaaaacgacatgaagttcaccgtggttgtgggcgacgcaaatgggattctgactcagggcaagaagatgatccgccctcaacccatggagcacaaatactcttggaagtcgtggggcaaggctaaaataatcggggccgatacccagaacacaacttttattatcgacggaccagatacccctgaatgtcccgacgatcagagagcgtggaatatttgggaggtcgaggactatggcttcggtgtgtttacaacgaacatctggcttaagttgagggatagctacacccagatgtgcgaccaccgtctcatgtccgccgctataaaagattcaaaggcagttcatgccgacatggggtattggattgaaagtgagaaaaatgaaacttggaagctggctcgggcctctttcatcgaggtgaagacatgtatttggccacgaagccacaccctatggtccaacggagtactggaatcagagatgatcatacccaaaatctacggcggtcctattagccaacataattatagaccaggctacttcactcagacagcagggccgtggcacctcggaaagctggagcttgattttaacttgtgcgaaggcaccacggtcgtggtggacgagcactgcgggaataggggaccctctctgcgcactaccacagtcaccggcaaaatcattcatgaatggtgttgccggtcctgtactttacctccactcagattcaggggtgaggatgggtgctggtacggaatggagatccgccccgttaaggaaaaagaggaaaacctggtgcgaagtatggtaagcgcgggctctggtgaggtggactccttttcacttggcctgttgtgtgtcagtataatgattgaagaggtgatgcggagccgttggtcgagaaagatgctcatgacagggaccctggccgttttctttctactgatcatgggacagctcacatggaatgacctgatcaggctttgcattatggtgggcgctaacgtctccgatcgcatggggatgggaactacctatttggccctgatggcaacgttcaagatgcggcctatgtttgctgtgggcttactcttcagaaggctgacatctcgagaggttcttctgctaaccatcggtctcagcctggtggcctcagtcgaattgccaaacagtctggaggaattaggggacggactcgcaatgggcattatgatgctgaaacttctgactgattttcaatcccaccagttgtggaccacactcctgtctctaactttcataaagaccacgctgagccttgactacgcctggaaaacaatggctatggtactctccatcgtgtcactgtttcccttgtgtctgagcaccacaagtcagaagacaacctggttaccggttctcctgggctctttcgggtgcaaacctcttactatgtttctgattacagagaataagatctggggacgcaagtcctggccattgaacgaaggtattatggcggtgggcatcgtcagcatactcctgtcgtcactactgaaaaatgatgtgccccttgccgggcctctcatcgcaggaggcatgctgattgcttgttatgtaatctctggtagttccgccgacttgagcttagagcgggccgctgaggtgtcttgggaagaggaagcagagcatagcggggcctcccacaacattctggtcgaagttcaggatgacggaaccatgaagatcaaagatgaggagagagacgatacgctcactatactgcttaaggcgaccctgttggctgtgtcaggcgtgtaccccatgagtattccagccacactattcgtctggtatttctggcagaaaaagaaacagaggagcggcgtgctgtgggacaccccttctcccccagaagttgagcgtgcagtactcgatgacgggatctaccgcatcctgcagcggggacttttaggtagatcccaggtgggcgtcggggtgtttcaagacggagttttccatacaatgtggcacgtgactaggggcgccgtcctgatgtatcagggtaagcgactcgaaccgtcatgggctagtgtgaagaaagatttgattagctacgggggaggctggcggtttcagggctcctggaataccggggaggaggtacaggtcatagcagtggaacctggaaagaaccccaaaaatgttcaaacgacaccaggtactttcaagacccccgagggcgaagtgggggccatcgcgctggactttaaacctggaacatctggctcgccaattgtcaaccgcgagggtaagatcgtggggctctacggaaatggcgttgtgaccactagcggcacctatgtctcagctattgcccaggcaaaggcctcccaggaagggcccctgcctgagatcgaggatgaagtgttcaaaaagagaaaccttacaataatggacctgcacccgggaagtggtaaaacgaggcggtacttgccagctatcgtacgagaggccattaagagaaaactacgcactctgatcctcgcacccaccagggtggttgcttctgaaatggccgaggcgttaaagggcatgcctattcgttatcaaacaaccgccgtcaagagcgaacatactgggaaagagatcgtggatctgatgtgccacgcaacatttaccatgcggcttctgtccccagtgagagtccccaattacaacatgataattatggacgaggctcatttcacggatcctgcctcaatcgctgcaaggggatatatctctactcgcgtaggcatgggtgaagccgccgctatttttatgacagcgaccccgcccgggagcgtggaggcattcccacagagtaatgccgttatccaggacgaagaacgagatatacctgaaagatcctggaacagcggatacgactggattaccgattttcccggcaagactgtgtggttcgtcccatctatcaaatcaggcaatgacattgctaactgtctccggaagaacgggaaaagggtgatccagttgtcccgcaagacattcgacaccgagtatcaaaagactaaaaataacgattgggactacgttgtgactacggatataagtgagatgggagccaattttcgtgcagacagagtcattgatcctcggaggtgcctgaagcccgtgatcctcaaagacggtccagaacgcgtaatcctggccggcccgatgcctgtgaccgctgcgagcgccgcacagcgaagagggcggattggaaggaaccagaataaggagggcgatcagtacatctatatgggtcaaccccttaacaatgacgaagatcacgctcattggacagaggccaaaatgctactggacaacattaatactccagaggggataatccccgcattgttcgaacctgagcgcgaaaagtcggccgctattgatggcgagtacagattaaggggagaagcccggaagacctttgttgagctgatgcgtcgcggcgacctcccagtctggctgtcttataaagtggcgtccgaggggttccagtacagcgatcgaagatggtgctttgacggagaaaggaacaatcaggtgcttgaggaaaacatggacgtcgagatctggacaaaggaaggtgagcggaaaaagctgcgccccagatggctcgatgcaaggacctattcagaccctttggccctgcgggagttcaaagaatttgctgccggccgaagaagtgtttctggggatctaatcctggagattggaaagctcccgcagcaccttactctgcgcgctcaaaatgcattagacaacttggtgatgctgcacaattccgaacagggcggtaaagcctacaggcatgctatggaggaactcccagatacgatagagaccctgatgcttctggccctcatcgcagtattgacagggggcgtgactctgttctttttaagcggaaagggcctagggaagacctcaattggactgctctgtgtcatggcgagtagcgtgcttctgtggatggcctccgttgagccccactggatcgctgcctctattatcttggagttctttctgatggtgctcctgatacctgagcccgaccggcagcgtacaccacaggataaccaacttgcatatgtcgtaatcggtctcctgttcttgattctgaccgtggctgccaacgaaatgggcttactagagactactaaaaaggacctggggatcggacatgttgtggcagagaatcaccaccatgccacgatgctcgatattgaccttcaccctgctagcgcgtggaccctgtacgccgtcgcaactacaatcataacccccatgatgagacataccattgaaaacacaactgctaatatctccttgacggccattgccaaccaggcagctatcctgatgggcctcgataaaggttggccaatatcaaagatggacatcggggtgcctctgcttgccttaggctgctactctcaggtcaatccgctgaccctcacagcggctgtgttgatgctggttgcccactatgcaattatcggacccggcctacaagccaaagctactagggaggcacagaagcgcaccgccgcggggattatgaagaacccaacagtggatggaatcgtagctatagacctggaccctgtggtctacgatgccaaatttgaaaagcagctcggccagattatgcttctgatcttgtgtaccagtcaaatcctgctcatgcggactacgtgggcactgtgcgagtcgattacattagccaccggtccccttactaccctgtgggaagggagcccaggaaaattctggaatacaactatcgctgtttccatggccaacatattccgaggctcttatctcgccggtgctggcctagccttttcactgatgaaaagcctagggggaggcagaagggggaccggagcgcagggcgagacactgggtgagaaatggaagcgccagctcaatcagctttccaagagtgagttcaacacgtacaaacggtctgggattatggaggtggacagaagcgaagccaaggagggactgaaacgtggcgaaaccactaagcatgcagtctcaaggggtacagctaaattgcggtggtttgtggagcgcaatctggtaaagcctgagggcaaggtgatcgatctcgggtgtggacgaggcgggtggtcctattactgcgccggactgaaaaaggttaccgaagtgaaaggctatactaagggtgggcccggacacgaggaaccgattccaatggcaacatacggctggaacatcgtcaaactacacagtggcagagacgtgttctttacccctcccgagaagtgtgatacgcttctgtgcgacataggggaaagctctccaaatcccaccatcgaggagggaaggacactacgggtcctcaaaatggtggaaccttggctgcgcggtaaccaattctgtattaagatcttgaatccgtacatgccctccgttgtagagactctggaacagatgcagagaaagcatggcgggatgctcgtgaggaacccactttcacgaaatagcacccacgagatgtattgggtctcgtgcggaacaggcaacattgtgtctgctgttaacatgacaagtcggatgctgttaaatcgttttaccatggcccatagaaaacctacatacgagcgcgatgtggacctgggtgccgggaccaggcacgtcgcggtggaacccgagatcgctaacttggatattatcggacagcggatagaaaatattaagaacgagcacaaatccacttggcattatgacgaagataatccttacaagacgtgggcatatcacggcagctacgaggtaaaaccatcaggctccgcctctagcatggtgaacggggttgtcagactcctgacaaagccctgggacgtgatccctatggtgacccaaatcgctatgactgacaccacaccattcggacagcagcgcgtctttaaggagaaagttgatacgaggacaccccgaccgaagcggggtactgcccaaattatggaagtgacagcaaaatggctatggggcttccttagtagaaataagaaacctaggatatgtacccgcgaggaatttactcgtaaggtacggtccaacgccgctatcggggcggtgttcgtcgacgagaatcagtggaacagcgccaaggaagcagtggaggatgagagattttgggacctggttcatagggaacgcgagctccacaaacagggaaagtgcgctacatgcgtgtataatatgatgggcaaacgagaaaagaaactgggtgagttcgggaaggccaagggatctcgggcaatttggtacatgtggttgggcgccagattcctggaatttgaggctctcggcttcatgaacgaggatcattggttttcaagggaaaatagtctttccggggtcgagggagaaggtctgcacaaattaggctacatcctgcgcgacattagcaagatcccagggggaaacatgtatgccgatgacaccgcgggctgggatacaagaataactgaggacgatttgcagaatgaggcaaaaatcaccgacattatggaacccgagcacgccctcctggctacgtctatcttcaagctaacctaccaaaacaaagtggtacgggttcagaggcctgccaagtcgggtacagtgatggatgtcatttcacgtcgagaccagcgcgggagcggacaggtgggcacttatggccttaacacctttacaaatatggaagtgcaactgatcagacagatggagtccgaagggatattcagtccatctgagctcgagaacagcaatctggcagaacgggtcttggactggttagagaaacatggagttgaaaggctgaagcgcatggctatttccggtgatgactgtgtggtaaagcccactgatgacagatttgccaccgctctcacggcccttaacgatatgggcaaagtgcggaaggacatcccgcagtgggagccttcaaaagggtggaatgattggcagcaagtccccttctgcagtcaccattttcaccagctgatcatgaaggacggaagggaaattgtggttccatgtcgaaaccaggatgagctagtgggccgtgcaagagtctctcagggtgcggggtggagcctgcgcgagacagcctgcctcggaaaatcctacgctcaaatgtggcagttgatgtatttccaccggagggacctgagacttgccgcaaatgctatatgttcagccgtgcctgtaaactgggttcccaccagccgcactacatggtctatccatgcacaccatcagtggatgaccactgaagatatgctgtccgtgtggaatcgggtctggattgaggaaaacccatggatggaggacaagacccacgtgagtagctgggaagacgttccctacctcggcaagagggaggatcaatggtgcggctcgttaatcgggctgacagcccgagcgacgtgggctaccaatattcaggtggccatcaaccaggtcagacggttgataggaaatgagaactatctggactacatgacttccatgaaaaggtttaagaatgaatctgatcctgagggtgcactctggtga

SEQ ID NO: 14080 - RNA, 9879 nt, synthetic construct
  misc_feature 1..9879: note = derived and/or modified CDS sequence (opt3) from DENV-1__KT187562__SS-prME
  source 1..9879: mol_type = other RNA
agcgtgaccatgctgctcatgcttctgcccacagcattggctttccacttaactacgagaggaggggaacctcatatgatcgtctccaagcaagaaaggggaaaatctctgttatttaagacctcagccggtgttaacatgtgcacactcattgccatggacctgggcgaactttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggagaagactctgaaactttcttggtttaagaaaggctcctcaatcggaaagatgttcgaggctaccgccagaggcgcaaggcggatggccattctgggggacacagcttgggattttggaagtatcggtggcgtcttcacgagcgtggggaaattggtacatcaggtgtttggaaccgcctacggcgttctcttctccggtgtctcttggactatgaagattgggataggcatcctgttaacatggctgggactaaatagccgatcaaccagtctctccatgacatgtattgcagtgggcatggtgactctgtaccttggggtcatggttcaggcggacagcggatgcgtgatcaactggaaaggccgcgaattgaagtgtggttctgggatctttgtgaccaacgaggtacacacgtggacagaacaatataagttccaggctgattcaccgaaaagactgagtgccgcaattggaaaggcctgggaggagggcgtctgcggtataaggagcgctacccggctcgaaaatatcatgtggaaacagatttccaacgagctgaatcatatcttactggaaaacgacatgaagtttactgtggttgtgggcgacgccaatgggattcttacccagggcaagaagatgatccgccctcaacccatggagcacaaatactcttggaagtcgtggggcaaggcaaaaataatcggggctgatacacagaacactaccttcattatcgacggaccagatacacctgaatgtcccgacgatcagagagcctggaatatttgggaggtcgaggactatggctttggtgtgttcacgaccaacatctggttgaagctcagggatagctacactcagatgtgcgaccaccgtctgatgtccgcggccataaaagattcaaaggctgttcatgcagacatggggtattggattgaaagtgagaaaaatgaaacatggaagctagcccgggcttcttttatcgaggtgaagacctgtatttggccacgaagccacactctgtggtccaacggagtactcgaatcagagatgatcatacccaaaatctacggcggtcctattagccaacataattatagaccaggctacttcacacagaccgccgggccgtggcacctgggaaaacttgagttggatttcaacctgtgcgaaggcacgactgtcgtggtggacgagcactgcgggaataggggaccctctttacgcaccacaaccgtcactggcaaaatcattcatgaatggtgttgccggtcctgtacactccctccactgagatttaggggtgaggatgggtgctggtacggaatggagatccgccccgttaaggaaaaagaggaaaaccttgtgcgaagtatggtaagcgcaggctctggtgaggtggactccttctcactgggcttgctctgtgtcagtataatgattgaagaggtgatgcggagccgttggtcgagaaagatgctgatgaccgggacactagcggtatttttcctgctcatcatgggacagctgacttggaatgaccttatcaggttgtgcattatggtgggcgccaacgtctccgatcgcatggggatgggaaccacgtatctggctttaatggccacatttaagatgcggcctatgttcgcagtgggcctcctgtttagaaggcttacctctcgagaggttctgctactcactatcggtctgagcttggtggcttcagtcgaactgccaaacagtttagaggaactcggggacggactggccatgggcattatgatgcttaaactgttgaccgatttccaatcccaccagctctggacaactctgctatctctgacctttataaagacgacacttagcctcgactacgcatggaaaaccatggccatggtactgtccatcgtgtcattgttccccctgtgtttaagcactacaagtcagaagaccacttggctcccggttctgcttggctcttttgggtgcaaacctctgacaatgttcttgattaccgagaataagatctggggacgcaagtcctggccactcaacgaaggtattatggctgtgggcatcgtcagcatactgctatcgtcactgcttaaaaatgatgtgcccctcgcggggcctctgatcgccggaggcatgttgattgcatgttatgtaatctctggtagttccgctgacttaagcctggagcgggccgccgaggtgtcttgggaagaggaagctgagcatagcggggcatcccacaacattctcgtcgaagttcaggatgacggaacgatgaagatcaaagatgaggagagagacgatactctgaccatacttctgaaggccacattgctagcggtgtcaggcgtgtaccccatgagtattccagctaccctgtttgtctggtatttctggcagaagaagaaacagaggagcggcgtgctctgggacacaccttctcccccagaagttgagcgtgccgtactggatgacgggatctaccgcatccttcagcggggattactgggtagatcccaggtgggcgtcggggtgttccaagacggagtttttcatactatgtggcacgtgaccaggggcgcagtcctcatgtatcagggtaagcgattggaaccgtcatgggccagtgtgaagaaagatctgattagctacgggggaggctggcggttccagggctcctggaatacgggggaggaggtacaggtcatagctgtggaacctggaaagaaccccaaaaatgttcaaacaactccaggtacctttaagacacccgagggcgaagtgggggcaatcgccctcgacttcaaacctggaacctctggctcgccaattgtcaaccgcgagggtaagatcgtggggctgtacggaaatggcgttgtgactaccagcggcacatatgtctcagcgattgctcaggccaaggcatcccaggaagggccccttcctgagatcgaggatgaagtgtttaaaaagagaaacctgacgataatggacttgcacccgggaagtggtaaaactaggcggtacctaccagccatcgtacgagaggctattaagagaaaactgcgcaccctcatcttagcccccacaagggtggttgcatctgaaatggctgaggccctgaagggcatgcctattcgttatcaaaccactgcggtcaagagcgaacatacagggaaagagatcgtggatcttatgtgccacgccaccttcacgatgcggctgctctccccagtgagagtccccaattacaacatgataattatggacgaggcacattttactgatcctgcttcaatcgccgctaggggatatatctctacacgcgtaggcatgggtgaagcagccgccattttcatgaccgctaccccgcccgggagcgtggaggcgtttccacagagtaatgcagttatccaggacgaagaacgagatatacctgaaagatcctggaacagcggatacgactggattactgatttccccggcaagacagtgtggtttgtcccatctatcaaatcaggcaatgacattgccaactgtttgcggaagaacgggaaaagggtgatccagctgtcccgcaagaccttcgacacagagtatcaaaagactaaaaataacgattgggactacgttgtgacgaccgatataagtgagatgggagctaatttccgtgccgacagagtcattgatcctcggaggtgcctcaagcccgtgatcctgaaagacggtccagaacgcgtaatccttgcaggcccgatgcctgtgacagccgctagcgcggcccagcgaagagggcggattggaaggaaccagaataaggagggcgatcagtacatctatatgggtcaacccctaaacaatgacgaagatcacgcacattggactgaggctaaaatgctgttggacaacattaataccccagaggggataatccccgccttatttgaacctgagcgcgaaaagtcggcagccattgatggcgagtacagactgaggggagaagctcggaagacattcgttgagctcatgcgtcgcggcgacctgccagtctggctttcttataaagtggcctccgaggggtttcagtacagcgatcgaagatggtgcttcgacggagaaaggaacaatcaggtgctggaggaaaacatggacgtcgagatctggaccaaggaaggtgagcggaaaaagctccgccccagatggttggatgcgaggacttattcagaccctctggcactacgggagtttaaagagttcgccgctggccgaagaagtgtttctggggatctgatcctcgagattggaaaacttccgcagcacctgacgttacgcgcccaaaatgctttggacaacctggtgatgctccacaattccgaacagggcggtaaagcatacaggcatgccatggaggaactgccagataccatagagacacttatgctgctcgctttgatcgccgtactgactgggggcgtgaccttatttttcctaagcggaaagggcctggggaagacatcaattggactcctttgtgtcatggcaagtagcgtgctgttgtggatggcgtccgttgagccccactggatcgccgcttctattatcctggaatttttcctcatggtgctgcttatacctgagcccgaccggcagcgtaccccacaggataaccaactcgcctatgtcgtaatcggtctgttgtttatgattctgactgtggcagctaacgaaatgggcttactagagacaacgaaaaaggacctggggatcggacatgttgtggccgagaatcaccaccatgcaaccatgctcgatattgaccttcaccctgccagcgcttggactctgtacgcggtcgccacaaccatcataacccccatgatgagacatacaattgaaaacactacggcaaatatctccttgaccgctattgccaaccaggccgcaatcctgatgggcctcgataaaggttggccaatatcaaagatggacatcggggtgcctctgcttgctttaggctgctactctcaggtcaatccgctgacactcactgccgcggtgttgatgctggttgctcactatgccattatcggacccggcctacaagcaaaagccaccagggaggctcagaagcgcacagcagccgggattatgaagaacccaaccgtggatggaatcgtagcgatagacctggaccctgtggtctacgatgctaaattcgaaaagcagctcggccagattatgcttctgatcttgtgtacgagtcaaatcctgctcatgcggactacatgggccctgtgcgagtcgattaccttagcaactggtccccttaccacactgtgggaagggagcccaggaaaattttggaatactaccatcgccgtttccatggctaacatattccgaggctcttatctcgccggtgcaggcctagctttctcactgatgaaaagcctagggggaggcagaagggggacaggagcccagggcgagacgctgggtgagaaatggaagcgccagctcaatcagctttccaagagtgaatttaacacctacaaacggtctgggattatggaggtggacagaagcgaagcgaaggagggactgaaacgtggcgaaactacaaagcatgccgtctcaaggggtaccgcaaaattgcggtggttcgtggagcgcaatctggtaaagcctgagggcaaggtgatcgatctcgggtgtggacgaggcgggtggtcctattactgcgctggactaaagaaggttactgaagtgaaaggctatacaaagggtgggcccggacacgaggaaccgattccaatggccacctacggctggaacatcgtcaaactgcacagtggcagagacgtgtttttcacgcctcccgagaagtgtgatacccttctgtgcgacataggggaaagctctccaaatcccacaatcgaggagggaaggactctacgggtcctcaaaatggtggaaccttggctgcgcggtaaccaattttgtattaagatcttgaatccgtacatgccctccgttgtagagaccctggaacagatgcagagaaagcatggcgggatgctcgtgaggaacccactttcacgaaatagcacacacgagatgtattgggtctcgtgcggaactggcaacattgtgtctgcagttaacatgaccagtcggatgctgttaaatcgtttcacaatggctcatagaaaacctacctacgagcgcgatgtggacctgggtgccgggactaggcacgtcgccgtggaacccgagatcgcgaacttggatattatcggacagcggatagaaaatattaagaacgagcacaaatccacgtggcattatgacgaagataatccttacaagacatgggcttatcacggcagctacgaggtaaaaccatcaggctccgcatctagcatggtgaacggggttgtcagactcctgaccaagccctgggacgtgatccctatggtgactcaaatcgccatgaccgacacaacgccatttggacagcagcgcgtcttcaaggagaaagttgataccaggactccccgaccgaagcggggtacagctcaaattatggaagtgaccgccaaatggctatggggctttcttagtagaaataagaaacctaggatatgtactcgcgaggagttcacacgtaaggtacggtccaacgcagccatcggggctgtgtttgtcgacgagaatcagtggaacagcgcgaaggaagccgtggaggatgagagattctgggacctggttcatagggaacgcgagctccacaaacagggaaagtgcgcaacctgcgtgtataatatgatgggcaaacgagaaaagaaactgggtgagtttgggaaggctaagggatctcgggccatttggtacatgtggttgggcgcaagattcctggagttcgaggccctcggctttatgaacgaggatcattggttctcaagggaaaatagtctttccggggtcgagggagaaggtctgcacaaattaggctacatcctgcgcgacattagcaagatcccagggggaaacatgtatgctgatgacacagccggctgggatactagaataaccgaggacgatttgcagaatgaggcgaaaatcacggacattatggaacccgagcacgcactcctggccacctctatctttaagctaacataccaaaacaaagtggtacgggttcagaggcctgctaagtcgggtactgtgatggatgtcatttcacgtcgagaccagcgcgggagcggacaggtgggcacctatggccttaacacattcactaatatggaagtgcaactgatcagacagatggagtccgaagggatatttagtccatctgagctcgagaacagcaatctggccgaacgggtcttggactggttagagaaacatggagttgaaaggctgaagcgcatggcaatttccggtgatgactgtgtggtaaagcccaccgatgacagattcgctacggccctcacagctcttaacgatatgggcaaagtgcggaaggacatcccgcagtgggagccttcaaaagggtggaatgattggcagcaagtccccttttgcagtcaccatttccaccagctgatcatgaaggacggaagggaaattgtggttccatgtcgaaaccaggatgagctagtgggccgtgccagagtctctcagggtgcagggtggagcctgcgcgagaccgcgtgcctcggaaaatcctacgcccaaatgtggcagttgatgtattttcaccggagggacctgagacttgctgccaatgcaatatgttcagctgtgcctgtaaactgggttcccactagccgcacaacctggtctatccatgcccaccatcagtggatgactaccgaagatatgctgtccgtgtggaatcgggtctggattgaggaaaacccatggatggaggacaagacacacgtgagtagctgggaagacgttccctacctcggcaagagggaggatcaatggtgcggctcgttaatcgggctgacggcacgagccacctgggcgactaatattcaggtggctatcaaccaggtcagacggttgataggaaatgagaactatctggactacatgacatccatgaaaaggttcaagaatgaatctgatcctgagggtgccctctggtga

SEQ ID NO: 14081 - RNA, 9879 nt, synthetic construct
  misc_feature 1..9879: note = derived and/or modified CDS sequence (opt3) from DENV-1__JQ045628__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgcatttttcctggcacatgccatcggcacctcgattacgcagaagggcatcatatttatcctgctcatgttagtgactccatcaatggctatgcgctgcgtcgggattggaagcagagatttcgtggagggtctgagtggcgccacatgggtagacgttgtgcttgagcacgggtcctgtgtcaccactatggcgaaggataaacccacattggacatcgaactgctgaagaccgaggtgacgaaccctgcaattctcaggaaactgtgcatcgaagccaagatatctaataccacaactgatagccggtgtccaacccaaggagaggctacacttgtggaagaacaagacgccaactttgtctgccgccgaactttcgttgatagaggctggggtaatgggtgtggactgtttggcaaaggctccttgattacctgcgcaaagttcaagtgcgtgacaaaactcgaggggaagatcgtacagtacgaaaacctgaaatattcagtgattgtcaccgtgcacactggagaccagcatcaagttggtaatgagagtacggaacacggcacaaccgctactatcacaccccaagcccctaccaccgagatccagttaactgactacggggcgctgacactcgattgtagcccaaggacgggacttgactttaacgaaatggtgctgttgaccatgaaggagaaatcttggctagtccataagcagtggttcctggatctcccgctgccctggacttccggcgcctcaacaagccaagagacctggaatcggcaggaccttctggtgacatttaaaactgcacacgctaagaagcaggaagtagttgtgttgggtagtcaagagggggccatgcacaccgctctcacgggcgccaccgaaattcagacatctggaactaccacaatattcgcaggccatctgaaatgccgtttaaagatggataaactgactctaaaggggatgtcctatgtcatgtgtaccggatcgttcaaactcgagaaggaagtggccgagacgcagcacggtacagtcctggtgcagatcaagtacgagggcaccgacgctccttgcaaaattccattttcgactcaagatgaaaagggggttacacagaacggacgccttatcaccgcgaatcccatagtgactgacaaagagaagcctgtaaacattgaagcagagccacccttcggcgagtcttatatcgtcatcggtgccggggaaaaggctttgaagctgtcctggtttaagaaaggctcaagtattggaaagatgttcgaggccaccgcaagaggcgccaggcggatggctatcctcggggatacagcctgggactttggaagcattggtggcgtgttcacgtccgttgggaaactggtgcatcagatatttggaaccgcatacggcgtccttttctctggtgtgagctggactatgaagatcgggattggcgtactgttgacatggctcggactaaattcacgaagtacctccttaagcatgacatgtatcgcggtgggcctggttactctatacctcggggtcatggtgcaggctgattctggatgcgtgatcaactggaaaggccgcgaactgaagtgtggttcagggatttttgtcaccaatgaggttcacacgtggacagaacaatataagttccaggccgacagtccgaaaagacttagcgcagccataggaaaggcttgggaggagggcgtgtgcggtatcaggtccgccacccggttggaaaacattatgtggaaacagatctctaacgagctgaatcatattctcctggaaaacgacatgaagtttactgtggtagtcggcgatgtggcagggatcttagctcagggcaagaaaatgatacgccctcaacccatggagtacaaatattcgtggaaaagctggggcaaggccaagatcattggggcggacgttcagaataccacattcatcattgatggaccaaacactcctgaatgtcccgacgatcagagagcctggaatatctgggaggtggaggactacggctttggtatattcaccacaaacatttggctgaaacttagggattcctatacgcaggtctgcgaccaccgtttgatgtcagctgcaatcaaagatagtaaggccgtgcacgctgacatggggtactggattgaatctgagaaaaatgaaacctggaagctcgcccgggcttccttcatcgaggttaagacttgtatatggccaaaatcccatacactgtggtcaaacggagtgctagaaagcgagatgatcattcccaagatctatggcggtcctatttctcaacacaattaccgaccaggctactttacccagactgcggggccgtggcatctgggaaaactcgagctggatttcgacctttgcgaaggcacaaccgtagtcgtggatgagcactgcgggaacagaggaccctccttgaggacgactaccgtgacaggcaagatcatacacgaatggtgttgccgcagttgtaccctgcctccattacggtttagaggtgaggacgggtgctggtatggaatggagattaggcccgtcaaagaaaaggaggaaaatctcgttaagagcatggtgtctgccggctccggtgaggtagactcattcagtctgggccttctgtgtatcagcatcatgattgaagaggtgatgcgctcgcgatggtcccggaaaatgttgatgactgggacactcgctgtctttctgctactgatcatgggacagctcacctggaacgatctgattcgtctttgcataatggtgggcgccaatgcatctgacagaatggggatgggaacaacttacttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcatcagttgtgggcgactctcctgagcctaaccttcattaagacaactttttccctgcactatgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttacgtgattagtggttccagcgccgacttgtctttagagaaagcggctgaggtcagctgggaagaggaagccgagcattccggggcatcacacaatatcctggtggaagtacaggatgacggaaccatgaagatcaaagatgaggagcgcgacgatactctcacaattctgcttaaggccaccctgttggctgtgagtggcgtctatcccctaagcataccagcaacgctgttcgtttggtacttctggcagaagaagaagcagcggtctggcgtgctctgggacactccttcacccccggaagtggagagagccgtcctggatgacgggatctataggattatgcagcgtggacttttaggtcgcagccaggtgggcgttggggtatttcaagaaaacgtgttccataccatgtggcacgtcacacggggagcggtgctgatgtaccagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacaactccaggaacctttaagacgctcgaaggtgaggtcggcgcaatcgccctggatttcaagcccgggacatcgggaagccctatagtgaaccgagaaggcaaaatcgttggtctttatgggaatggagtggtcactacctcaggcacatacgtgtccgctattgcccaggcaaaggctagtcaggagggcccactgcccgagatcgaagacgaggtttttcggaaacgcaacttgaccattatggatctacaccctgggtctggaaagactagaaggtatctgccggccatcgtgcgggaagcgataaaacgaaagctcagaaccttaattctggccccaacacgcgtcgtggcaagcgagatggctgaagcccttaagggtatgcccatcaggtaccaaacgactgctgtaaaatccgagcataccggcaaggagatcgtggacctgatgtgccacgcaacattcaccatgcgtctcttgtcacctgttcgggtcccaaattataacatgattatcatggatgaagcccattttactgacccctctagcatagccgctagagggtacattagtacaagggtgggaatgggcgaggcggcagccatcttcatgaccgctacgcctccgggttccgtggaagcctttccccagagcaatgcagtcattcaggatgaggaacgcgacatcccagagcgatcttggaactcagggtatgagtggataactgatttccctggaaaaacagtatggtttgtgccctccattaagagtggcaatgacatcgccaactgtctgaggaagaatggcaagcgggttatccagctcagcaggaagaccttcgataccgaataccagaaaactaagaacaacgactgggactacgtggtcacaaccgatatttcggagatgggggctaatttccgcgcggaccgtgtgatcgatccaagacggtgcctgaaacctgttattcttaaggacggacccgaaagggtgatactagccggtccaatgccggtcacagtggcatctgctgcccagcgccgaggcagaatcgggcggaaccacaataaagagggagatcagtatatttacatgggccagcctctgaacaatgacgaggatcatgcacactggactgaagccaagatgttgttagacaacatcaatacgcccgagggtatcattccagctctgtttgaacccgagagggaaaagtccgccgcgatagatggggagtatcgcctcagaggcgaggcaaggaaaaccttcgtagaactgatgcggcgtggagaccttcctgtgtggctgagctacaaggttgcctcagagggctttcaatatagtgatcgccgatggtgcttcgacggggaaagaaacaatcaggtcctcgaggaaaacatggatgtggagatctggacaaaagagggagaaaggaagaaattgcggccacgctggctggacgctagaacttactctgaccccctagccctgagggagtttaaggagttcgctgcaggtcggcgatccgtgagcggcgatctcattcttgagatcgggaaactgcctcagcacttaacccagagagcccaaaatgctttggacaacctggtcatgctccataattcagaacagggaggccgcgcctataggcacgcaatggaggagctgccggatacaattgaaacccttatgctgctcgcgttgatcgccgttctgactggtggggtgacgttatttttcctaagtggccggggactgggcaagaccagcatagggctcctttgtgtaatcgcttcctctgtgctgttgtggatggccagcgtcgagccacattggattgcagcttccatcattctggaatttttcctcatggtgctgcttatccccgagcctgaccgtcagagaacaccccaggataaccaactcgcctacgttgtgataggactgttgtttatgattctgactgtcgcagccaatgagatgggtttactagaaaccacaaagaaagacctgggcatcgggcacgtagctgtgggaaaccaccatcacgcggccatgctcgatgttgaccttcatccagcatcagcttggaccctgtacgccgtggccactacaattatcacgcctatgatgaggcacaccatagagaacactacagcaaatatctctttgaccgctattgccaaccaggcggctatcctgatgggcctcgataagggttggcccattagtaaaatggacatcggggtcccactgcttgccttaggctgctatagccaggtgaatcctctgaccctcacagcagccgtcttgatgctggtggctcattacgcaataattggaccgggcctacaagccaaggcgactcgcgaagctcagaaacggacggccgcagggatcatgaagaaccccaccgttgatggaatcgtggccattgacctggatccagtagtgtatgacgctaagttcgagaaacagctcggccagatcatgcttctgatattgtgtacaagccaaattctgctcatgcgaactacctgggccctgtgcgaatccatcacattagcaaccggtcctcttactacgctgtgggaggggtctcccggaaagttttggaatacaaccattgctgtctcaatggccaacatcttcagaggcagctacctcgcgggtgccggcctagcattctccctgatgaaaagtctagggggaggcaggcgcgggactggagctcagggcgagaccctgggtgaaaagtggaaacggcagctcaatcagctttctaagagcgagtttaacacatataagagatcagggataatggaagttgaccgttccgaggccaaagaaggactgaagaggggcgagactaccaaacacgcagtgagtcggggtacagctaagttgcgctggttcgtcgagcgaaatctggtgaaaccagaaggcaaggtaatcgatctcgggtgtggaagaggcgggtggagctactattgcgccggattaaagaaagtgacggaggttaagggctacaccaaaggtgggcctggacacgaggaacccattccgatggccacttacggctggaacctggtgaaacttcattctggcaaagacgtctttttcatcccacctgaaaagtgtgatacactgctatgcgacattggggagtcctcacccaatccaaccatcgaggaaggaaggactctccgggtgctgaaaatggtcgagccctggttgcgcggtaaccaattttgtattaagatcctgaatccttatatgccgagcgtggttgaaacactcgagcagatgcagagaaagcacggcgggatgcttgtaaggaaccccctgtcgcgaaattctacccatgagatgtactgggtgagttgcggaacgggcaacatagtctccgcggtgaatatgaccagccggatgttactgaaccgtttcacaatggctcacagaaaaccaacttatgaacgcgatgttgacttgggtgcagggaccaggcacgtggccgtcgagcctgaagtggctaacctcgatattatcggacagcggatcgagaatattaagcatgaacacaaatcaacatggcattacgacgaggataacccctataagacttgggcctaccacggctcctatgaggtaaaaccttctggcagcgcaagttccatggtgaatggggttgtcaagctgctaaccaagccatgggacgtgatacccatggtgacacaaatcgccatgaccgatactacgccttttggacagcagagagtcttcaaagaaaaggttgacacacgcaccccaaaagctaagaggggtactgcgcaaattatggaggtgaccgccaaatggctttggggctttctgagccgaaacaagaagccccggatctgtacaagagaagagttcacgaggaaagtacgctctaatgcagctattggggccgtgtttgtcgacgaaaaccagtggaactcagcaaaggaggccgtggaggatgaacgtttctgggacctcgttcatcgggagagagaactgcacaaacagggaaagtgcgctacctgcgtgtacaacatgatgggcaaaagggagaagaagttgggtgaatttgggaaagccaagggaagtcgcgcgatctggtacatgtggctgggcgcacgattcctcgagttcgaggcccttggctttatgaatgaagatcactggttctcccgggagaacagcctgtctggggtcgaaggagagggtttacataaactgggctatatattgagagacatctcgaagattccagggggaaatatgtacgctgatgacactgccggctgggatacaaggatcaccgaggacgatctccagaacgaagcacgcattactgacatcatggagcctgaacacgctctgctagccaaatcaatatttaaacttacatatcaaaataaagtggtaagagttcagcggccagctaagaacggtaccgtgatggatgtcattagcaggcgtgaccagcgagggtccggacaggtgggcacatacggcctgaatactttcaccaacatggaggcccaactcatccgccagatggaaagtgaggggatcttttctcccagcgagctggaaacgcctaacttggcagagagagtgttagattggctggaaaagtatggagtcgagcggctcaaaaggatggcgatttccggtgacgactgtgttgtgaagccaatagatgaccgcttcgccaccgctcttacagccctgaatgatatgggcaaagtaagaaaggacatcccccagtgggaaccgtcaaaagggtggaacgattggcagcaagtgcctttttgcagtcatcacttccaccagctaattatgaaggacggacgggagatcgtcgtgccctgtaggaatcaggatgagctggttggccgagcacgtgtgtctcagggtgctgggtggagcctcagagaaactgcctgcttgggaaagtcctacgcacaaatgtggcagctgatgtattttcatcgccgggaccttaggctggccgcgaacgctatttgttcagccgtcccagtggattggatccctaccagcagaacaacttggtctatacacgcacatcaccagtggatgaccacggaggacatgctctccgtatggaatcgcgtttggatcgaagagaacccctggatggaagataaaacacatattagtagctggggcgacgtgccatacttaggcaagcgggaggaccaatggtgcgggtcgctgatcggattgaccgccagggctacttgggccacaaatattcaggtcgcaatcaaccaggtgcgaagactgattggtaatgagaactacctcgattatatgacctccatgaaacggttcaagaatgaatctgaccccgagggcgctctttggtga

SEQ ID NO: 14082 - RNA, 9879 nt, synthetic construct
  misc_feature 1..9879: note = derived and/or modified CDS sequence (opt3) from DENV-1__JQ045629__SS-prME
  source 1..9879: mol_type = other RNA
agcgtgaccatgctgctcatgcttatgcccacggccctggctttccacttgactacgagaggaggggaacctcatatgatggtctccaagcaggaaagaggaaaatctttactgtttaagacctcagccggtgttaatatgtgcacactgatcgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttatcgctctgtttctggcacatgccattggcacctcgatcacgcagaagggcattatcttcatactcttaatgctggtgactccatcaatggctatgcgctgcgtcgggatcggaagcagagattttgtggagggtcttagtggcgccacatgggtagacgttgtgttggagcacgggtcctgtgtcaccactatggcgaaggataaacccacactggacattgaactactcaagaccgaggtgacgaaccctgcagtgctgaggaaactttgcatcgaagccaagatttctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagatagtgcagtacgaaaacttaaaatattcagtcattgtgaccgttcacactggagaccagcatcaagtgggtaatgagagtacggaacacggcacaaccgctactatcacaccccaagcccctaccaccgagattcagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatctttgcaggccatttaaaatgccgtctgaagatggataaactaactctcaaggggatgtcctatgtgatgtgtaccgggtcgttcaaactggagaaggaacttgccgagacgcagcacggtacagtcttggtgcagattaagtacgagggcaccgacgctccttgcaaaataccattctcgactcaagatgaaaagggggttacacagaacggacgcctgatcaccgcgaatcccattgtgactgacaaagagaagcctgtaaacatcgaagcagagccaccctttggcgagtcttatatagtcattggtgccggggaaaaagctctcaagctgtcctggttcaagaaaggctcaagtatcggaaagatgtttgaggccaccgcaagaggcgccaggcggatggctatccttggggatacagcctgggacttcggaagcattggtggcgtgtttacgtccgttgggaaactggtgcatcagatcttcggaaccgcatacggcgtcttgttttctggtgtgagctggactatgaagattgggataggcgtactcctgacatggttaggactaaattcacgaagtacctccctaagcatgacatgtatcgcggtgggcctcgttactctgtaccttggggtcatggtgcaggctgattctggatgcgtgattaactggaaaggccgcgaattgaagtgtggttcagggatcttcgtcaccaatgaggttcacacgtggacagaacaatataagtttcaggccgacagtccgaaaagactgagcgcagccatcggaaaggcttgggaggagggcgtgtgcggtattaggtccgccacccggctcgaaaacataatgtggaaacagatctctaacgagctgaatcatattttactggaaaacgacatgaagttcactgtggtagtcggcgatgtggcagggatccttgctcagggcaagaagatgattcgccctcaacccatggagtacaaatattcgtggaaaagctggggcaaggccaagatcataggggcggacgttcagaataccacatttatcattgatggaccaaacactcctgaatgtcccgacgatcagagagcctggaatatctgggaggtggaggactacggcttcggtatttttaccacaaacatctggttgaagctcagggattcccacacgcaggtctgcgaccaccgtctgatgtcagctgcaataaaagatagtaaggccgtgcatgctgacatggggtattggattgaatctgagaaaaatgaaacctggaagctagcccgggcatccttcatcgaggttaagacttgtatttggccaaaatcccacacactgtggtcaaacggagtgctcgaaagcgagatgatcatacccaagatctacggcggtcctatttctcaacataattatcgaccaggctacttcacccagactgcggggccgtggcacctgggaaaacttgagttggattttgacctgtgcgaaggcacaaccgtagtcgtggatgagcactgcgggaacagaggaccctccttaaggacgactaccgtgacaggcaagatcattcatgaatggtgttgccgcagttgtaccctccctccactgcggttcagaggtgaggacgggtgctggtacggaatggagatcaggcccgtcaaagaaaaggaggaaaatcttgttaagagcatggtgtctgccggctccggtgaggtagactcatttagtctgggcttgctctgtataagcattatgatcgaagaggtgatgcgctcgcgatggtcccggaaaatgctgatgactgggacactagctgtcttctttctgctcatcatgggacagctgacctggaacgatcttattcgtttgtgcatcatggtgggcgccaatgcatctgacagaatggggatgggaacaacttatctggctttaatggccaccttcaagatgaggcctatgtttgcagttggcctcctgttccgccggcttacgagcagagaggtgctgctactcacaattggtctgtcattggtcgccagtgtggaactgccaaactccttagaggaactcggggatggactggctatgggcataatgatccttaaactgttgaccgactttcaatctcaccagctctgggcgactctgctaagcctgaccttcattaagacaactttttcccttcattacgcctggaaaaccatggcaatggttctctcaatcgtgagcctgttccccttgtgtctgagtacgacatctcagaagaccacttggttaccggtcctcctgggctcccttgggtgcaagcctctgacaatgtttttgattgctgagaataaaatctggggaaggcgaagctggccactcaacgaaggtataatggccgtaggcatcgtgtcgattctgctatcatctctgcttaagaacgatgttcccctcgccgggcctctgatcgctggaggcatgttgattgcatgttatgtgatcagtggttccagcgccgacttatctctggagaaagcggctgaggtcagctgggaagaggaagccgagcactccggggcatcacataatatactcgtggaagtacaggatgacggaaccatgaagattaaagatgaggagcgcgacgatactctgacaatccttctgaaggccaccttgctagctgtgagtggcgtctaccccctgagcatcccagcaacactcttcgtttggtatttctggcagaagaagaagcagcggtctggcgtgctgtgggacactccttcacccccagaagtggagagagccgtccttgatgacgggatttacaggataatgcagcgtggattactgggtcgcagccaggtgggcgttggggtatttcaagaaaacgtgttccacaccatgtggcacgtcacacggggagcggtgctcatgtatcagggcaaaagattggagccgagttgggctagcgttaagaaagacctgatctcctacggtgggggatggaggctccagggctcttggaataccggcgaggaagtgcaggtcattgccgtggagcctgggaagaaccccaaaaatgtacaaacagcaccaggaacttttaagacccccgaaggtgaggtcggcgccatcgctctggatttcaagcctgggacgtcgggaagcccaattgtgaaccgagaaggcaaaatcgttggtctttacgggaatggagtggtcacaacttcaggcacctatgtgtccgccatagcacaggctaaggccagtcaggagggccccctgcctgagatcgaagacgaggtttttcggaaacgcaacttgacaattatggatctacatccggggtctggaaagaccagaaggtacctgccagcgatcgtgcgggaagccattaaacgaaagctcagaactttaatcctggcacccacccgcgtcgtggctagcgagatggccgaagctcttaagggtatgcctataaggtatcaaacaacggcagtaaaatccgagcacactggcaaggagattgtggacctgatgtgccatgccaccttcacaatgcgtctcttgtcaccagttcgggtccccaattacaacatgatcatcatggatgaagcccactttaccgacccttctagcattgctgcgagagggtatatcagtactagggtgggaatgggcgaggcagccgctatattcatgacagccaccccgcccggttccgtggaagcatttccacagagcaatgccgtcattcaggatgaggaacgcgacatccctgagcgatcttggaactcagggtacgagtggattacggatttccccggaaaaactgtatggtttgtgccatccatcaagagtggcaatgacatagctaactgtctgaggaaaaatggcaagcgggttattcagctcagcaggaagacattcgataccgaatatcagaaaaccaagaacaacgactgggactacgtggtcactacagatatctcggagatgggggcgaatttccgcgccgaccgtgtgatcgatcctagacggtgcctgaaacccgttattcttaaggacggaccagaaagggtgatcctagcaggtccgatgcctgtcaccgtggcttctgccgcacagcgccgaggcagaattgggcggaaccataataaagagggagatcagtacatatatatgggccagcccctgaacaatgacgaggatcacgcccactggacagaagctaagatgttgttagacaacatcaatactccagagggtattatccccgccctgtttgaacctgagagggaaaagtccgcggcaatcgatggggagtaccgcctcagaggcgaggccaggaaaacgttcgtagaactgatgcggcgtggagaccttccagtgtggctgagctataaggttgcttcagagggctttcaatacagtgatcgccgatggtgcttcgacggggaaagaaacaatcaggtcctcgaggaaaacatggatgtggagatttggaccaaagagggagaaaggaagaaattgcggccccgctggctggacgccagaacatattctgaccctctagctctgagggagtttaaggagttcgcagccggtcggcgatccgtgagcggcgatctcatacttgagatcgggaaactgccgcagcatttaactcagagagctcaaaatgccttggacaacctggtcatgctccacaattcagaacagggaggccgcgcatacaggcatgcgatggaggagctgccagataccattgaaacacttatgctgctcgccttgatcgctgttctgaccggtggggtgactttatttttcctaagtggccggggactgggcaagacgagcattgggctcctttgtgtaatggcctcctctgtgctgttgtggatggcaagcgtcgagccccactggatcgctgcctccataatcctggaatttttcctcatggtgctgcttattcctgagcccgaccgtcagagaaccccacaggataaccaactcgcatatgttgtgatcggactgttgtttatgattctgacagtcgccgctaatgagatgggtttactagaaactaccaagaaagacctgggcatcgggcacgtagcggtggagaaccatcaccatgccgcaatgctcgatgttgaccttcaccctgcttcagcctggacactgtacgccgtggcaaccactataattacacccatgatgaggcatacgatcgaaaacaccactgctaatatttctttgacagccatcgcgaaccaggctgccatactgatgggactcgataagggctggccaatcagtaaaatggacattggtgtccctctgcttgcattagggtgctacagccaggtgaatccgctgaccctcaccgccgctgtcttgatgctggtggcacactatgccatcattggccccggactacaagcgaaggctacacgcgaggcccagaaacggactgcagccggcatcatgaagaacccaacggttgatgggatagtggctattgacctggatcctgtagtgtacgacgccaagttcgaaaaacagctcggacagatcatgcttctgatcttgtgtaccagccaaattctgctcatgcgaacaacttgggcactgtgcgagtccatcaccttagctacaggcccccttaccactctgtgggagggttctccagggaagttttggaatacgacaatagccgtctcaatggcgaacattttcagaggaagctatctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctacaagagatcaggtatcatggaggttgaccgttccgaagcaaaagaggggctgaagaggggagagacaactaaacacgctgtgagtcggggcaccgccaagttgcgctggttcgtcgaacgaaatctggtgaaacctgagggtaaggtaattgatctcggctgtgggagaggaggctggagctattactgcgccgggttaaagaaagtgacagaagttaagggatatacgaaaggcggtcccgggcatgaggaaccgatcccaatggcgacctacggatggaacctggtgaaacttcactctggcaaagacgtctttttcatacctcccgagaagtgtgatactctgctatgcgacatcggcgagtcctcaccaaatcccacaattgaagaggggaggaccctccgggtgctgaaaatggtcgaaccttggttgcgcggaaaccaattttgtatcaagattctgaatccgtacatgcccagcgtggttgagactctcgagcagatgcagagaaagcatggtggcatgcttgtaaggaacccactgtcgcgaaattctacacacgaaatgtattgggtgagttgcgggaccggaaacatcgtctccgctgtgaatatgacgagccggatgttactgaaccgtttcaccatggcacacagaaaacctacatacgagcgcgatgttgacttgggcgccggtactaggcatgtggctgtcgaacccgaggtggccaacctcgatattatcgggcagcggatagaaaatattaagcacgagcataaatcaacctggcactatgacgaggataacccttacaagacatgggcatatcatggatcctacgaagtaaaaccatctggcagcgccagttccatggtgaatggcgttgtcaagctgctaactaagccctgggacgtgatccctatggtgacccaaatcgctatgacagataccactccatttgggcagcagagagtcttcaaagagaaggttgacacgcgcacacccaaagcgaagaggggaaccgcccaaattatggaagtgactgcaaaatggctttggggttttctgagccgaaacaagaagccgcggatatgtaccagagaggagttcacaaggaaagtacgctctaatgctgccatcggcgcagtgtttgtcgacgagaaccagtggaactcagccaaggaggctgtggaagatgagcgtttctgggacctcgttcaccgggaaagagagctgcacaaacaggggaagtgcgccacgtgcgtgtataacatgatgggaaaaagggaaaagaagttgggcgagtttggtaaagcgaaggggagtcgcgcaatttggtacatgtggctgggagcccgattcctcgagttcgaagctcttggctttatgaatgaggatcattggttctcccgggaaaacagcctgtctggcgtcgagggggagggattacacaaactgggttacatcttgagagacatttcgaagatccctggcgggaatatgtatgccgatgacaccgcaggatgggatactaggataacagaagacgatctccagaacgaggctcgcatcaccgacattatggaaccagagcatgccctgctagctaaatcaatctttaaacttacttaccaaaataaagtggtaagagttcagcggcccgccaagaacggcacagtgatggatgtcattagcaggcgtgaccagcgaggttccggacaggtgggaacctatggcctgaatacattcactaacatggaagcacaactcatccgccagatggagagtgagggcatattttctcctagcgaactggagaccccaaacttggcggaaagagtgttagattggctggagaagtacggggtcgaacggctcaaaaggatggccatttccggagacgactgtgttgtgaagcccatcgatgaccgcttcgctacggcccttaccgcactgaatgatatgggtaaagtaagaaaggacatcccgcagtgggagccttcaaaaggctggaacgattggcagcaagtgcccttttgcagtcaccacttccatcagctaattatgaaggacgggcgggagatagtcgtgccatgtaggaatcaggatgaactggttggacgagctcgtgtgtctcagggcgccggttggagcctcagagagacagcatgcttggggaagtcctatgcccaaatgtggcagctgatgtactttcaccgccgggaccttaggctggcggctaacgccatctgttcagcagtccctgtggattggattcccactagcagaaccacatggtctatccatgcccaccatcagtggatgactaccgaagacatgctctccgtatggaatcgcgtttggattgaggaaaacccatggatggaggataaaacgcacatcagtagctggggagacgtgccctatttaggcaagcgggaggaccaatggtgcggctcgctgatagggttgacagctagggccacctgggcaactaatatccaggtcgctattaaccaggtgcgaagactgatcggaaatgaaaactacctcgattacatgacatccatgaaacggttcaagaatgagtctgaccctgaaggtgccctttggtga

SEQ ID NO: 14083 - RNA, 9879 nt, synthetic construct
  misc_feature 1..9879: note = derived and/or modified CDS sequence (opt3) from DENV-1__JQ045630__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaagacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaagcccctaccaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggatcgttcaaactggagaaggaagtggccgagacgcagcacggtacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgccagtgtggaactgccaaactccttagaggaactcggggatggactggctatgggcattatgatccttaaactgttgaccgacttccaatctcatcagctctgggcgactctgctaagcctgacctttattaagacaactttctcccttcactatgcctggaaaaccatggcaatggttctctcaatcgtgagcctgtttcccttgtgtctgagtacgacatctcagaagaccacttggttaccggtcctcctgggctcccttgggtgcaagcctctgacaatgttcttgatagctgagaataaaatctggggaaggcgaagctggccactcaacgaaggtattatggccgtaggcatcgtgtcgattctgctatcatctctgcttaagaacgatgttcccctcgccgggcctctgatcgctggaggcatgttgatagcatgttacgtgattagtggttccagcgccgacttatctctggagaaagcggctgaggtcagctgggaagaggaagccgagcattccggggcatcacacaatatcctcgtggaagtacaggatgacggaaccatgaagatcaaagatgaggagcgcgacgatactctgacaattcttctgaaggccaccttgctagctgtgagtggcgtctatcccctgagcataccagcaacgctctttgtttggtacttctggcagaagaagaagcagcggtctggcgtgctgtgggacactccttcacccccagaagtggagagagccgtccttgatgacgggatctataggattatgcagcgtggattactgggtcgcagccaggtgggcgttggggtattccaagaaaacgtgtttcataccatgtggcacgtcacacggggagcggtgctcatgtaccagggcaaaagattggagccgagttgggctagcgttaagaaagacctgatctcctacggtgggggatggaggctccagggctcttggaataccggcgaggaagtgcaggtcattgccgtggagcctgggaagaaccccaaaaatgtacaaacaactccaggaaccttcaagacgcccgaaggtgaggtcggcgcaatcgccctggattttaagcctgggacatcgggaagcccaatagtgaaccgagaaggcaaaatcgttggtctttatgggaatggagtggtcactacctcaggcacatacgtgtccgctattgcccaggcaaaggctagtcaggagggccccctgcctgagatcgaagacgaggttttccggaaacgcaacttgaccattatggatctacacccggggtctggaaagactagaaggtatctgccagccatcgtgcgggaagcgataaaacgaaagctcagaaccttaattctggcccccacacgcgtcgtggcaagcgagatggctgaagcccttaagggtatgcctatcaggtaccaaacgactgctgtaaaatccgagcataccggcaaggagatcgtggacctgatgtgccacgcaacatttaccatgcgtctcttgtcaccagttcgggtccccaattataacatgattatcatggatgaagcccatttcactgacccttctagcatagccgctagagggtacattagtacaagggtgggaatgggcgaggcggcagccatctttatgaccgctacgccgcccggttccgtggaagccttcccacagagcaatgcagtcattcaggatgaggaacgcgacatccctgagcgatcttggaactcagggtatgagtggataactgattttcccggaaaaacagtatggttcgtgccatccattaagagtggcaatgacatcgccaactgtctgaggaaaaatggcaagcgggttatccagctcagcaggaagacctttgataccgaataccagaaaactaagaacaacgactgggactacgtggtcacaaccgatatttcggagatgggggctaatttccgcgcggaccgtgtgatcgatcctagacggtgcctgaaacccgttattcttaaggacggaccagaaagggtgatactagccggtccgatgcctgtcacagtggcatctgctgcccagcgccgaggcagaatcgggcggaaccacaataaagagggagatcagtatatttacatgggccagcccctgaacaatgacgaggatcatgcacactggactgaagccaagatgttgttagacaacatcaatacgccagagggtatcattcccgctctgttcgaacctgagagggaaaagtccgccgcgatagatggggagtatcgcctcagaggcgaggcaaggaaaacctttgtagaactgatgcggcgtggagaccttccagtgtggctgagctacaaggttgcctcagagggcttccaatatagtgatcgccgatggtgctttgacggggaaagaaacaatcaggtcctcgaggaaaacatggatgtggagatctggacaaaagagggagaaaggaagaaattgcggccccgctggctggacgctagaacttactctgaccctctagccctgagggagttcaaggaatttgctgcaggtcggcgatccgtgagcggcgatctcattcttgagatcgggaaactgccgcagcacttaacccagagagcccaaaatgctttggacaacctggtcatgctccataattcagaacagggaggccgcgcctataggcacgcaatggaggagctgccagatacaattgaaacccttatgctgctcgcgttgatcgccgttctgactggtggggtgacgttattctttctaagtggccggggactgggcaagaccagcatagggctcctttgtgtaatcgcttcctctgtgctgttgtggatggccagcgtcgagccccattggattgcagcttccatcattctggagttctttctcatggtgctgcttatccctgagcccgaccgtcagagaacaccacaggataaccaactcgcctacgttgtgataggactgttgttcatgattctgactgtcgcagccaatgagatgggtttactagaaaccacaaagaaagacctgggcatcgggcacgtagctgtgggaaaccaccatcacgcggccatgctcgatgttgaccttcatcctgcatcagcttggaccctgtacgccgtggccactacaattatcacgcccatgatgaggcacaccatagagaacactacagcaaatatctctttgaccgctattgccaaccaggcggctatcctgatgggcctcgataagggttggccaattagtaaaatggacatcggggtccctctgcttgccttaggctgctatagccaggtgaatccgctgaccctcacagcagccgtcttgatgctggtggctcattacgcaataattggacccggcctacaagccaaggcgactcgcgaagctcagaaacggacggccgcagggatcatgaagaacccaaccgttgatggaatcgtggccattgacctggatcctgtagtgtatgacgctaagtttgagaaacagctcggccagatcatgcttctgatattgtgtacaagccaaattctgctcatgcgaactacctgggccctgtgcgaatccatcacattagcaaccggtccccttactacgctgtgggaggggtctccaggaaagttctggaatacaaccattgctgtctcaatggccaacatctttagaggcagctacctcgcgggtgccggcctagcattctccctgatgaaaagtctagggggaggcaggcgcgggactggagctcagggcgagaccctgggtgaaaagtggaaacggcagctcaatcagctttctaagagcgagttcaacacatataagagatcagggataatggaagttgaccgttccgaggccaaagaaggactgaagaggggcgagactaccaaacacgcagtgagtcggggtacagctaagttgcgctggtttgtcgagcgaaatctggtgaaacctgaaggcaaggtaatcgatctcgggtgtggaagaggcgggtggagctactattgcgccggattaaagaaagtgacggaggttaagggctacaccaaaggtgggcccggacacgaagaaccgattccaatggccacttacggctggaacctggtgaaacttcattctggcaaagacgtcttctttatccctcccgaaaagtgtgatacactgctatgcgacattggggagtcctcaccaaatcccaccatcgaggaaggaaggactctccgggtgctgaaaatggtcgagccttggttgcgcggtaaccaattctgtattaagatcctgaatccgtatatgcccagcgtggttgaaacactcgagcagatgcagagaaagcacggcgggatgcttgtaaggaacccactgtcgcgaaattctacccatgagatgtactgggtgagttgcggaacgggcaacatagtctccgcggtgaatatgaccagccggatgttactgaaccgttttacaatggctcacagaaaacctacttatgaacgcgatgttgacttgggtgcagggaccaggcacgtggccgtcgagcccgaagtggctaacctcgatattatcggacagcggatcgagaatattaagcatgaacacaaatcaacatggcattacgacgaggataacccttataagacttgggcctaccacggctcctatgaggtaaaaccatctggcagcgcaagttccatggtgaatggggttgtcaagctgctaaccaagccctgggacgtgatacctatggtgacacaaatcgccatgaccgatactacgccattcggacagcagagagtctttaaagaaaaggttgacacacgcacccccaaagctaagaggggtactgcgcaaattatggaggtgaccgccaaatggctttggggcttcctgagccgaaacaagaagccgcggatctgtacaagagaagagtttacgaggaaagtacgctctaatgcagctattggggccgtgttcgtcgacgaaaaccagtggaactcagcaaaggaggccgtggaggatgaacgtttttgggacctcgttcatcgggagagagaactgcacaaacagggaaagtgcgctacctgcgtgtacaacatgatgggcaaaagggagaagaagttgggtgagttcgggaaagccaagggaagtcgcgcgatctggtacatgtggctgggcgcacgatttctcgagttcgaggcccttggcttcatgaatgaagatcactggttttcccgggagaacagcctgtctggggtcgaaggagagggtttacataaactgggctatatattgagagacatctcgaagattcctgggggaaatatgtacgctgatgacactgccggctgggatacaaggatcaccgaggacgatctccagaacgaagcacgcattactgacatcatggagccagaacacgctctgctagccaaatcaatattcaaacttacatatcaaaataaagtggtaagagttcagcggcccgctaagaacggtaccgtgatggatgtcattagcaggcgtgaccagcgagggtccggacaggtgggcacatacggcctgaatacttttaccaacatggaggcccaactcatccgccagatggaaagtgaggggatcttctctcctagcgagctggaaacgccaaacttggcagagagagtgttagattggctggaaaagtatggagtcgagcggctcaaaaggatggcgatttccggtgacgactgtgttgtgaagcccatagatgaccgctttgccaccgctcttacagccctgaatgatatgggcaaagtaagaaaggacatcccgcagtgggaaccttcaaaagggtggaacgattggcagcaagtgcccttctgcagtcatcactttcaccagctaattatgaaggacggacgggagatcgtcgtgccatgtaggaatcaggatgagctggttggccgagcacgtgtgtctcagggtgctgggtggagcctcagagaaactgcctgcttgggaaagtcctacgcacaaatgtggcagctgatgtatttccatcgccgggaccttaggctggccgcgaacgctatttgttcagccgtccctgtggattggatccccaccagcagaacaacttggtctatacacgcacatcaccagtggatgaccacggaggacatgctctccgtatggaatcgcgtttggatcgaagagaacccatggatggaagataaaacacatattagtagctggggcgacgtgccctacttaggcaagcgggaggaccaatggtgcgggtcgctgatcggattgaccgccagggctacttgggccacaaatattcaggtcgcaatcaaccaggtgcgaagactgattggtaatgagaactacctcgattatatgacctccatgaaacggtttaagaatgaatctgaccctgagggcgctctttggtga

SEQ ID NO: 14084 - RNA, 9879 nt, synthetic construct
  misc_feature 1..9879: note = derived and/or modified CDS sequence (opt3) from DENV-1__JQ045632__SS-prME
  source 1..9879: mol_type = other RNA
agcgtgaccatgctgctcatgcttatgcccacggccctggctttccacttgactacgagaggaggggaacctcatatgatcgtctccaagcaggaaagggggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaacttgccgagacgcagcacggtacagtcttggtgcagataaagtacgagggcaccgacgctccttgcaaaatcccattcctgactcaagatgaaaagggggttacacagaacggacgcctcattaccgcgaatcccatcgtgactgacaaagagaagcctgtaaacatagaagcagagccaccctttggcgagtcgtatattgtcatcggtgccggggaaaaagctctgaaactttcttggttcaagaaaggctcctcaatcggaaagatgtttgaggccaccgcaagaggcgccaggcggatggctattctgggggatacagcctgggacttcggaagtatcggtggcgtgtttacgagcattgggaaattggttcatcagatattcggaaccgcatacggcgtgctcttttccggtgtctcttggactatgaagatcgggattggcgtgctgttaacatggctgggactaaatagccgatcaaccagtctctccatgacatgtatcgcggtaggcctggtgactctttacttgggggttatggtccaggctgatagcggatgcgtgatcaactggaaaggccgcgaactgaagtgtggttctgggattttcgtgaccaatgaggtccacacgtggacagaacaatataagtttcaggccgactcaccgaaaagactcagtgcagccataggaaaggcttgggaggagggcgtttgcggtatcaggagcgccacccggctggaaaacattatgtggaaacagatctccaacgagttaaatcatattctgcttgaaaacgacatgaagttcactgtggtggtaggcgatgtcgcagggatcttggctcagggcaagaagatgatacgccctcaacccatggagcacaaatactcttggaagtcgtggggcaaggccaaaatcattggggcggacgtgcagaataccacatttatcattgatggaccaaacactcctgaatgtcccgacgatcagagagcctggaatatctgggaggttgaggactatggcttcggtatatttaccacaaacatttggctcaagctgagggatagctacacacaggtgtgcgaccaccgtctaatgtccgctgcaatcaaagattcaaaggccgtccatgctgacatggggtattggattgaaagtgagaaaaatgaaacctggaagctggcccgggcatctttcatcgaggtgaagacttgtatatggccaaaaagccacacactctggtccaacggagttctggaatcagagatgatcattcccaagatctacggcggtcctattagccaacataattatcgaccaggctacttcacccagactgcggggccgtggcaccttggaaaattggagctggattttgacttatgcgaaggcacaaccgtggtagtcgatgagcactgcgggaacagaggaccctctctcaggacgactaccgtgacaggcaagatcatacatgaatggtgttgccgctcctgtaccctgcctccacttcggttcagaggtgaggacgggtgctggtacggaatggagattaggcccgtgaaagaaaaggaggaaaatctggtcaagagtatggttagcgccggctctggtgaggtggactccttttcattgggcctcctgtgtatcagtatcatgattgaagaggtaatgcgcagccgatggtcgcggaaaatgctaatgactgggacactggctgtgttctttctcctgatcatgggacagcttacctggaacgatttgattcgtctgtgcataatggtcggcgccaatgcatccgacagaatggggatgggaacaacttatttagctctcatggccaccttcaagatgaggcctatgtttgcagtgggcctgcttttccgccggctgacgtctagagaggttctactcctgacaatcggtttgagcctggtggcctcagtcgaattaccaaacagtctcgaggaactgggggatggacttgctatgggcattatgatcctgaaattgctcaccgactttcaatcccaccagctgtgggcgactctactgtctcttaccttcattaagacaacttttagcctccattacgcctggaaaaccatggcaatggtgctgtccatcgtttcattgttccccctgtgtttaagcacgacaagtcagaagaccacttggctcccggtgctgcttggctctctggggtgcaagcctttgacaatgtttctcatagctgagaataaaatctggggaaggcgatcctggccactgaacgaaggtattatggccgtcggcatcgtaagcattctactgtcgtcacttctcaagaacgatgtgcccctggccgggcctttgatcgctggaggcatgttaatagcatgttatgttatttctggtagttccgccgacctgagcctcgagaaagcggctgaggtgtcttgggaagaggaagccgagcacagcggggcatcccataatatcctggtcgaagtgcaggatgacggaaccatgaagatcaaagatgaggagcgcgacgatactcttacaattctgttgaaggccaccctactggctgtatcaggcgtgtaccccctcagtataccagcaacgctgttcgtctggtatttctggcagaaaaagaagcagcggagcggcgttctttgggacactccttctcccccagaagtggagagagccgtgttagatgacgggatctacaggattatgcagcgtggactgctcggtcgctcccaggtcggcgtgggggtttttcaagaaaacgtattccacaccatgtggcacgtgacacggggagcggtcttgatgtatcagggcaaaagactggagccgtcatgggctagtgtgaagaaagacctcatcagctacggtgggggatggaggctgcagggctcctggaataccggcgaggaagttcaggtgattgccgtcgagcctgggaagaaccccaaaaatgtgcaaacagcaccaggaacttttaagacccccgaaggtgaggtaggcgccatcgctcttgatttcaagcctgggacgtctggatcgccaatagtcaaccgagaaggcaaaatcgtgggtctgtacgggaatggagttgtgacaactagcggcacctatgtctcagccattgcacaggctaaggcctcccaggagggccccttgcctgagatcgaagacgaggtgtttcggaaacgcaacctaacaattatggatctgcatccggggagtggaaagaccagaaggtacctcccagcgatcgttcgggaagccataaaacgaaagttaagaactctgattcttgcacccacccgcgtggtcgcttctgagatggccgaagctctgaagggtatgcctatcaggtatcaaacaacggcagtgaaaagcgagcacactggcaaggagatcgtagacctcatgtgccatgccaccttcacaatgcgtttgctgtccccagtgcgggttcccaattacaacatgattatcatggatgaagcccactttaccgacccttcatctatagctgcgagagggtatattagcactagggtcggaatgggcgaggcagccgctatcttcatgacagccaccccgcccggtagtgtggaagcatttccacagtccaatgccgtgattcaggatgaggaacgcgacatccctgagcgaagctggaactctgggtacgagtggataacggatttccccggaaaaactgtctggtttgtaccatcaattaagtccggcaatgacatcgctaactgtctcaaaaagaatggcaagagagtgatccagctgagtcggaaaacattcgataccgaatatcaaaagaccaaaaacaacgactgggactacgttgtgactacagatattagcgagatgggggcgaatttcagggccgaccgcgtcatcgatcctcgtagatgccttaagcccgtgattctaaaagacggaccagaacgggttatactggcaggtccgatgcctgtgaccgtcgcttcggccgcacagaggcgcggccgaatcgggagaaaccataataaggagggagatcagtacatttatatgggccagcccttgaacaatgacgaggatcacgcccactggacagaagctaagatgttactggacaacatcaatactccagagggtatcattcccgccctctttgaacctgagcgggaaaaatctgcggcaatagatggggagtacaggctgcgcggcgaggccagaaagacgttcgtggaacttatgaggcggggagacctgccagtatggctctcctataaagtggctagcgagggctttcaatactcagatcgtcgctggtgcttcgacggggaacgaaacaatcaggttttggaggaaaacatggatgtcgagatctggaccaaggagggagaaaggaaaaagctgaggccccggtggctagacgcccgcacatatagtgaccctctggctctcagagagtttaaagagttcgcagccggtaggcggtctgtgtccggcgatcttattctggagatcgggaagttaccgcagcatttgactcagcgagctcaaaatgccctggacaacctcgtgatgctgcacaatagcgaacagggaggcagagcataccgccatgcgatggaggagcttccagataccattgaaacactgatcctcttggccctgatagctgtcttaaccggtggggttactctatttttcctgtcaggcaggggactcggcaagacgagtatcgggcttctgtgtgtgatggccagctccgtattgctgtggatggcatctgtggagccccactggattgctgccagcatcattctcgaatttttcctgatggtccttctcatccctgagcccgaccggcagcgtaccccacaggataaccaactggcatatgtggttataggattgctgtttatgattttaacagtggccgctaatgagatgggtctactggaaactaccaaaaaggacctcggcatcgggcacgtcgcggtagagaaccatcaccatgccgcaatgcttgatgtggacctgcaccctgcttccgcctggacattgtacgccgttgcaaccactattatcacacccatgatgagacatacgatagaaaacaccactgctaatatctcactgacagccattgcgaaccaggctgccatcctcatgggactggataaaggctggccaatttctaagatggacatcggtgtgcctcttttagcactggggtgctacagtcaggtcaatccgctcaccttgaccgccgctgtgctgatgctagtcgcacactatgccataattggccccggactgcaagcgaaagctacaagggaggcccagaagcgcactgcagccggcatcatgaagaacccaacggtggatgggatcgttgctattgacctcgatcctgtggtatacgacgccaaattcgaaaagcagcttggacagatcatgctgttgatactgtgtacctcgcaaattctcctgatgcggacaacttgggcattatgcgagagcatcacccttgctacaggccccctgaccactctctgggagggttccccagggaaattttggaatacgacaattgccgtgtctatggcgaacatcttccgaggatcatatctagccggcgcaggtctggctttcagcttgatgaagtccctgggcgggggaagaaggggcaccggggcccagggagaaactctcggcgagaaatggaagcgccagcttaatcagctgagtaagtctgaatttaacacctacaaacggagcggtataatggaggtcgacagatcagaagcaaaggaggggttgaaacgtggagagacaactaagcacgctgtttccaggggcaccgccaaactgcggtggttcgtggaacgcaatctcgtcaagcctgagggtaaggtgatcgatttaggctgtgggcgaggaggctggagttattactgcgccgggctgaaaaaggtaacagaagtgaaaggatatacgaagggcggtcccgggcatgaggaaccgattccaatggcgacctacggatggaaccttgttaaactgcacagcggcaaggacgtgtttttcatccctcccgagaaatgtgatactctactctgcgacattggcgagtcttccccaaatcccacaatcgaagaggggagaaccctgagggtcttgaagatggtggaaccttggctgcggggaaaccaattttgtattaaggtcctcaatccgtacatgccctcagtggttgagactcttgagcagatgcagcgcaaacatggtggcatgctggtaagaaacccattaagcagaaattcgacacacgaaatgtattgggtgtcttgcgggaccggaaacatcgtcagtgctgtgaatatgacgtcccgaatgctgttgaaccggttcaccatggcacaccgtaagcctacatacgagagagatgttgacctcggcgccggtactcgccatgtggctgtcgaacccgaggtggccaacctggatataattgggcagaggatcgaaaatatcaaacacgagcataagagcacctggcactatgacgaggataacccttacaaaacatgggcatatcatggatcatacgaagtaaagccatccggctctgccagcagtatggtgaatggcgttgtcaagctacttactaaaccctgggacgtgattcctatggtgacccaaatagctatgacagataccactccatttgggcagcagcgggtcttcaaggagaaagttgacacgagaacacccaaggcgaaacgcggaaccgcccaaatcatggaagtgactgcaaagtggctgtggggttttctctccaggaacaagaaaccgcgaatttgtacccgggaggagttcacaagaaaggtaaggagcaatgctgccatcggcgcagtgtttgtcgacgagaaccagtggaactctgccaaagaggctgtggaagatgagcgcttctgggacctggttcaccgtgaacgggagttgcacaagcaggggaaatgcgccacgtgcgtgtataacatgatgggaaagagagaaaagaaactgggcgagtttggtaaggcgaaagggtcaagggcaatttggtacatgtggctcggagcccgcttccttgagttcgaagctctgggctttatgaatgaggatcattggttcagtcgagaaaactccttaagcggcgtcgagggggagggactgcacaagttgggttacatcctccgggacatatctaaaatccctggcgggaatatgtatgccgatgacaccgcaggatgggatactagaattacagaagacgatctgcagaacgaggctaggatcaccgacattatggaaccagagcatgccctacttgctaagtcgatctttaaactgacttaccaaaataaggtggtacgcgttcagagacccgccaagaacggcacagtgatggatgtcatatcacggagggaccagcgtggtagcggacaggtgggaacctatggcctcaatacattcactaacatggaagcacaactgattcgacagatggagtccgagggcatctttagtccttctgaattggagaccccaaacttagcggaacgcgtgctggattggctcgagaaatacggggtcgaaagacttaagcggatggccatcagcggagacgactgtgttgtgaaacccattgatgacaggttcgctacggccctgaccgcactaaatgatatgggtaaggtacgcaaagacataccgcagtgggagccttccaagggctggaacgattggcagcaagtgcccttttgctcacaccacttccatcagctgatcatgaaggacgggagagagattgtcgtgccatgtcggaatcaggatgaactcgttggaagggctcgagtgagtcagggcgccggttggtctttgcgtgagacagcatgcctggggaaaagctatgcccaaatgtggcagcttatgtactttcacagacgcgacctgcggctcgcggctaacgccatctgttccgcagtccctgtggattggattcccacttcaaggaccacatggagcatccatgcccaccatcagtggatgactaccgaagacatgttatctgtatggaatagagtttggatagaggaaaacccatggatggaggataagacgcacatctccagttggggagacgtgccctatctgggcaaacgcgaggaccaatggtgcggcagcttgattgggctgacagctcgggccacctgggcaactaatatccaggtcgctattaaccaggtgaggcgactcatcggaaatgaaaactaccttgattacatgacatcgatgaagagattcaaaaatgagtccgaccctgaaggtgccctgtggtga

SEQ ID NO: 14085 - RNA, 9879 nt, synthetic construct
  misc_feature 1..9879: note = derived and/or modified CDS sequence (opt3) from DENV-1__JQ045633__SS-prME
  source 1..9879: mol_type = other RNA
agcgtgaccatgctgctcatgcttatgcccaccgccctggctttccacttgactacgagaggaggggaacctcatatgatcgtctccaagcaggaaagaggaaaatctttactgtttaagacctcagccggtgttaatatgtgcacactcattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcgcatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactgctcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctggcggactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaacttgctgagacccagcacggtacggtcttggtgcagataaagtacgagggcacagacgcgccttgcaaaatcccattctcgacccaagatgaaaagggggttactcagaacggacgcctgattacagcaaatcccatcgtgaccgacaaagagaagcctgtaaacatagaagccgagccaccctttggcgagtcttatattgtcatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtgtttacatccgttgggaaactggtgcatcagattttcggagcggcttacggcgtcttgttttctggtgtgagctggacgatgaagatagggatcggcgtactcctgacctggttaggactaaattcacgaagtacttccctaagcatgacatgtattgccgtgggcctcgttaccctgtaccttggggtcatggtgcaggcagattctggatgcgtgatcaactggaaaggccgcgaattgaagtgtggttcagggatcttcgtcacaaatgaggttcacacttggaccgaacaatataagtttcaggccgacagtccgaaaagactgagcgctgccattggaaaggcatgggaggagggcgtgtgcggtataaggtccgctacgcggctcgaaaacatcatgtggaaacagatttctaacgagctgaatcatatcttactggaaaacgacatgaagttcacagtggtagtcggcgatgtggccgggattcttgcgcagggcaaaaagatgatccgccctcaacccatggagtacaaatattcgtggaaaagctggggcaaggccaagataatcggggctgacgttcagaataccacttttattatcgatggacagaacaccccagaatgtcctgacgatcagagagcatggaatatttgggaggtggaggactacggcttcggtatctttacaactaacatatggttgaagctcagggattcctatacccaagtctgcgaccaccgtctgatgtcagccgctattaaagatagtaaggccgtgcacgcagacatggggtactggatcgaatctgagaaaaatgaaacatggaagctagcgcgggccagcttcattgaggttaagacgtgtatctggcccaaatcccataccctgtggtcaaacggagtgctcgaaagcgagatgataatcccaaagatttatggcggtcccatctctcagcacaattaccgacctggctacttcactcagacagctgggccatggcatctgggaaaacttgagttggattttgacctgtgcgaaggcaccactgtagtcgtggatgagcactgcgggaacagaggaccgtccttaaggacaaccacggtgactggcaagattatccacgaatggtgttgccgcagttgtaccctaccccctctgcggttcagaggtgaggacgggtgctggtatggaatggagataaggccagtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgacagggaccctagcagtcttcctgctcctgattatgggacaacttacttggaacgatttgatccgtctgtgcattatggtgggcgctaatgcctctgacagaatggggatgggaacaacctacttagcactcatggccacatttaagatgaggcccatgttcgctgttggcctgctttttcgccggctgactagcagagaggtgctactcctgaccataggtttgtcactggtcgcgagtgtggaattacctaactccctcgaggaactgggggatggacttgccatgggcatcatgattctgaaattgctcacggacttccagtctcatcagctgtgggcaacactactgagccttacctttatcaagactaccttctccctccactatgcttggaaaacaatggccatggttctgtcaattgtgagcttgtttccactgtgtttaagtactacctctcagaagacgacatggctccccgtcctgcttggctccctggggtgcaagccgttgaccatgttcctcatcgccgagaataaaatatggggaaggcgaagctggcctctgaacgaaggtatcatggctgtaggcattgtgtcgatcctactgtcatctcttctcaagaacgatgttccactggcagggcccttgattgccggaggcatgttaatcgcgtgttacgtgataagtggttccagcgctgacctgtctctcgagaaagccgcagaggtcagctgggaagaggaagccgagcattccggggcttcacacaatattctggtggaagtacaagatgacggaactatgaagatcaaagatgaggagcgcgacgatacacttaccatcctgttgaaggcaactctactggccgtgagtggcgtctatcctctcagcattcccgcgacactgtttgtttggtacttctggcagaaaaagaagcagcggtctggcgtgctttgggacaccccatcccctcccgaagtggagagagctgtcttagatgacgggatatataggatcatgcagcgtggactgctcggtcgctcacaagtgggcgttggggtattccaggaaaacgtgtttcatacgatgtggcacgtcactcggggagccgtgttgatgtaccagggcaaaagactggagccaagttgggcaagcgttaagaaagacctcatttcctacggtgggggatggaggctgcagggctcttggaataccggcgaggaagtgcaagtcatcgccgtggagccggggaagaaccctaaaaatgtacagacagctcccggaaccttcaagacaccagaaggtgaggtcggcgccattgcacttgattttaagcccgggacttcgggaagccctatcgtgaaccgagaaggcaaaatagttggtctgtatgggaatggagtggtcaccacgtcaggcacatacgtgtccgctatcgcccaggcgaaggttagtcaagagggcccattgcccgagattgaagacgaggtgttccggaaacgcaacctaactatcatggatctgcaccctgggtctggaaagaccagaaggtatctcccggccattgtccgggaagcaatcaaacgaaagttaagaacactgatacttgctccaacccgcgtggtagccagcgagatggctgaagcactgaagggtatgcccattaggtaccagactaccgccgtgaaatccgagcatacaggcaaggagatcgttgacctcatgtgccacgccacgtttactatgcgtttgctgtcacctgtccgggtgccaaattataacatgatcattatggatgaagctcatttcaccgacccctctagcatcgcggcaagagggtacataagtacaagggtgggaatgggcgaggccgctgccatttttatgaccgcaactcctccgggttccgtcgaagccttcccccagagcaatgctgtaatccaggatgaggaacgcgacattccagagcgatcttggaactcagggtatgagtggatcacagattttcctggaaaaaccgtgtggttcgttccctccataaagagtggcaatgacattgcgaactgtctcaggaaaaatggcaagcgggtgatccaactgagcaggaagacgtttgatactgaataccagaaaacaaagaacaacgactgggactacgtcgtgaccaccgatatctcggagatgggggccaatttccgcgcagaccgtgttattgatccaagacggtgccttaaacctgtgatcctaaaggacggacccgaaagggtcattctggctggtccaatgccggtgactgtagcctctgcagcccagcgccgaggcagaatagggcggaaccacaataaagagggagatcagtatatctacatgggccaacctttgaacaatgacgaggatcatgctcactggacagaagccaagatgttactggacaacattaatacccccgagggtatcatcccagcactcttcgaacccgagagggaaaagtccgcagccattgatggggagtatcgcctgagaggcgaggctaggaaaacatttgtggaacttatgcggcgtggagacctgcctgtttggctcagctacaaggtcgcctcagagggcttccagtatagtgatcgccgatggtgctttgacggggaaagaaacaatcaggtgttggaggaaaacatggatgtggagatatggactaaagagggagaaaggaagaaactgcggccacgctggctagacgctagaacgtactctgaccccctggcactcagggagttcaaggaatttgccgctggtcggcgatccgtcagcggcgatcttatcctggagattgggaaattacctcagcacttgacccaaagagcccagaatgcactggacaacctcgttatgctgcataattcagaacagggaggccgcgcgtataggcacgccatggaggagcttccggatacaatcgaaactctgatgctcttggctctgattgccgtgttaaccggtggggtaacactattctttctgagtggccggggactcggcaagaccagcatcgggcttctgtgtgtgatggcatcctctgtcttgctgtggatggctagcgtggagccacattggatagccgcatccatcattctcgagttctttctgatggttcttctcatccccgagcctgaccgtcagagaactccccaagataaccagctggcctacgtggtcattggattgctgttcatgatcttaacggtagctgcgaatgagatgggtctactggaaaccacaaagaaagacctcggcatagggcacgtggccgttgagaaccaccatcacgcagctatgcttgatgtggacctgcatccagcctcagcctggactttgtacgcagtcgctaccacaattatcacccctatgatgaggcacactattgaaaacacaacggccaatatctctctgaccgcgatagctaaccaggccgcaatcctcatgggactggataagggctggcccattagtaaaatggacatcggtgtgccacttttagccctggggtgctattcgcaagtcaatcctctcactttgacagctgcagtgctgatgctagttgcccattacgcgattatcggcccgggactgcaggctaaggccacccgcgaggcacagaaacggaccgccgctggcataatgaagaaccccacagtggatgggattgtagccatcgacctcgatccagtggtctatgacgcaaagtttgaaaaacagcttggacaaatcatgctgttgattctgtgtactagccagatcctcctgatgcgaacgacctgggctttatgcgagtccataacacttgccactggccctctgaccacactctgggagggttctcccgggaagttctggaataccactattgcggtttcaatggccaacatctttagaggaagctacctagcaggcgctggtctggccttctccttgatgaaaagtctgggcgggggaaggcgcggcacgggggcacagggagaaacactcggcgagaagtggaaacggcagcttaatcaactgtctaagagcgagttcaacacctataagagatcaggtattatggaggtggaccgttccgaagctaaagaggggttgaagaggggagagactaccaaatacgccgtcagtcggggcacagccaagctgcgctggtttgtggaacgaaatctcgtaaaaccagagggtaaggtgatcgatttaggctgtgggagaggaggctggagctattactgcgcggggctgaagaaagttactgaagtgaagggatacaccaaaggcggtcctgggcacgaggaacccataccgatggctacatatggatggaaccttgtcaagctgcactctggcaaagacgtgttctttgtcccacctgagaagtgtgatacgctactctgcgacatcggcgagtcctcacccaatccaaccattgaagaggggaggactctgcgggtgttgaaaatggttgaaccctggctgcgcggaaaccagttctgtatcaagattctcaatccttacatgccgagcgtagtggagacacttgagcagatgcagagaaagcatggtggcatgctggtcaggaaccccttatcgcgaaattctacccacgaaatgtattgggtgagttgcgggactggaaacatcgtttccgcagtgaatatgacaagccggatgctgttgaaccgttttaccatggcccatagaaaaccaacgtacgagcgcgatgtcgacctcggcgctggtaccaggcacgtggccgtagaacctgaggtggcaaacctggatattatcgggcaacggatagaaaatattaagcacgagcataaatcaacatggcactatgacgaggataacccctacaagacttgggcctatcatggatcctacgaagttaaaccttctggcagcgctagttccatggtcaatggcgtggtgaagctacttaccaagccatgggacgtcatccccatggttacacagatcgcgatgactgataccacacctttcgggcagcaaagagtgtttaaagagaaggtagacacccgcactccaaaagccaagaggggaacggcacagattatggaagtgacagctaaatggctgtggggtttcctcagccgaaacaagaagccccggatatgtaccagagaggaatttactaggaaagtccgctctaatgccgcaatcggcgccgtgttcgttgacgagaaccagtggaactcagctaaggaggccgtggaagatgagcgtttttgggacctggtccaccgggaaagagagttgcataaacaggggaagtgcgcgacctgcgtgtacaacatgatgggaaaaagggaaaagaagctgggcgagttcggtaaagcaaaggggagtcgcgccatttggtatatgtggctcggagctcgatttcttgagttcgaagccctgggcttcatgaatgaggatcactggttttcccgggaaaacagcttatctggcgtagagggggagggactgcacaaattgggttacatcctcagagacatttcgaagatcccgggcgggaatatgtatgcagatgacacagctggatgggatacgaggataaccgaagacgatctgcaaaacgaggcccgcatcactgacattatggaacctgagcatgctctacttgccaaatcaatcttcaagctgacataccagaataaagttgtgagagtccagcggccagcaaagaacggcaccgtgatggatgtgattagcaggcgtgaccagcgaggttccgggcaagtcggaacttatggcctcaatacatttaccaacatggaagcgcagctgatccgccagatggagagtgagggcatattctctcccagcgaattggagacacctaacttagccgaaagagttctggattggctcgagaagtacggggtggaacggcttaaaaggatggctatttccggagacgactgtgtagtgaagccaatcgatgaccgctttgccactgcactgaccgctctaaatgatatgggtaaagtcagaaaggacatcccccagtgggagccgtcaaaaggctggaacgattggcaacaggtgcctttctgcagtcaccattttcaccagctgattatgaaggacgggcgggagatagttgtgccctgtaggaatcaggatgaactcgtcggacgagcccgtgtgtctcaaggcgcaggttggagcttgagagagacggcctgcctggggaagtcctatgcgcagatgtggcagcttatgtacttccaccgccgggacctgaggctcgctgccaacgcaatctgttcagccgtaccagttgattggattcctaccagcagaacaacttggtctatccatgctcaccatcaatggatgaccacagaagacatgttatccgtgtggaatcgcgtctggattgaggaaaacccctggatggaggataaaactcacatcagtagctggggagacgtgccatacctgggcaagcgggaggaccagtggtgcggctcgttgatagggctgaccgccagggcaacgtgggctacaaatatccaggttgccattaaccaggtgcgaagactcatcggaaatgaaaactatcttgattacatgacctccatgaaacggtttaagaatgagtctgaccccgaaggtgcgctgtggtga

SEQ ID NO: 14086 - RNA, 9879 nt, synthetic construct
  misc_feature 1..9879: note = derived and/or modified CDS sequence (opt3) from DENV-1__JQ045634__SS-prME
  source 1..9879: mol_type = other RNA
agcgtgaccatgctgctcatgcttatgcccaccgccctggctttccacttgactacgagaggaggggaacctcatatgatcgtctccaagcaggaaagagggaaatctttactgtttaagacctcagccggtgttaatatgtgcacactcattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcgcatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactgctcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctggcggactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaacttgctgagacccagcacggtacggtcttggtgcagataaagtacgagggcacagacgcgccttgcaaaatcccattctcgacccaagatgaaaagggggttactcagaacggacgcctgattacagcaaatcccatcgtgaccgacaaagagaagcctgtaaacatagaagccgagccaccctttggcgagtcttatattgtcatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtgtttacatccgttgggaaactggtgcatcagattttcggagcggcttacggcgtcttgttttctggtgtgagctggacgatgaagatagggatcggcgtactcctgacctggttaggactaaattcacgaagtacttccctaagcatgacatgtattgccgtgggcctcgttaccctgtaccttggggtcatggtgcaggcagattctggatgcgtgatcaactggaaaggccgcgaattgaagtgtggttcagggatcttcgtcacaaatgaggttcacacttggaccgaacaatataagtttcaggccgacagtccgaaaagactgagcgctgccattggaaaggcatgggaggagggcgtgtgcggtataaggtccgctacgcggctcgaaaacatcatgtggaaacagatttctaacgagctgaatcatatcttactggaaaacgacatgaagttcacagtggtagtcggcgatgtggccgggattcttgcgcagggcaaaaagatgatccgccctcaacccatggagtacaaatattcgtggaaaagctggggcaaggccaagataatcggggctgacgttcagaataccacttttattatcgatggacagaacaccccagaatgtcctgacgatcagagagcatggaatatttgggaggtggaggactacggcttcggtatctttacaactaacatatggttgaagctcagggattcctatacccaagtctgcgaccaccgtctgatgtcagccgctattaaagatagtaaggccgtgcacgcagacatggggtactggatcgaatctgagaaaaatgaaacatggaagctagcgcgggccagcttcattgaggttaagacgtgtatctggcccaaatcccataccctgtggtcaaacggagtgctcgaaagcgagatgataatcccaaagatttatggcggtcccatctctcagcacaattaccgacctggctacttcactcagacagctgggccatggcatctgggaaaacttgagttggattttgacctgtgcgaaggcaccactgtagtcgtggatgagcactgcgggaacagaggaccgtccttaaggacaaccacggtgactggcaagattatccacgaatggtgttgccgcagttgtaccctaccccctctgcggttcagaggtgaggacgggtgctggtatggaatggagataaggccagtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgacagggaccctagcagtcttcctgctcctgattatgggacaacttacttggaacgatttgatccgtctgtgcattatggtgggcgctaatgcctctgacagaatggggatgggaacaacctacttagcactcatggccacatttaagatgaggcccatgttcgctgttggcctgctttttcgccggctgactagcagagaggtgctactcctgaccataggtttgtcactggtcgcgagtgtggaattacctaactccctcgaggaactgggggatggacttgccatgggcatcatgattctgaaattgctcacggacttccagtctcatcagctgtgggcaacactactgagccttacctttatcaagactaccttctccctccactatgcttggaaaacaatggccatggttctgtcaattgtgagcttgtttccactgtgtttaagtactacctctcagaagacgacatggctccccgtcctgcttggctccctggggtgcaagccgttgaccatgttcctcatcgccgagaataaaatatggggaaggcgaagctggcctctgaacgaaggtatcatggctgtaggcattgtgtcgatcctactgtcatctcttctcaagaacgatgttccactggcagggcccttgattgccggaggcatgttaatcgcgtgttacgtgataagtggttccagcgctgacctgtctctcgagaaagccgcagaggtcagctgggaagaggaagccgagcattccggggcttcacacaatattctggtggaagtacaagatgacggaactatgaagatcaaagatgaggagcgcgacgatacacttaccatcctgttgaaggcaactctactggccgtgagtggcgtctatcctctcagcattcccgcgacactgtttgtttggtacttctggcagaaaaagaagcagcggtctggcgtgctttgggacaccccatcccctcccgaagtggagagagctgtcttagatgacgggatatataggatcatgcagcgtggactgctcggtcgctcacaagtgggcgttggggtattccaggaaaacgtgtttcatacgatgtggcacgtcactcggggagccgtgttgatgtaccagggcaaaagactggagccaagttgggcaagcgttaagaaagacctcatttcctacggtgggggatggaggctgcagggctcttggaataccggcgaggaagtgcaagtcatcgccgtggagccggggaagaaccctaaaaatgtacagacagctcccggaaccttcaagacaccagaaggtgaggtcggcgccattgcacttgattttaagcccgggacttcgggaagccctatcgtgaaccgagaaggcaaaatagttggtctgtatgggaatggagtggtcaccacgtcaggcacatacgtgtccgctatcgcccaggcgaaggttagtcaagagggcccattgcccgagattgaagacgaggtgttccggaaacgcaacctaactatcatggatctgcaccctgggtctggaaagaccagaaggtatctcccggccattgtccgggaagcaatcaaacgaaagttaagaacactgatacttgctccaacccgcgtggtagccagcgagatggctgaagcactgaagggtatgcccattaggtaccagactaccgccgtgaaatccgagcatacaggcaaggagatcgttgacctcatgtgccacgccacgtttactatgcgtttgctgtcacctgtccgggtgccaaattataacatgatcattatggatgaagctcatttcaccgacccctctagcatcgcggcaagagggtacataagtacaagggtgggaatgggcgaggccgctgccatttttatgaccgcaactcctccgggttccgtcgaagccttcccccagagcaatgctgtaatccaggatgaggaacgcgacattccagagcgatcttggaactcagggtatgagtggatcacagattttcctggaaaaaccgtgtggttcgttccctccataaagagtggcaatgacattgcgaactgtctcaggaaaaatggcaagcgggtgatccaactgagcaggaagacgtttgatactgaataccagaaaacaaagaacaacgactgggactacgtcgtgaccaccgatatctcggagatgggggccaatttccgcgcagaccgtgttattgatccaagacggtgccttaaacctgtgatcctaaaggacggacccgaaagggtcattctggctggtccaatgccggtgactgtagcctctgcagcccagcgccgaggcagaatagggcggaaccacaataaagagggagatcagtatatctacatgggccaacctttgaacaatgacgaggatcatgctcactggacagaagccaagatgttactggacaacattaatacccccgagggtatcatcccagcactcttcgaacccgagagggaaaagtccgcagccattgatggggagtatcgcctgagaggcgaggctaggaaaacatttgtggaacttatgcggcgtggagacctgcctgtttggctcagctacaaggtcgcctcagagggcttccagtatagtgatcgccgatggtgctttgacggggaaagaaacaatcaggtgttggaggaaaacatggatgtggagatatggactaaagagggagaaaggaagaaactgcggccacgctggctagacgctagaacgtactctgaccccctggcactcagggagttcaaggaatttgccgctggtcggcgatccgtcagcggcgatcttatcctggagattgggaaattacctcagcacttgacccaaagagcccagaatgcactggacaacctcgttatgctgcataattcagaacagggaggccgcgcgtataggcacgccatggaggagcttccggatacaatcgaaactctgatgctcttggctctgattgccgtgttaaccggtggggtaacactattctttctgagtggccggggactcggcaagaccagcatcgggcttctgtgtgtgatggcatcctctgtcttgctgtggatggctagcgtggagccacattggatagccgcatccatcattctcgagttctttctgatggttcttctcatccccgagcctgaccgtcagagaactccccaagataaccagctggcctacgtggtcattggattgctgttcatgatcttaacggtagctgcgaatgagatgggtctactggaaaccacaaagaaagacctcggcatagggcacgtggccgttgagaaccaccatcacgcagctatgcttgatgtggacctgcatccagcctcagcctggactttgtacgcagtcgctaccacaattatcacccctatgatgaggcacactattgaaaacacaacggccaatatctctctgaccgcgatagctaaccaggccgcaatcctcatgggactggataagggctggcccattagtaaaatggacatcggtgtgccacttttagccctggggtgctattcgcaagtcaatcctctcactttgacagctgcagtgctgatgctagttgcccattacgcgattatcggcccgggactgcaggctaaggccacccgcgaggcacagaaacggaccgccgctggcataatgaagaaccccacagtggatgggattgtagccatcgacctcgatccagtggtctatgacgcaaagtttgaaaaacagcttggacaaatcatgctgttgattctgtgtactagccagatcctcctgatgcgaacgacctgggctttatgcgagtccataacacttgccactggccctctgaccacactctgggagggttctcccgggaagttctggaataccactattgcggtttcaatggccaacatctttagaggaagctacctagcaggcgctggtctggccttctccttgatgaaaagtctgggcgggggaaggcgcggcacgggggcacagggagaaacactcggcgagaagtggaaacggcagcttaatcaactgtctaagagcgagttcaacacctataagagatcaggtattatggaggtggaccgttccgaagctaaagaggggttgaagaggggagagactaccaaatacgccgtcagtcggggcacagccaagctgcgctggtttgtggaacgaaatctcgtaaaaccagagggtaaggtgatcgatttaggctgtgggagaggaggctgggcgtattactgcgctgggctgaagaaagttactgaagtgaagggatacaccaaaggcggtcctgggcacgaggaacccataccgatggcaacatatggatggaaccttgtcaagctgcacagcggcaaagacgtgttctttgtcccacctgagaagtgtgatacgctactctgcgacatcggcgagtcttcccccaatccaaccattgaagaggggaggactctgcgggtgttgaaaatggttgaaccctggctgcgcggaaaccagttctgtatcaagattctcaatccttacatgccgtcagtagtggagacacttgagcagatgcagagaaagcatggtggcatgctggtcaggaaccccttaagccgaaattcgacccacgaaatgtattgggtgtcttgcgggactggaaacatcgttagtgccgtgaatatgacatcccggatgctgttgaaccgttttaccatggctcatagaaaaccaacgtacgagcgcgatgtcgacctcggcgccggtaccaggcacgtggcagtagaacctgaggtggccaacctggatattatcgggcaacggatagaaaatattaagcacgagcataaaagcacatggcactatgacgaggataacccctacaagacttgggcttatcatggatcatacgaagttaaaccttccggctctgcgagcagtatggtcaatggcgtggtgaagctacttaccaagccatgggacgtcatccccatggttacacagatcgccatgactgataccacacctttcgggcagcaaagagtgtttaaagagaaggtagacacccgcactccaaaagcaaagaggggaacggctcagattatggaagtgacagccaaatggctgtggggtttcctctcccgaaacaagaagccccggatatgtaccagagaggaatttactaggaaagtccgcagcaatgcagccatcggcgctgtgttcgttgacgagaaccagtggaactctgccaaggaggcggtggaagatgagcgtttttgggacctggtccaccgggaaagagagttgcataaacaggggaagtgcgcaacctgcgtgtacaacatgatgggaaaaagggaaaagaagctgggcgagttcggtaaagccaaggggtcacgcgctatttggtatatgtggctcggagcccgatttcttgagttcgaagcactgggcttcatgaatgaggatcactggtttagtcgggaaaactccttaagcggcgtagagggggagggactgcacaaattgggttacatcctcagagacatttctaagatcccgggcgggaatatgtatgctgatgacacagccggatgggatacgaggataaccgaagacgatctgcaaaacgaggctcgcatcactgacattatggaacctgagcatgccctacttgcaaaatcgatcttcaagctgacataccagaataaagttgtgagagtccagcggccagcgaagaacggcaccgtgatggatgtgatttcaaggcgtgaccagcgaggtagcgggcaagtcggaacttatggcctcaatacatttaccaacatggaagcccagctgatccgccagatggagtccgagggcatattcagtccctctgaattggagacacctaacttagctgaaagagttctggattggctcgagaagtacggggtggaacggcttaaaaggatggccattagcggagacgactgtgtagtgaagccaatcgatgaccgctttgcaactgctctgaccgccctaaatgatatgggtaaagtcagaaaggacatcccccagtgggagccgtccaaaggctggaacgattggcaacaggtgcctttctgctcacaccattttcaccagctgattatgaaggacgggcgggagatagttgtgccctgtaggaatcaggatgaactcgtcggacgagcacgtgtgagtcaaggcgccggttggtctttgagagagacggcgtgcctgggaaagagctatgctcagatgtggcagcttatgtacttccaccgccgggacctgaggctcgccgcaaacgccatctgttccgctgtaccagttgattggattcctacctcaagaacaacttggagcatccatgcccaccatcaatggatgaccacagaagacatgttatctgtgtggaatcgcgtctggattgaggaaaacccctggatggaggataaaactcacatctccagttggggagacgtgccatacctgggcaagcgggaggaccagtggtgcggcagcttgatagggctgaccgcaagggctacgtgggccacaaatatccaggttgcgattaaccaggtgcgaagactcatcggaaatgaaaactatcttgattacatgacctcgatgaaacggtttaagaatgagtccgaccccgaaggtgctctgtggtga

SEQ ID NO: 14087 - RNA, 9879 nt, synthetic construct
  misc_feature 1..9879: note = derived and/or modified CDS sequence (opt3) from DENV-1__JQ045636__SS-prME
  source 1..9879: mol_type = other RNA
agcgtgaccatgctgctcatgcttatgcccaccgcactggctttccacttgactacgagaggaggggaacctcatatgatcgtctccaagcaggaaagagggaagtctttactgtttaagacctcagccggtgttaacatgtgcaccctaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgattgccacaatcacaccccaggcgcctagcactgagatccagttaaccgactacggggccctgacactcgattgttctccaaggaccggacttgactttaacgaaatggtcctgttgactatgaaggagaaatcctggctagtgcataagcagtggttcctggatctcccgctgccctggacatcaggcgcaagcacgagtcaagagacctggaatcggcaggaccttctggtaacttttaaaacagctcacgccaagaagcaggaagttgtggtcttgggttctcaagagggggctatgcacaccgccctcacaggcgcaactgaaattcagacctccggaacgaccacaatattcgccggccatctgaaatgccgtttaaagatggataaactgactctaaaggggatgagctatgtgatgtgtaccggatcgttcaaactcgagaaggaagtcgctgagacacagcacggtactgtgctggttcagatcaagtacgagggcaccgacgcgccttgcaaaattccattttctacgcaagatgaaaagggggcaacacagaacggacgccttatcaccgccaatcccatagtgactgacaaagagaagcctgtaaacattgaagctgagccacccttcggcgagtcctatatcgtcatcggtgccggggaaaaagcattgaagctgtcatggtttaagaaaggcagtagcattggaaagatgttcgaggccacagctagaggcgccaggcggatggcaatcctcggggataccgcgtgggactttggatccattggtggcgtgttcacttctgttgggaaactggtgcatcagatatttggaaccgcttacggcgtccttttcagcggtgtgtcatggacaatgaagatcgggattggcgtactgttgacgtggctcggactgaatagtcgatccaccagcttatctatgacttgtatcgccgtgggcctggttacactatacctcggggtcatggtgcaggcagattcaggatgcgtgatcaactggaaaggccgcgaactgaagtgtggtagtgggatttttgtcaccaatgaggttcacacatggactgaacaatataagttccaggccgacagcccgaaaagactttccgctgccataggaaaggcatgggaggagggcgtgtgcggtatcaggtctgctacccggttggaaaacattatgtggaaacagatctcgaacgagctgaatcatattctcctggaaaacgacatgaagttaacggtggtagtcggcgatgtggccgggatcctggcgcagggcaagaagatgatacgccctcaacccatggagtacaaatatagctggaagtcctggggcaaggccaaaatcattggggctgacgttcagaatacaacctttatcattgatggaccaaacactcctgaatgtcccgacgatcagagagcatggaatatctgggaggtggaggactacggcttcggtatatttaccacaaacatttggcttaagttgagggattcatatactcaggtctgcgaccaccgtctcatgagtgccgctatcaaagattctaaggccgtgcacgcagacatggggtactggattgaaagcgagaaaaatgaaacctggaagctggcgcgggcctccttcatcgaggttaagacatgtatatggccaaaatcacatacgctatggagcaacggagtgctggaatctgagatgatcattcccaagatctatggcggtcctatttcccaacacaattaccgaccaggctacttcacccagactgctgggccgtggcatctcggaaaactggagcttgattttgacttgtgcgaaggcacaaccgtagtcgtggatgagcactgcgggaacagaggacccagtctgaggactacaaccgtgacgggcaagatcatacacgaatggtgttgccgcagctgtactttacctccactccggttcaaaggtgaggacgggtgctggtatggaatggagattagacccgtcaaggaaaaggaggaaaatctggttaaatctatggtgtccgccggctcaggtgaggtagacagttttagccttggcctgttgtgtatctcgatcatgattgaagaggtgatgaggtcccgctggtctcgaaagatgctcatgaccgggacactggcagtcttctttctactgatcatgggacagctcacctggaacgatctgattcggctttgcataatggtgggcgctgacgccagcgatcgtatggggatgggaactacatacttggcactgatggccaccttcaaaatgagacctatgtttgctgttggcttactcttcaggcgcctgacatcacgggaggtgcttctgctaactatcggtctcagtctggtcgcgtccgtggaattgccaaattctctggaggaattaggggacggactcgccatgggcattatgatcctgaaacttctgaccgattttcaaagccatcagttgtgggcaacgctcctgtccctaacattcattagaaccactttttcactgcactatgcttggaaaaccatggccatggttcttagcatcgtgagtctcttccccctgtgtttgtctacaacttcccagaagaccacgtggctgccggtcttactcggcagcctggggtgcaagcctcttacaatgtttctgatagccgagaacaaaatctggggaaggaagtcgtggccattgaatgaaggtattatggctgtaggcatcgtgtcaattctcctgtctagtctactgaaaaacgacgttccccttgcagggcctctcatcgccggaggcatgctgatagcgtgttacgtgatttccggtagctctgctgatttgagcttagagaaggccgcagtcgtgtcctgggaggaagaggccgaacattcaggggctagtcacaacatcctggtagaggtgcaggacgatggaaccatgaaaatcaaggacgaagaacgagatgacactctcacaattctgcttaaagcaaccctgttggccgtcagcggcgtttatcccctatctataccagcgactctgttcgtgtggtacttctggcaaaagaagaaacagcgctccggcgtgctctgggatacaccttcacccccagaggtcgaacgggctgtgctggacgacgggatctatagaattatgcagaggggacttttaggtcgtagtcaggttggcgtaggggtgtttcaagagaatgtcttccataccatgtggcacgtgacgcgcggagccgttctgatgtaccagggcaagcggctcgaaccgagctgggcatccgtgaaaaaggatttgatctcttacggtgggggatggagactgcagggctcgtggaacactggcgaggaggtccaggtgattgccgtagaacctgggaaaaatcccaagaacgtccaaaccgctccaggaacatttaagaccagcgagggtgaagtgggcgccatcgcactcgacttcaaacccgggacatcaggatcccctatagttaatagggagggcaagatcgtgggtctgtatgggaacggagtcgtgactaccagtggcacgtacgtttctgctattgcccaggcgaaagccagccaggaaggcccacttcccgagatcgaggatgaagtgtttcgaaagcggaatctgacaattatggacttgcaccctgggtccggaaaaactcgcagatatctaccggcaatcgtcagggaggctataaagcggaagctgcgaaccctcattttagccccaacaagagtggtagcttcagaaatggcagaggccctgaaaggtatgcccatccgctaccaaaccactgccgtgaagtctgaacataccggcaaagagatcgttgatcttatgtgccacgctacattcacgatgaggctgctcagccctgtccgtgtgccaaactataatatgattatcatggacgaggcgcattttactgatcccagttccatagcagcccgggggtacattagcaccagagtgggaatgggcgaagctgccgcaatcttcatgacagccacccctccgggttctgtcgaggcttttccccagtcaaacgcggtaattcaggacgaagagagggatatcccagaacgctcctggaatagtgggtatgagtggataactgacttccctggaaagacagtgtggtttgttcccagcattaaatcgggcaacgatatcgccaattgtttgcgaaagaacggcaagagagtgatccagctgtctcggaaaaccttcgacacggagtaccaaaagactaaaaataacgactgggattacgtcgtgacaaccgacatttccgaaatgggggcaaacttcagggctgatcgcgttatcgacccacgtagatgcctcaagcctgtgattctgaaagatggacccgagcgggtcatacttgccggtccaatgccggtgaccgtagcaagcgccgctcagaggcgcggccgaatcgggagaaatcacaacaaggaaggagaccagtatatttacatgggccagcctctaaataacgatgaggaccatgcccactggactgaggcgaagatgctgttggataatatcaacacacccgaaggtatcattccagcattatttgaccccgagcgggaaaaatcagccgctatagatggggagtataggctgcgcggcgaagccagaaagaccttcgtggagctcatgaggcggggagacctgcctgtttggcttagttacaaagtcgcttctgagggctttcaatattccgatcgtcgctggtgcttcgacggggaacgaaataaccaggtgctggaggaaaatatggacgtggagatctggacaaaggaaggagagaggaagaagctcaggccacggtggttggatgcacgcacttacagcgaccccctggccctaagagagtttaaagagttcgctgccggtaggcggtcagtcagtggcgatctgattctcgagatcgggaaacttcctcagcacctgacgcagcgagcacaaaacgcgttagacaatttggttatgctgcataacagcgaacagggaggcagagcctatcgccacgctatggaggaactcccggataccattgagacactgatgcttctggccctcatcgcagtgttgactggtggggtaaccctgtttttcttatccggcaggggactaggcaagacatctatagggctgctctgtgtgatggctagctccgtccttctgtggatggcctcagtggagccacattggatcgcagcctctattatcttggaatttttcctgatggttctcctgattcccgagcctgaccggcagcgtacaccccaggataatcaacttgcttacgtggtcatcggactcctgtttatgatattgactgtagcggccaacgaaatgggtctgttagagacgaccaaaaaggacctaggcattgggcacgtggcagttgagaatcaccatcacgctgccatgctggatgtggacctccatccagccagtgcatggacactttacgctgtcgccactaccatcattacacctatgatgagacacaccatcgaaaacactacagcgaacatatcgctgacggctatcgccaatcaggcagccattttgatgggactggataaaggctggcccatcagcaagatggacattggtgtgccactcctggctcttgggtgctattcccaggtcaaccctttaaccctgactgcagccgtgctcatgttggttgcgcattacgctatcataggcccgggactgcaagccaaagcaacaagggaggcccagaagcgcaccgctgccggcattatgaagaatcccaccgtggatgggatcgtagcaatcgacctagacccagtggtctatgatgctaaattcgaaaagcagctgggacagattatgctccttatcctgtgtacatctcaaatattgctgatgcggactacgtgggccctctgcgagtcaattaccctggcgacaggccctttaactaccctttgggaaggtagccccgggaaattttggaacacaaccatcgccgtttccatggcaaatattttccgaggaagttacctggctggcgccggtctcgcattctctctaatgaaaagcctgggcgggggaagaaggggcactggggctcagggagagacgttgggcgagaaatggaagcgccagctgaaccagctctcaaagtccgaatttaatacatataaacggagtggtatcatggaggtggacagaagcgaagccaaggaggggcttaaacgtggagaaaccactaagcacgccgtctctaggggcaccgcgaaactgcggtggttcgtggagcgcaacttggtaaagccagagggtaaggtgatagatctgggctgtgggcgaggaggctggtcctactattgcgctgggctcaaaaaggttacagaagtgaaaggatacactaagggcggtcctgggcacgaggaacccatcccgatggcaacctacggatggaatttagtcaaactgcattcaggcaaggacgtgtttttcattccacctgagaaatgtgatacacttctgtgcgacatcggcgaaagctcgcccaacccaacgattgaggaggggagaaccctaagggtcctcaagatggtggaaccctggctgcggggaaatcaattttgtatcaagattttgaacccttatatgccgtctgttgtagagactctggaacagatgcagcgcaaacacggtggcatgctcgtgagaaatccccttagtaggaactccacacatgagatgtactgggtcagctgcgggaccggaaatatcgtgtcagccgttaacatgacttcccgaatgctgttaaatcggttcacaatggctcaccgtaagccaacctatgagagagatgtggacctgggcgccggtacgcgccacgtcgcagtggaacctgaggtagccaacttggatataattgggcagaggatcgaaaacatcaaacatgagcacaagtctacctggcattacgacgaagataatccctataaaacatgggcttaccacggaagctatgaggtgaagcctagtggctccgcgagctctatggttaacggcgtcgtgaagctcctgactaaaccatgggacgtgattcccatggtcacccaaatagccatgacagacactaccccttttgggcagcagcgggttttcaaggagaaagtggatacaagaaccccaaaggcaaaacgcggaactgctcaaatcatggaagtaacggccaagtggctatggggttttctttcaaggaataagaaaccccgaatttgtacacgggaggagttcaccagaaaggtgaggagtaacgcagccatcggcgctgtctttgtggacgagaatcagtggaactccgccaaagaagcggttgaggatgagcgcttctgggacctggtgcatcgtgaacgggagctccacaagcaggggaaatgcgcaacttgcgtctacaatatgatgggaaagagagaaaagaaactgggcgagtttggtaaggccaaagggagcagggctatttggtacatgtggttgggagcccgcttcctggagttcgaggcactcggctttatgaacgaggatcactggttctctcgagaaaattcgctttcaggcgtggagggggaaggactgcataagttaggttatatcctgcgggacataagcaaaatcccgggcgggaacatgtacgctgatgacaccgccggatgggatacaagaattacggaggacgatttgcagaatgaggctaagatcaccgacattatggaacctgagcacgccctcctggcaaaatccatctttaagctaacttatcaaaacaaggtagttagggtgcagcgcccagcgaaaaatggcacagtcatggatgtgataagtagacgggaccagaggggttctggacaggtgggaacctacggccttaacactttcacaaatatggaagcccaactgattcgtcagatggagagcgaaggcatcttttccccctcagagctcgagacccctaacctggctgggcgagtcttggactggttagaaaagcatggagttgagcgcctgaaaagaatggccatcagtggtgatgactgtgtggtaaagccaattgatgaccggttcgcaacagctctcactgcccttaacgatatgggcaaagtgaggaaggacataccccagtgggaaccgtctaaggggtggaatgattggcagcaagtccctttttgcagccaccacttccatcagctgatcatgaaagacggacgcgagattgtggttccctgtagaaaccaggatgagctagtgggccgggcaagggtctcccagggtgccgggtggtcactgcgagagaccgcgtgcctcggaaagagctatgctcaaatgtggcagttgatgtactttcaccgtagagacctgcgccttgccgcaaatgccatctgttctgctgtgccagtagattgggttcctacgtcccggaccacatggagtattcatgcccaccatcagtggatgactaccgaggacatgctgagcgtgtggaacagggtctggatcgaagagaatccctggatggaagacaaaacacacatatcgtcctggggcgatgtgccatatctcggcaagagagaggaccaatggtgcgggtctttaatcggactgactgcacgcgctacctgggccacgaacattcaggttgcgatcaatcaggtgcggaggttgctgggtaacgaaaattacctcgattacatgacatcaatgaaacgattcaagaacgagagcgaccccgagggcgctctttggtga

SEQ ID NO: 14088 - RNA, 9879 nt, synthetic construct
  misc_feature 1..9879: note = derived and/or modified CDS sequence (opt3) from DENV-1__JQ045635__SS-prME
  source 1..9879: mol_type = other RNA
agcgtgaccatgctgctcatgcttatgcccaccgcactggctttccacttgactacgagaggaggggaacctcatatgatcgtctccaagcaggaaagagggaagtctttactgtttaagacctcagccggtgttaacatgtgcaccctaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgattgccacaatcacaccccaggcgcctagcactgagatccagttaaccgactacggggccctgacactcgattgttctccaaggaccggacttgactttaacgaaatggtcctgttgactatgaaggagaaatcctggctagtgcataagcagtggttcctggatctcccgctgccctggacatcaggcgcaagcacgagtcaagagacctggaatcggcaggaccttctggtaacttttaaaacagctcacgccaagaagcaggaagttgtggtcttgggttctcaagagggggctatgcacaccgccctcacaggcgcaactgaaattcagacctccggaacgaccacaatattcgccggccatctgaaatgccgtttaaagatggataaactgactctaaaggggatgagctatgtgatgtgtaccggatcgttcaaactcgagaaggaagtcgctgagacacagcacggtactgtgctggttcagatcaagtacgagggcaccgacgcgccttgcaaaattccattttctacgcaagatgaaaagggggcaacacagaacggacgccttatcaccgccaatcccatagtgactgacaaagagaagcctgtaaacattgaagctgagccacccttcggcgagtcctatatcgtcatcggtgccggggaaaaagcattgaagctgtcatggtttaagaaaggcagtagcattggaaagatgttcgaggccacagctagaggcgccaggcggatggcaatcctcggggataccgcgtgggactttggatccattggtggcgtgttcacttctgttgggaaactggtgcatcagatatttggaaccgcttacggcgtccttttcagcggtgtgtcatggacaatgaagatcgggattggcgtactgttgacgtggctcggactgaatagtcgatccaccagcttatctatgacttgtatcgccgtgggcctggttacactatacctcggggtcatggtgcaggcagattcaggatgcgtgatcaactggaaaggccgcgaactgaagtgtggtagtgggatttttgtcaccaatgaggttcacacatggactgaacaatataagttccaggccgacagcccgaaaagactttccgctgccataggaaaggcatgggaggagggcgtgtgcggtatcaggtctgctacccggttggaaaacattatgtggaaacagatctcgaacgagctgaatcatattctcctggaaaacgacatgaagttaacggtggtagtcggcgatgtggccgggatcctggcgcagggcaagaagatgatacgccctcaacccatggagtacaaatatagctggaagtcctggggcaaggccaaaatcattggggctgacgttcagaatacaacctttatcattgatggaccaaacactcctgaatgtcccgacgatcagagagcatggaatatctgggaggtggaggactacggcttcggtatatttaccacaaacatttggcttaagttgagggattcatatactcaggtctgcgaccaccgtctcatgagtgccgctatcaaagattctaaggccgtgcacgcagacatggggtactggattgaaagcgagaaaaatgaaacctggaagctggcgcgggcctccttcatcgaggttaagacatgtatatggccaaaatcacatacgctatggagcaacggagtgctggaatctgagatgatcattcccaagatctatggcggtcctatttcccaacacaattaccgaccaggctacttcacccagactgctgggccgtggcatctcggaaaactggagcttgattttgacttgtgcgaaggcacaaccgtagtcgtggatgagcactgcgggaacagaggacccagtctgaggactacaaccgtgacgggcaagatcatacacgaatggtgttgccgcagctgtactttacctccactccggttcaaaggtgaggacgggtgctggtatggaatggagattagacccgtcaaggaaaaggaggaaaatctggttaaatctatggtgtccgccggctcaggtgaggtagacagttttagccttggcctgttgtgtatctcgatcatgattgaagaggtgatgaggtcccgctggtctcgaaagatgctcatgaccgggacactggcagtcttctttctactgatcatgggacagctcacctggaacgatctgattcggctttgcataatggtgggcgctgacgccagcgatcgtatggggatgggaactacatacttggcactgatggccaccttcaaaatgagacctatgtttgctgttggcttactcttcaggcgcctgacatcacgggaggtgcttctgctaactatcggtctcagtctggtcgcgtccgtggaattgccaaattctctggaggaattaggggacggactcgccatgggcattatgatcctgaaacttctgaccgattttcaaagccatcagttgtgggcaacgctcctgtccctaacattcattagaaccactttttcactgcactatgcttggaaaaccatggccatggttcttagcatcgtgagtctcttccccctgtgtttgtctacaacttcccagaagaccacgtggctgccggtcttactcggcagcctggggtgcaagcctcttacaatgtttctgatagccgagaacaaaatctggggaaggaagtcgtggccattgaatgaaggtattatggctgtaggcatcgtgtcaattctcctgtctagtctactgaaaaacgacgttccccttgcagggcctctcatcgccggaggcatgctgatagcgtgttacgtgatttccggtagctctgctgatttgagcttagagaaggccgcagtcgtgtcctgggaggaagaggccgaacattcaggggctagtcacaacatcctggtagaggtgcaggacgatggaaccatgaaaatcaaggacgaagaacgagatgacactctcacaattctgcttaaagcaaccctgttggccgtcagcggcgtttatcccctatctataccagcgactctgttcgtgtggtacttctggcaaaagaagaaacagcgctccggcgtgctctgggatacaccttcacccccagaggtcgaacgggctgtgctggacgacgggatctatagaattatgcagaggggacttttaggtcgtagtcaggttggcgtaggggtgtttcaagagaatgtcttccataccatgtggcacgtgacgcgcggagccgttctgatgtaccagggcaagcggctcgaaccgagctgggcatccgtgaaaaaggatttgatctcttacggtgggggatggagactgcagggctcgtggaacactggcgaggaggtccaggtgattgccgtagaacctgggaaaaatcccaagaacgtccaaaccgctccaggaacatttaagaccagcgagggtgaagtgggcgccatcgcactcgacttcaaacccgggacatcaggatcccctatagttaatagggagggcaagatcgtgggtctgtatgggaacggagtcgtgactaccagtggcacgtacgtttctgctattgcccaggcgaaagccagccaggaaggcccacttcccgagatcgaggatgaagtgtttcgaaagcggaatctgacaattatggacttgcaccctgggtccggaaaaactcgcagatatctaccggcaatcgtcagggaggctataaagcggaagctgcgaaccctcattttagccccaacaagagtggtagcttcagaaatggcagaggccctgaaaggtatgcccatccgctaccaaaccactgccgtgaagtctgaacataccggcaaagagatcgttgatcttatgtgccacgctacattcacgatgaggctgctcagccctgtccgtgtgccaaactataatatgattatcatggacgaggcgcattttactgatcccagttccatagcagcccgggggtacattagcaccagagtgggaatgggcgaagctgccgcaatcttcatgacagccacccctccgggttctgtcgaggcttttccccagtcaaacgcggtaattcaggacgaagagagggatatcccagaacgctcctggaatagtgggtatgagtggataactgacttccctggaaagacagtgtggtttgttcccagcattaaatcgggcaacgatatcgccaattgtttgcgaaagaacggcaagagagtgatccagctgtctcggaaaaccttcgacacggagtaccaaaagactaaaaataacgactgggattacgtcgtgacaaccgacatttccgaaatgggggcaaacttcagggctgatcgcgttatcgacccacgtagatgcctcaagcctgtgattctgaaagatggacccgagcgggtcatacttgccggtccaatgccggtgaccgtagcaagcgccgctcagaggcgcggccgaatcgggagaaatcacaacaaggaaggagaccagtatatttacatgggccagcctctaaataacgatgaggaccatgcccactggactgaggcgaagatgctgttggataatatcaacacacccgaaggtatcattccagcattatttgaccccgagcgggaaaaatcagccgctatagatggggagtataggctgcgcggcgaagccagaaagaccttcgtggagctcatgaggcggggagacctgcctgtttggcttagttacaaagtcgcttctgagggctttcaatattccgatcgtcgctggtgcttcgacggggaacgaaataaccaggtgctggaggaaaatatggacgtggagatctggacaaaggaaggagagaggaagaagctcaggccacggtggttggatgcacgcacttacagcgaccccctggccctaagagagtttaaagagttcgctgccggtaggcggtcagtcagtggcgatctgattctcgagatcgggaaacttcctcagcacctgacgcagcgagcacaaaacgcgttagacaatttggttatgctgcataacagcgaacagggaggcagagcctatcgccacgctatggaggaactcccggataccattgagacactgatgcttctggccctcatcgcagtgttgactggtggggtaaccctgtttttcttatccggcaggggactaggcaagacatctatagggctgctctgtgtgatggctagctccgtccttctgtggatggcctcagtggagccacattggatcgcagcctctattatcttggaatttttcctgatggttctcctgattcccgagcctgaccggcagcgtacaccccaggataatcaacttgcttacgtggtcatcggactcctgtttatgatattgactgtagcggccaacgaaatgggtctgttagagacgaccaaaaaggacctaggcattgggcacgtggcagttgagaatcaccatcacgctgccatgctggatgtggacctccatccagccagtgcatggacactttacgctgtcgccactaccatcattacacctatgatgagacacaccatcgaaaacactacagcgaacatatcgctgacggctatcgccaatcaggcagccattttgatgggactggataaaggctggcccatcagcaagatggacattggtgtgccactcctggctcttgggtgctattcccaggtcaaccctttaaccctgactgcagccgtgctcatgttggttgcgcattacgctatcataggcccgggactgcaagccaaagcaacaagggaggcccagaagcgcaccgctgccggcattatgaagaatcccaccgtggatgggatcgtagcaatcgacctagacccagtggtctatgatgctaaattcgaaaagcagctgggacagattatgctccttatcctgtgtacatctcaaatattgctgatgcggactacgtgggccctctgcgagtcaattaccctggcgacaggccctttaactaccctttgggaaggtagccccgggaaattttggaacacaaccatcgccgtttccatggcaaatattttccgaggaagttacctggctggcgccggtctcgcattctctctaatgaaaagcctgggcgggggaagaaggggcactggggctcagggagagacgttgggcgagaaatggaagcgccagctgaaccagctctcaaagtccgaatttaatacatataaacggagtggtatcatggaggtggacagaagcgaagccaaggaggggcttaaacgtggagaaaccactaagcacgccgtctctaggggcaccgcgaaactgcggtggttcgtggagcgcaacttggtaaagccagagggtaaggtgatagatctgggctgtgggcgaggaggctgggcttactattgcgcagggctcaaaaaggttacagaagtgaaaggatacactaagggcggtcctgggcacgaggaacccatcccgatggccacctacggatggaatttagtcaaactgcattccggcaaggacgtgtttttcattccacctgagaaatgtgatacacttctgtgcgacatcggcgaatcaagccccaacccaacgattgaggaggggagaaccctaagggtcctcaagatggtggaaccctggctgcggggaaatcaattttgtatcaagattttgaacccttatatgccgtcggttgtagagactctggaacagatgcagcgcaaacacggtggcatgctcgtgagaaatcccctttctaggaacagtacacatgagatgtactgggtctcctgcgggaccggaaatatcgtgagcgctgttaacatgacttcacgaatgctgttaaatcggttcacaatggcccaccgtaagccaacctatgagagagatgtggacctgggcgcaggtacgcgccacgtcgccgtggaacctgaggtagctaacttggatataattgggcagaggatcgaaaacatcaaacatgagcacaagtccacctggcattacgacgaagataatccctataaaacatgggcgtaccacggatcttatgaggtgaagcctagcggcagtgcctccagcatggttaacggcgtcgtgaagctcctgactaaaccatgggacgtgattcccatggtcacccaaatagcaatgacagacactaccccttttgggcagcagcgggttttcaaggagaaagtggatacaagaaccccaaaggctaaacgcggaactgcccaaatcatggaagtaacggcaaagtggctatggggttttctttctaggaataagaaaccccgaatttgtacacgggaggagttcaccagaaaggtgaggtcaaacgccgctatcggcgccgtctttgtggacgagaatcagtggaacagtgcgaaagaagcagttgaggatgagcgcttctgggacctggtgcatcgtgaacgggagctccacaagcaggggaaatgcgccacttgcgtctacaatatgatgggaaagagagaaaagaaactgggcgagtttggtaaggctaaagggtccagggccatttggtacatgtggttgggagcacgcttcctggagttcgaggctctcggctttatgaacgaggatcactggttcagccgagaaaattctctttcgggcgtggagggggaaggactgcataagttaggttatatcctgcgggacatatcaaaaatcccgggcgggaacatgtacgccgatgacaccgctggatgggatacaagaattacggaggacgatttgcagaatgaggccaagatcaccgacattatggaacctgagcacgcactcctggcgaaaagcatctttaagctaacttatcaaaacaaggtagttagggtgcagcgcccagccaaaaatggcacagtcatggatgtgatatccagacgggaccagaggggtagtggacaggtgggaacctacggccttaacactttcacaaatatggaagctcaactgattcgtcagatggagtctgaaggcatctttagcccctccgagctcgagacccctaacctggccgggcgagtcttggactggttagaaaagcatggagttgagcgcctgaaaagaatggcaatctcaggtgatgactgtgtggtaaagccaattgatgaccggttcgctacagccctcactgcacttaacgatatgggcaaagtgaggaaggacataccccagtgggaaccgagtaaggggtggaatgattggcagcaagtccctttttgctctcaccacttccatcagctgatcatgaaagacggacgcgagattgtggttccctgtagaaaccaggatgagctagtgggccgggccagggtcagccagggtgcggggtggtccctgcgagagaccgcttgcctcggaaagtcatatgcccaaatgtggcagttgatgtactttcaccgtagagacctgcgccttgcagccaatgctatctgtagcgccgtgccagtagattgggttcctacgtctcggaccacatggtccattcatgcacaccatcagtggatgactaccgaggacatgctgagtgtgtggaacagggtctggatcgaagagaatccctggatggaagacaaaacacacataagctcgtggggcgatgtgccatatctcggcaagagagaggaccaatggtgcgggtccttaatcggactgactgctcgcgccacctgggcgacgaacattcaggttgctatcaatcaggtgcggaggttgctgggtaacgaaaattacctcgattacatgacatctatgaaacgattcaagaacgagtcagaccccgagggcgccctttggtga

SEQ ID NO: 14089 - RNA, 9879 nt, synthetic construct
  misc_feature 1..9879: note = derived and/or modified CDS sequence (opt3) from DENV-1__JQ045637__SS-prME
  source 1..9879: mol_type = other RNA
agcgtgaccatgctgctcatgcttatgcccacagcactggctttccacttgactacgagaggaggggaacctcatatgatcgtctccaagcaggaaagagggaaatctttactgtttaagacctcagccggtgttaacatgtgcacactaattgcaatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagatgtctggaacaactaccatttttgcaggccatttaaaatgccgtctgaagatggataaactaacactcaaggggatgtcctatgtgatgtgtactggcagcttcaaactggagaaggaagtcgccgagacccagcacggtacggtgcttgttcagataaagtacgagggcacagacgctccttgcaaaatcccattctcgacccaagatgaaaagggggtgactcagaacggacgcttgattacagcgaatcccatcgtaaccgacaaagagaagcctgtcaacatagaagcagagccaccctttggcgagtcttatattgtgatcggtgccggggaaaaagctctgaagctctcctggttcaagaaaggctcaagtatcggaaagatgtttgaggccactgcaagaggcgccaggcggatggctattctgggggataccgcctgggacttcggaagcatcggtggcgtttttacatccgtggggaaacttgtccatcagattttcggaacggcatacggcgtgctgttttctggtgtaagctggaccatgaagatagggatcggcgtgttgctcacttggctgggattaaattcacgaagtacatccctgagcatgacctgtattgcggttggcctagtcacactctacctgggggtgatggtgcaggctgattctggatgcgtcatcaactggaaaggccgcgaacttaagtgtggttcagggatcttcgttactaatgaggtgcacacctggacggaacaatataagtttcaggccgacagtccgaaaagattgagcgcagccattggaaaggcttgggaggagggcgtgtgcggtataaggtccgccacacggctggaaaacatcatgtggaaacagatttctaacgagctcaatcatatcctgttagaaaacgacatgaagttcaccgtagtcgtgggcgatgttgcagggattctggctcagggcaagaagatgatccgccctcaacccatggagtacaaatattcgtggaaaagctggggcaaggccaagataatcggggcggacgtgcagaatactacctttattatcgatggaccaaacacacctgaatgtcccgacgatcagagagcctggaatatttgggaggtcgaggactacggcttcggtatctttactaccaacatatggcttaagttgagggattcctatacacaggtgtgcgaccaccgtctcatgtcagctgcaattaaagatagtaaggccgttcacgctgacatggggtactggatcgaatctgagaaaaatgaaacgtggaagctggcccgggccagcttcattgaggtgaagacctgtatctggccaaaatcccatactctatggtcaaacggagtactggaaagcgagatgataatccccaagatttatggcggtcctatctctcaacacaattaccgaccaggctacttcacacagaccgcggggccgtggcatctcggaaaactggagcttgattttgacttgtgcgaaggcactacagtcgtggtggatgagcactgcgggtccagaggacccagtctgaggaccacgactgtcaccggcaagattatccacgaatggtgttgccgcagctgtacattacctccactccggttcagaggtgaggacgggtgctggtatggaatggagataaggcccgttaaagaaaaggaggaaaacctggtgaagtctatggtatccgccggctcaggtgaggtggacagtcttagcctgggcttgctctgtatttcgatcatgatcgaagaggtcatgcgctcccgatggtctcggaaaatgctgatgaccgggactctagctgtgtttttcctgctcattatgggacagctgacatggaatgatcttatccgtttgtgcattatggttggcgccaacgcaagcgacagaatggggatgggaaccacatacctggctttaatggccgcatttaagatgaggcctatgttcgccgtgggcctcctgtttcgccggcttacttcaagagaggtcctgctactcaccataggtctgagtttggtggcttccgttgaactgccaaattctttagaggaactcggggatggactggcgatgggcatcatgattcttaaactgttgacggacttccaaagccatcagctctgggccacactgctatccctgacctttatcaagactaccttctcacttcactatgcatggaaaacaatggctatggtgctcagcattgtcagtctgtttcccttgtgtctgtctactacctcccagaagacgacatggttaccggtactcctgggcagccttgggtgcaagcctctgaccatgttcttgatcgccgagaacaaaatatggggaaggcgatcgtggccactcaatgaaggtatcatggccgtgggcattgtttcaatcctgctatctagtctgcttaagaacgatgtgcccctcgctgggcctctgattgcaggaggcatgttgatcgcctgttacgtcatatccggtagctctgcggacttaagcctggagaaagctgccgaggtgtcctgggaagaggaagcagagcattcaggggccagtcacaacattctcgtagaagtgcaggatgacggaactatgaagatcaaagatgaggagcgcgacgatacactgaccatccttctgaaggctactttgctagcagtcagcggcgtttatcccctgtctattccagccacactctttgtgtggtacttctggcagaaaaagaagcagcggtccggcgtgctgtgggacaccccttcacccccagaagtcgagagagcggtgcttgatgacgggatatataggatcatgcagcgtggattactgggtcgcagtcaggttggcgtaggggtgttccaagaaaatgtctttcatacgatgtggcacgtgactcggggagctgttctcatgtaccagggcaaaagattggagccgagctgggcctccgtgaagaaagacctgatttcttacggtgggggatggaggctccagggctcgtggaacaccggcgaggaagtccaggtgatcgcagtagagcctgggaagaatcccaaaaacgtccaaacagccccaggaaccttcaagacacccgaaggtgaggtgggcgctattgccctggattttaagcctgggactagcggatcaccaatcgttaatcgagaaggcaaaatagtgggtctttatgggaacggagtcgtgaccacgtccggcacatacgttagtgcaatcgctcaggccaaggcgtctcaggagggccccctgcctgagattgaagacgaggtgttccggaaacgcaatttgactatcatggatctacacccggggagcggaaagaccagaaggtatctgccagccattgtccgggaagcaatcaaacgaaagctcagaacattaatactggctcccacccgcgtggtagcctccgagatggctgaagcacttaagggtatgcctattaggtaccaaactaccgccgtgaaatcagagcatacaggcaaggagatcgttgacctgatgtgccacgccacgtttactatgcgtctcttgtctccagtccgggtgcccaactataatatgatcattatggatgaagctcatttcaccgaccctagcagtatcgcggcaagagggtacatatccacaagggtgggaatgggcgaggccgctgccatttttatgaccgcaactccgcccggtagcgtcgaagccttcccacagtctaacgctgtaatccaggatgaggaacgcgacattcctgagcgatcatggaactccgggtatgagtggatcacagattttcccggaaaaaccgtgtggttcgttccaagtataaagagcggcaacgacattgcgaattgtctgaggaaaaatggcaagcgggtgatccagctctcgaggaagacgtttgatactgaataccagaaaacaaagaataacgactgggactacgtcgtgaccaccgatatctctgagatgggggccaacttccgcgcagaccgtgttattgatcctagacggtgcctgaaacccgtgatccttaaggacggaccagaaagggtcattctagctggtccgatgcctgtgactgtagcctccgcagcccagcgccgaggcagaatagggcggaatcacaacaaagagggagatcagtatatctacatgggccagcccctgaataacgacgaggatcatgctcactggacagaagccaagatgttgttagacaatattaacaccccagagggtatcatccccgcgctgttcgaacctgagagggaaaagagcgcagccattgatggggagtatcgcctcagaggcgaggctaggaaaacatttgtggaactgatgcggcgtggagaccttccagtttggctgtcatacaaggtcgccagtgagggcttccaatattctgatcgccgatggtgctttgacggggaaagaaataaccaggtgctcgaggaaaatatggatgtggagatatggactaaagagggagaaaggaagaaattgcggccccgctggctggacgctagaacgtactccgaccctctagcactgagggagttcaaggaatttgccgctggtcggcgaagcgtctcaggcgatctcatccttgagattgggaaactgccgcagcacttaacccagagagcccaaaacgcattggacaatctggttatgctccataacagtgaacagggaggccgcgcgtataggcacgccatcgaggagctgccagatacaattgaaactcttatgctgctcgctttgatcgccgtgctgaccggtggggtaacattattctttctaagcggccggggactgggcaagacctccatagggctcctttgtgtgatggcatctagcgtcctgttgtggatggcttccgtggagccccattggatcgccgcatcaattatcctggagttctttctcatggttctgcttattcctgagcccgaccgtcagagaactccacaggataatcaactcgcctacgtggtcatcggactgttgttcatgatactgacggtagctgcgaacgagatgggtttactagaaaccacaaagaaagacctgggcattgggcacgtggccgttgagaatcaccatcacgcagctatgctcgatgtggaccttcatcctgcctctgcctggactctgtacgcagtcgctaccacaatcattacccccatgatgaggcacactatcgaaaacacaacggccaacataagtttgaccgcgatcgctaatcaggccgcaattctgatgggactcgataagggctggccaatctcgaaaatggacattggtgtgcctctgcttgccttagggtgctatagccaggtcaacccgctgactctcacagctgcagtgttgatgctggttgcccattacgcgatcataggccccggactacaagctaaggccacccgcgaggcacagaaacggaccgccgctggcattatgaagaatccaacagtggatgggatcgtagccatcgacctggatcctgtggtctatgacgcaaagtttgaaaaacagctcggacagattatgcttctgatcttgtgtacttcccaaatactgctcatgcgaacgacctgggctctgtgcgagtctattacattagccactggcccccttaccacactgtgggagggttcaccagggaagttctggaacaccactatcgcggttagcatggccaatatttttagaggatcctacctcgcaggcgctggtctagccttcagtctgatgaaatctttgggcgggggaaggcgcggcacgggggcacagggagaaacactgggcgagaagtggaaacggcagctcaaccagcttagcaagtcagagttcaatacctataagagatccggtatcatggaggtggaccgtagtgaagctaaagaggggctgaagaggggagagactaccaaacacgccgtcagccggggcacagccaagttgcgctggtttgtggaacgaaacctggtaaaacctgagggtaaggtgatagatctcggctgtgggagaggaggctggtcttactattgcgcggggttaaagaaagttactgaagtgaagggatacaccaaaggcggtcccgggcacgaggaaccgatcccaatggctacatacggatggaatctggtcaaacttcattccggcaaagacgtgttctttattcctcccgagaagtgtgatacgctgctatgcgacatcggcgagtcaagcccaaaccccaccattgaagaggggaggactctccgggtcctgaaaatggtggaaccttggttgcgcggaaatcaattctgtatcaagattctgaacccgtatatgccctcggttgtagagacactcgagcagatgcagagaaagcacggtggcatgcttgtgaggaatccactgtctcgaaacagtacccatgaaatgtactgggtctcctgcgggactggaaatatcgtgagcgcagttaacatgacatcacggatgttactgaatcgttttaccatggcccacagaaaacctacgtatgagcgcgatgtggacttgggcgctggtaccaggcacgtcgccgtggaacccgaggtagcaaacctcgatataattgggcagcggatcgaaaacatcaagcatgagcacaaatccacatggcattacgacgaggataatccttataagacttgggcctaccacggatcttatgaagtgaaaccaagcggcagtgcttccagcatggttaacggcgtcgtgaagctgctaaccaagccctgggacgtgattcctatggtcacacaaatagcgatgactgataccacaccattcgggcagcagagagtttttaaagagaaggtggacacccgcactcccaaagccaagaggggaacggcacaaatcatggaagtaacagctaaatggctttggggtttcctgtctcgaaataagaagccgcggatttgtaccagagaggaatttactaggaaagtgcgctcaaacgccgcaatcggcgccgtcttcgtggacgagaatcagtggaacagtgctaaggaggccgttgaagatgagcgtttttgggacctcgtgcatcgggaaagagagctgcacaaacaggggaagtgcgcgacctgcgtctacaatatgatgggaaaaagggaaaagaagttgggcgagttcggtaaagcaaaggggtcccgcgccatttggtacatgtggctgggagctcgatttctcgagttcgaagcccttggcttcatgaacgaggatcactggtttagccgggaaaattctctgtcgggcgtggagggggagggattacataaactgggttatatcttgagagacatatcaaagatccctggcgggaacatgtacgcagatgacacagctggatgggatacgaggattaccgaagacgatctccagaatgaggcccgcatcactgacattatggaaccagagcacgctctgctagccagaagcatcttcaaacttacatatcaaaacaaggtagttcgggtgcagaggcccgccaaaaatggcaccgtcatggatgtgatatcccgtcgagaccagcgcggtagtggacaggtgggaacttacggcctgaacacatttaccaatatggaagcgcaactcattagacagatggagtctgagggcatcttcagcccttccgaactggagacaccaaacttggccgaacgggtcttagattggctggagaagtatggggttgaaaggctcaagcgcatggctatctcaggagacgactgtgtggtaaaacccattgatgacagatttgccactgcacttaccgctctgaacgatatgggtaaggtgcggaaagacataccgcagtgggagcctagtaagggctggaatgattggcagcaagtccccttctgctctcatcactttcaccagctaatcatgaaagacgggagggagattgtggttccatgtcgaaaccaggatgaactggtgggacgtgccagagtcagccagggcgcaggttggtccctccgcgagacggcctgcttggggaagtcatacgcgcaaatgtggcagctgatgtatttccatcggagggaccttagactggctgccaatgcaatctgtagcgccgtgcctgtagattggattcccacctctcgcacaacttggtccatccacgctcatcaccagtggatgaccacagaagacatgctcagtgtttggaaccgggtgtggatagaggaaaatccatggatggaggataagactcatatcagctcgtggggagacgtcccctacttaggcaaaagggaggaccaatggtgcggctccctgattgggttgaccgcccgagcaacgtgggctacaaacatccaggtggccattaatcaggttagacggctgatcggaaacgaaaattacctcgattatatgacctctatgaagaggtttaaaaacgagtcagaccctgaaggtgcgctttggtga

SEQ ID NO: 14090 - RNA, 9879 nt, synthetic construct
  misc_feature 1..9879: note = derived and/or modified CDS sequence (opt3) from DENV-1__JQ045638__SS-prME
  source 1..9879: mol_type = other RNA
agcgtgaccatgctgctcatgcttatgcccacagcactggctttccacttgactacgagaggaggggaacctcatatgatcgtctccaagcaggaaagagggaaatctttactgtttaagacctcagccggtgttaacatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagatgtctggaacaactaccatttttgcaggccatttaaaatgccgtctgaagatggataaactaacactcaaggggatgtcctatgtgatgtgtactggcagcttcaaactggagaaggaagtcgccgagacccagcacggtacggtgcttgttcagataaagtacgagggcacagacgctccttgcaaaatcccattctcgacccaagatgaaaagggggtgactcagaacggacgcttgattacagcgaatcccatcgtaaccgacaaagagaagcctgtcaacatagaagcagagccaccctttggcgagtcttatattgtgatcggtgccggggaaaaagctctgaagctctcctggttcaagaaaggctcaagtatcggaaagatgtttgaggccactgcaagaggcgccaggcggatggctattctgggggataccgcctgggacttcggaagcatcggtggcgtttttacatccgtggggaaacttgtccatcagattttcggaacggcatacggcgtgctgttttctggtgtaagctggaccatgaagatagggatcggcgtgttgctcacttggctgggattaaattcacgaagtacatccctgagcatgacctgtattgcggttggcctagtcacactctacctgggggtgatggtgcaggctgattctggatgcgtcatcaactggaaaggccgcgaacttaagtgtggttcagggatcttcgttactaatgaggtgcacacctggacggaacaatataagtttcaggccgacagtccgaaaagattgagcgcagccattggaaaggcttgggaggagggcgtgtgcggtataaggtccgccacacggctggaaaacatcatgtggaaacagatttctaacgagctcaatcatatcctgttagaaaacgacatgaagttcaccgtagtcgtgggcgatgttgcagggattctggctcagggcaagaagatgatccgccctcaacccatggagtacaaatattcgtggaaaagctggggcaaggccaagataatcggggcggacgtgcagaatactacctttattatcgatggaccaaacacacctgaatgtcccgacgatcagagagcctggaatatttgggaggtcgaggactacggcttcggtatctttactaccaacatatggcttaagttgagggattcctatacacaggtgtgcgaccaccgtctcatgtcagctgcaattaaagatagtaaggccgttcacgctgacatggggtactggatcgaatctgagaaaaatgaaacgtggaagctggcccgggccagcttcattgaggtgaagacctgtatctggccaaaatcccatactctatggtcaaacggagtactggaaagcgagatgataatccccaagatttatggcggtcctatctctcaacacaattaccgaccaggctacttcacacagaccgcggggccgtggcatctcggaaaactggagcttgattttgacttgtgcgaaggcactacagtcgtggtggatgagcactgcgggtccagaggacccagtctgaggaccacgactgtcaccggcaagattatccacgaatggtgttgccgcagctgtacattacctccactccggttcagaggtgaggacgggtgctggtatggaatggagataaggcccgttaaagaaaaggaggaaaacctggtgaagtctatggtatccgccggctcaggtgaggtggacagtcttagcctgggcttgctctgtatttcgatcatgatcgaagaggtcatgcgctcccgatggtctcggaaaatgctgatgaccgggactctagctgtgtttttcctgctcattatgggacagctgacatggaatgatcttatccgtttgtgcattatggttggcgccaacgcaagcgacagaatggggatgggaaccacatacctggctttaatggccgcatttaagatgaggcctatgttcgccgtgggcctcctgtttcgccggcttacttcaagagaggtcctgctactcaccataggtctgagtttggtggcttccgttgaactgccaaattctttagaggaactcggggatggactggcgatgggcatcatgattcttaaactgttgacggacttccaaagccatcagctctgggccacactgctatccctgacctttatcaagactaccttctcacttcactatgcatggaaaacaatggctatggtgctcagcattgtcagtctgtttcccttgtgtctgtctactacctcccagaagacgacatggttaccggtactcctgggcagccttgggtgcaagcctctgaccatgttcttgatcgccgagaacaaaatatggggaaggcgatcgtggccactcaatgaaggtatcatggccgtgggcattgtttcaatcctgctatctagtctgcttaagaacgatgtgcccctcgctgggcctctgattgcaggaggcatgttgatcgcctgttacgtcatatccggtagctctgcggacttaagcctggagaaagctgccgaggtgtcctgggaagaggaagcagagcattcaggggccagtcacaacattctcgtagaagtgcaggatgacggaactatgaagatcaaagatgaggagcgcgacgatacactgaccatccttctgaaggctactttgctagcagtcagcggcgtttatcccctgtctattccagccacactctttgtgtggtacttctggcagaaaaagaagcagcggtccggcgtgctgtgggacaccccttcacccccagaagtcgagagagcggtgcttgatgacgggatatataggatcatgcagcgtggattactgggtcgcagtcaggttggcgtaggggtgttccaagaaaatgtctttcatacgatgtggcacgtgactcggggagctgttctcatgtaccagggcaaaagattggagccgagctgggcctccgtgaagaaagacctgatttcttacggtgggggatggaggctccagggctcgtggaacaccggcgaggaagtccaggtgatcgcagtagagcctgggaagaatcccaaaaacgtccaaacagccccaggaaccttcaagacacccgaaggtgaggtgggcgctattgccctggattttaagcctgggactagcggatcaccaatcgttaatcgagaaggcaaaatagtgggtctttatgggaacggagtcgtgaccacgtccggcacatacgttagtgcaatcgctcaggccaaggcgtctcaggagggccccctgcctgagattgaagacgaggtgttccggaaacgcaatttgactatcatggatctacacccggggagcggaaagaccagaaggtatctgccagccattgtccgggaagcaatcaaacgaaagctcagaacattaatactggctcccacccgcgtggtagcctccgagatggctgaagcacttaagggtatgcctattaggtaccaaactaccgccgtgaaatcagagcatacaggcaaggagatcgttgacctgatgtgccacgccacgtttactatgcgtctcttgtctccagtccgggtgcccaactataatatgatcattatggatgaagctcatttcaccgaccctagcagtatcgcggcaagagggtacatatccacaagggtgggaatgggcgaggccgctgccatttttatgaccgcaactccgcccggtagcgtcgaagccttcccacagtctaacgctgtaatccaggatgaggaacgcgacattcctgagcgatcatggaactccgggtatgagtggatcacagattttcccggaaaaaccgtgtggttcgttccaagtataaagagcggcaacgacattgcgaattgtctgaggaaaaatggcaagcgggtgatccagctctcgaggaagacgtttgatactgaataccagaaaacaaagaataacgactgggactacgtcgtgaccaccgatatctctgagatgggggccaacttccgcgcagaccgtgttattgatcctagacggtgcctgaaacccgtgatccttaaggacggaccagaaagggtcattctagctggtccgatgcctgtgactgtagcctccgcagcccagcgccgaggcagaatagggcggaatcacaacaaagagggagatcagtatatctacatgggccagcccctgaataacgacgaggatcatgctcactggacagaagccaagatgttgttagacaatattaacaccccagagggtatcatccccgcgctgttcgaacctgagagggaaaagagcgcagccattgatggggagtatcgcctcagaggcgaggctaggaaaacatttgtggaactgatgcggcgtggagaccttccagtttggctgtcatacaaggtcgccagtgagggcttccaatattctgatcgccgatggtgctttgacggggaaagaaataaccaggtgctcgaggaaaatatggatgtggagatatggactaaagagggagaaaggaagaaattgcggccccgctggctggacgctagaacgtactccgaccctctagcactgagggagttcaaggaatttgccgctggtcggcgaagcgtctcaggcgatctcatccttgagattgggaaactgccgcagcacttaacccagagagcccaaaacgcattggacaatctggttatgctccataacagtgaacagggaggccgcgcgtataggcacgccatcgaggagctgccagatacaattgaaactcttatgctgctcgctttgatcgccgtgctgaccggtggggtaacattattctttctaagcggccggggactgggcaagacctccatagggctcctttgtgtgatggcatctagcgtcctgttgtggatggcttccgtggagccccattggatcgccgcatcaattatcctggagttctttctcatggttctgcttattcctgagcccgaccgtcagagaactccacaggataatcaactcgcctacgtggtcatcggactgttgttcatgatactgacggtagctgcgaacgagatgggtttactagaaaccacaaagaaagacctgggcattgggcacgtggccgttgagaatcaccatcacgcagctatgctcgatgtggaccttcatcctgcctctgcctggactctgtacgcagtcgctaccacaatcattacccccatgatgaggcacactatcgaaaacacaacggccaacataagtttgaccgcgatcgctaatcaggccgcaattctgatgggactcgataagggctggccaatctcgaaaatggacattggtgtgcctctgcttgccttagggtgctatagccaggtcaacccgctgactctcacagctgcagtgttgatgctggttgcccattacgcgatcataggccccggactacaagctaaggccacccgcgaggcacagaaacggaccgccgctggcattatgaagaatccaacagtggatgggatcgtagccatcgacctggatcctgtggtctatgacgcaaagtttgaaaaacagctcggacagattatgcttctgatcttgtgtacttcccaaatactgctcatgcgaacgacctgggctctgtgcgagtctattacattagccactggcccccttaccacactgtgggagggttcaccagggaagttctggaacaccactatcgcggttagcatggccaatatttttagaggatcctacctcgcaggcgctggtctagccttcagtctgatgaaatctttgggcgggggaaggcgcggcacgggggcacagggagaaacactgggcgagaagtggaaacggcagctcaaccagcttagcaagtcagagttcaatacctataagagatccggtatcatggaggtggaccgtagtgaagctaaagaggggctgaagaggggagagactaccaaacacgccgtcagccggggcacagccaagttgcgctggtttgtggaacgaaacctggtaaaacctgagggtaaggtgatagatctcggctgtgggagaggaggctgggcgtactattgcgctgggttaaagaaagttactgaagtgaagggatacaccaaaggcggtcccgggcacgaggaaccgatcccaatggcaacatacggatggaatctggtcaaacttcattctggcaaagacgtgttctttattcctcccgagaagtgtgatacgctgctatgcgacatcggcgagtcctcaccaaaccccaccattgaagaggggaggactctccgggtcctgaaaatggtggaaccttggttgcgcggaaatcaattctgtatcaagattctgaacccgtatatgcccagcgttgtagagacactcgagcagatgcagagaaagcacggtggcatgcttgtgaggaatccactgtcgcgaaactctacccatgaaatgtactgggtcagttgcgggactggaaatatcgtgtccgccgttaacatgacaagccggatgttactgaatcgttttaccatggctcacagaaaacctacgtatgagcgcgatgtggacttgggcgccggtaccaggcacgtcgcagtggaacccgaggtagccaacctcgatataattgggcagcggatcgaaaacatcaagcatgagcacaaatcaacatggcattacgacgaggataatccttataagacttgggcttaccacggatcctatgaagtgaaaccatctggcagcgcgagttccatggttaacggcgtcgtgaagctgctaaccaagccctgggacgtgattcctatggtcacacaaatagccatgactgataccacaccattcgggcagcagagagtttttaaagagaaggtggacacccgcactcccaaagcaaagaggggaacggctcaaatcatggaagtaacagccaaatggctttggggtttcctgagccgaaataagaagccgcggatttgtaccagagaggaatttactaggaaagtgcgctctaacgcagccatcggcgctgtcttcgtggacgagaatcagtggaactcagccaaggaggcggttgaagatgagcgtttttgggacctcgtgcatcgggaaagagagctgcacaaacaggggaagtgcgcaacctgcgtctacaatatgatgggaaaaagggaaaagaagttgggcgagttcggtaaagccaaggggagtcgcgctatttggtacatgtggctgggagcccgatttctcgagttcgaagcacttggcttcatgaacgaggatcactggttttcccgggaaaatagcctgtctggcgtggagggggagggattacataaactgggttatatcttgagagacatatcgaagatccctggcgggaacatgtacgctgatgacacagccggatgggatacgaggattaccgaagacgatctccagaatgaggctcgcatcactgacattatggaaccagagcacgccctgctagcaagatcaatcttcaaacttacatatcaaaacaaggtagttcgggtgcagaggcccgcgaaaaatggcaccgtcatggatgtgataagccgtcgagaccagcgcggttccggacaggtgggaacttacggcctgaacacatttaccaatatggaagcccaactcattagacagatggagagtgagggcatcttctctcctagcgaactggagacaccaaacttggctgaacgggtcttagattggctggagaagtatggggttgaaaggctcaagcgcatggccatctccggagacgactgtgtggtaaaacccattgatgacagatttgcaactgctcttaccgccctgaacgatatgggtaaggtgcggaaagacataccgcagtgggagccttcaaagggctggaatgattggcagcaagtccccttctgcagtcatcactttcaccagctaatcatgaaagacgggagggagattgtggttccatgtcgaaaccaggatgaactggtgggacgtgcaagagtctctcagggcgccggttggagcctccgcgagacggcgtgcttggggaagtcctacgctcaaatgtggcagctgatgtatttccatcggagggaccttagactggccgcaaatgccatctgttcagctgtgcctgtagattggattcccaccagccgcacaacttggtctatccacgcccatcaccagtggatgaccacagaagacatgctctccgtttggaaccgggtgtggatagaggaaaatccatggatggaggataagactcatatcagtagctggggagacgtcccctacttaggcaaaagggaggaccaatggtgcggctcgctgattgggttgaccgcacgagctacgtgggccacaaacatccaggtggcgattaatcaggttagacggctgatcggaaacgaaaattacctcgattatatgacctccatgaagaggtttaaaaacgagtctgaccctgaaggtgctctttggtga

SEQ ID NO: 14091 - RNA, 9879 nt, synthetic construct
  misc_feature 1..9879: note = derived and/or modified CDS sequence (opt3) from DENV-1__JQ045639__SS-prME
  source 1..9879: mol_type = other RNA
agcgtgaccatgttcctgatgctcatgcccacagcccttgcttttcacctgactacgagaggaggggaacctcatatgatcgtctccaagcaggaaaggggaaaatctttgttattcaagacctcagccggtgttaatatgtgcacactgattgccatggacctaggcgaactctgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctctggcaccccatgtcggccttggtctggagaccagaacagaaacttggatgtcctctgagggggcatggaaacagatccagagggtggaaacctgggccttgcggcaccctggatttacagttattgctctcttcctggcacatgccatcggcacctcgattacgcagaagggcatcatatttatcctgctcatgttagtgactccatcaatggctatgcgctgcgtcgggattggaagcagagatttcgtggagggtctgagtggcgccacatgggtagacgttgtgcttgagcacgggtcctgtgtcaccactatggcgaaggataaacccacattggacatcgaactgctaaagaccgaggtgacgaaccctgcagtgctcaggaaactgtgcattgaagccaagatctctaataccacaactgatagccggtgtccaacccaaggagaggctacacttgtcgaagaacaggacgccaactttgtttgccgccgaactttcgtggatagaggctggggtaatgggtgtggactgtttggcaaaggctccttgataacctgcgcaaagttcaagtgcgtaacaaaactcgaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagttaactgactacggggcgctgacactcgattgtagcccaaggacgggacttgactttaacgaaatggtcctgttgaccatgaaggagaaatcttggctagtgcataagcagtggttcctggatctcccgctgccctggacttccggcgcctcaacaagccaagagacctggaatcggcaggaccttctggtaacatttaaaactgcacacgctaagaagcaggaagttgtggtcttgggtagtcaagagggggccatgcacaccgctctcacgggcgccaccgaaatccagacatctggaactaccacaattttcgcaggccatctgaaatgccgtttaaagatggataaactgactctaaaggggatgtcctatgtgatgtgtaccgggtcgttcaaactcgagaaggaactggccgagacgcagcacggtacagtccttgtgcagataaagtacgagggcaccgacgctccttgcaaaatcccattttcgactcaagatgaaaagggggttacacagaacggacgcttgattaccgcgaatcccatcgtgactgacaaagagaagcctgtaaacatagaagcagagccacccttcggcgagtcttatattgtcatcggtgccggggaaaaagctctgaagctctcctggtttaagaaaggctcaagtatcggaaagatgttcgaggccaccgcaagaggcgccaggcggatggctattctgggggatacagcctgggactttggaagcatcggtggcgtgttcacgtccgttgggaaacttgtgcatcagatttttggaaccgcatacggcgtcctgttctctggtgtgagctggactatgaagatagggatcggcgtattgctcacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatctttgtcaccaatgaggttcacacgtggacagaacaatataagttccaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagtttactgtggtagtcggcgatgtggcagggattctggctcagggcaagaagatgatccgccctcaacccatggagtacaaatattcgtggaaaagctggggcaaggccaagataatcggggcggacgttcagaataccacattcattatcgatggaccaaacactcctgaatgtcccgacgatcagagagcctggaatatttgggaggtggaggactacggctttggtatcttcaccacaaacatatggcttaagttgagggattcctatacgcaggtctgcgaccaccgtctcatgtcagctgcaattaaagatagtaaggccgtgcacgctgacatggggtactggatcgaatctgagaaaaatgaaacctggaagctggcccgggcatccttcattgaggttaagacttgtatctggccaaaatcccatacactatggtcaaacggagtgctggaaagcgagatgataatccccaagatttatggcggtcctatctctcaacacaattaccgaccaggctactttacccagactgcggggccgtggcatctcggaaaactggagcttgatttcgacttgtgcgaaggcacaaccgtagtcgtggatgagcactgcgggaacagaggaccctccctgaggacgactaccgtgacaggcaagattatccacgaatggtgttgccgcagttgtaccttacctccactccggtttagaggtgaggacgggtgctggtatggaatggagataaggcccgtcaaagaaaaggaggaaaatctggttaagagcatggtgtctgccggctccggtgaggtagactcattcagtcttggcctgttgtgtattagcatcatgatcgaagaggtgatgcgctcgcgatggtcccggaaaatgctcatgactgggacactggctgtctttttcctactgattatgggacagctcacctggaacgatctgatccgtctttgcattatggtgggcgccaatgcatctgacagaatggggatgggaacaacttacttggctctgatggccacctttaagatgaggcctatgttcgcagttggcttactctttcgccggctgacgagcagagaggtgcttctgctaacaataggtctctcactggtcgccagtgtggaattgccaaactccctggaggaattaggggatggactcgctatgggcatcatgattctgaaacttctgaccgacttccaatctcatcagttgtgggcgactctcctgagcctaacctttatcaagacaactttctccctgcactatgcctggaaaaccatggcaatggttctttcaattgtgagcctctttcccctgtgtttgagtacgacatctcagaagaccacttggctgccggtcttactcggctccctggggtgcaagcctcttacaatgttcctgatcgctgagaataaaatatggggaaggcgaagctggccattgaacgaaggtatcatggccgtaggcattgtgtcgatcctcctgtcatctctactgaagaacgatgttccccttgccgggcctctcattgctggaggcatgctgatcgcatgttacgtgataagtggttccagcgccgacttgtctttagagaaagcggctgaggtcagctgggaagaggaagccgagcattccggggcatcacacaatattctggtggaagtacaggatgacggaaccatgaagatcaaagatgaggagcgcgacgatactctcacaatcctgcttaaggccaccctgttggctgtgagtggcgtctatcccctaagcattccagcaacgctgttcgtttggcatttttggcagaaaaagaagcagcggtctggcgtgctctgggacactccttcacccccagaagtggagagagccgtcctggatgacgggatatacaggatcatgcagcgtggacttttaggtcgcagccaggtgggcgttggggtattccaagaaaacgtgtttcacaccatgtggcacgtcacacggggagcggtgctgatgtatcagggcaaaagactcgagccgagttgggctagcgttaagaaagacttgatttcctacggtgggggatggaggctgcagggctcttggaataccggcgaggaagtgcaggtcatcgccgtggagcctgggaagaaccccaaaaatgtacaaacagcaccaggaactttcaagacccccgaaggtgaggtcggcgccattgctctcgattttaagcctgggacgtcgggaagcccaatcgtgaaccgagaaggcaaaatagttggtctgtacgggaatggagtggtcacaacttcaggcacctatgtgtccgccatcgcacaggctcgggccagtcaggagggcccccttcctgagattgaagacgaggttttccgcaagagaaacctgacaatcatggatttgcatccggggtctggaaaaaccaggcggtacctaccagcgattgtgcgagaagccatcaagagaaaactgcgcactctcatattagcacccaccagggtcgtggctagcgagatggccgaagctctgaagggtatgcctattcgttatcaaacaacggcagtaaagtccgagcacactggcaaagagatcgtggaccttatgtgccatgccacctttacaatgcggctgctctcaccagttagagtccccaattacaacatgatcattatggatgaagcccacttcaccgacccttctagcatcgctgcgagggggtatataagtactcgcgtgggaatgggcgaggcagccgctatttttatgacagccaccccgcccggttccgtggaagcattcccacagagcaatgccgtcatccaggatgaggaacgagacattcctgagagatcttggaactcagggtacgagtggatcacggattttcccggaaagactgtatggttcgtgccatccataaaaagtggcaatgacattgctaactgtttgcggaagaatggcaaaagggttatccagctgagccgcaagacattcgataccgaatatcaaaagaccaaaaacaacgactgggactacgtggtcactacagatatctcggagatgggggcgaattttcgtgccgacagagtgattgatcctcggaggtgcctcaagcccgttatcctgaaagacggaccagaacgcgtgattcttgcaggtccgatgcctgtcaccgtggcttctgccgcacagcgaagaggccggatagggaggaaccataataaggagggagatcagtacatctatatgggccagcccctaaacaatgacgaggatcacgcccactggacagaagctaaaatgctgttggacaacattaatactccagagggtatcatccccgccttattcgaacctgagcgcgaaaagtccgcggcaattgatggggagtacagactgaggggcgaggcccggaagacgtttgtagaactcatgcgtcgcggagacctgccagtgtggcttagctataaagttgcttcagagggcttccaatacagtgatcgaagatggtgctttgacggggaaaggaacaatcaggtcctggaggaaaacatggatgtggagatatggaccaaggagggagaacggaaaaagctccgccccagatggttggacgccaggacatattctgaccctctggctctacgggagttcaaagaatttgcagccggtcgaagatccgtgagcggcgatctgatcctcgagattgggaaacttccgcagcatctgactcagcgcgctcaaaatgccttagacaacttggtcatgctgcacaattcagaacagggaggcagggcataccggcatgcgatggaggagctcccagataccatcgaaacactgatgcttctggccctcattgctgttttgaccggtggggtgactctgttctttttaagtggccgtggactaggcaaaacgagcatcgggctgctctgtgtaatggcctcctctgcacttctgtggatggctagcgtggagccccactggatagccgcatccatcattttggagttctttctgatggtcctcctgatccctgagcccgacagacagaggaccccacaggataaccaacttgcctatgtggttattggactcctgttcatgatcttgacagtggctgcgaatgagatgggtctgttagaaactaccaagaaggacctaggcatagggcacgccgcagtcgagaaccatcaccatgctgccatgctggatgtagacctccaccctgcctcagcatggacactttacgctgtggccaccactattatcacacccatgatgcgccatacgattgaaaacaccactgcgaatatctctctgacagctatagccaaccaggcagccatcttgatgggactggataaaggctggccaattagtaagatggacatcggtgttcctctcctggctcttgggtgctacagccaggtgaatccgttaaccctgaccgcagccgtcctcatgttggtggcgcactatgctattatcggccccggactgcaagccaaagcaacacgggaggcccagaagcgaactgctgccggcataatgaaaaacccaacggtcgatgggattgtggcaatcgacctagatcctgttgtgtacgacgctaagtttgaaaagcagctgggacagatcatgctccttattctgtgtaccagccaaatcttgctgatgagaacaacttgggccctctgcgagtccataaccctggcgacaggccccttaaccactctttgggagggttctccagggaaattctggaatacgacaattgccgtatcaatggcaaacatcttcaggggaagctatctggctggcgccggtctcgcattttccctaatgaagagtctgggcgggggacgccggggcaccggggctcagggagaaactttgggcgagaaatggaagagacagctgaatcagctctctaaaagcgagttcaacacctacaagcgttcaggtattatggaggtggacaggtccgaagccaaggaggggcttaaacggggagagacaactaagcacgccgtcagtcgcggcaccgcgaaactgcgatggtttgttgaaagaaatttggtgaagcctgagggtaaagtcatcgatctgggctgtgggaggggaggctggagctattactgcgctgggctcaagaaggtgacagaagtaaaaggatatacgaagggcggtcccgggcatgaggaaccgataccaatggcaacctacggatggaacttagtgaaactgcactctggcaaggacgttttctttatccctcccgagaaatgtgatactcttctgtgcgacattggcgagtcctcaccaaatcccacaatcgaagaggggcggaccctacgcgtgctcaagatggtcgaaccttggctgagaggaaaccaattctgtattaaaatcttgaatccgtacatgcccagcgtggtcgagactctggagcagatgcagaggaagcatggtggcatgctcgtgcgaaacccactttcgagaaattctacacacgaaatgtattgggttagttgcgggaccggaaacattgtatccgccgtgaatatgacgagccgtatgctgttaaacagatttaccatggctcaccgcaagcctacatacgagagggatgtcgacctgggcgccggtactcggcatgtggcagttgaacccgaggtggccaacttggatatcatagggcagagaattgaaaatatcaaacacgagcataagtcaacctggcactatgacgaggataacccttacaaaacatgggcttatcatggatcctacgaagtcaagccatctggcagcgcgagttccatggtgaatggcgtagtgaaactcctgactaagccctgggacgttatccctatggtcacccaaattgccatgacagataccactccattcgggcagcagcgcgtgtttaaggagaaagtggacacgaggacacccaaggcaaaacgaggaaccgctcaaataatggaagtcactgccaagtggctatggggtttccttagccggaacaaaaagccgagaatctgtaccagggaggaatttacacgcaaggttcgttctaatgcagccattggcgctgtgttcgtagacgagaaccagtggaactcagccaaagaggcggtggaagatgagcggttttgggacctggtccacagagaaagggagctccacaagcaggggcgctgcgcaacgtgcgtgtataacatgatgggaaaacgagaaaagaaactgggcgagttcggtaaggccaaggggagtcgggctatctggtacatgtggttgggagccagattcctggagtttgaagcactcggcttcatgaatgaggatcattggttttccagggaaaacagcctttctggcgttgagggggagggactgcacaaattaggttacattctgcgcgacatctcgaagatacctggcgggaatatgtatgctgatgacaccgccggatgggatactagaatcacagaagacgatttgcagaacgaggctcggattaccgacatcatggaaccagagcatgccctcctggcaaaatcaattttcaagctaacttaccaaaataaagtggtcagggtgcagcgtcccgcgaagaacggcacagtaatggatgttatcagccgacgcgaccagagaggttccggacaggtgggaacctatggccttaatacatttactaacatggaagcccaactgatacggcagatggagagtgagggcattttctctcctagcgaactcgagaccccaaacctggctgaaagggtcttggattggttagagaaatacggggtggaacgcctgaagagaatggccatctccggagacgactgtgtggtcaagcccatcgatgaccggtttgcaacggctctcaccgcccttaatgatatgggtaaagttaggaaggacattccgcagtgggagccttcaaaaggctggaacgattggcagcaagtgcccttctgcagtcaccactttcatcagctgataatgaaggacgggcgagagatcgtagtgccatgtcgtaatcaggatgagctagtcggacgggcacgcgtgtctcagggcgccggttggagcctgcgggagacagcgtgcctcgggaaatcctatgctcaaatgtggcagttgatgtacttccacaggagagacctgcgccttgccgcaaacgccatttgttcagctgttcctgtggattggatccccactagccggaccacatggtctattcatgcccaccatcagtggatgactaccgaagacatgctgtccgtctggaatagggtgtggatcgaggaaaacccatggatggaggataagacgcacataagtagctgggaggacgtaccctatctcggaaagcgagaagaccaatggtgcggctcgttaatcggcctgacagcaagagctacctgggccactaatattcaggttgcgatcaaccaggtgcggaggttgattgggaatgagaactacctggattacatgacatccatgaaacgctttaagaatgaatctgaccctgagggagctctctggtga

SEQ ID NO: 14092 - RNA, 9879 nt, synthetic construct
  misc_feature 1..9879: note = derived and/or modified CDS sequence (opt3) from DENV-1__JQ045641__SS-prME
  source 1..9879: mol_type = other RNA
tccgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttgcgcagaacggacgcctgattacagcaaatcccatcgtgaccgacaaagagaagcctgtaaacatagaagccgagccaccctttggcgagtcttatattgtcatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtgtttacatccgttgggaaactggtgcatcagattttcggaacggcgtacggcgtcttgttttctggtgtgagctggaccatgaagatagggatcggcgtactcctgacttggttaggactaaattcacgaagtacatccctaagcatgacctgtattgctgtgggcctcgttacactgtaccttggggtcatggtgcaggccgattctggatgcgtgatcaactggaaaggccgcgaattgaagtgtggttcagggatcttcgtcactaatgaggttcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtggtagtcggcgatgtggctgggattcttgcccagggcaaaaagatgatccgccctcaacccatggagtacaaatattcgtggaaaagctggggcaaggcgaagataatcggggccgacgttcagaatactacctttattatcgatggaccaaacacacctgaatgtcccgacgatcagagagcttggaatatttgggaggtggaggactacggcttcggtatctttactaccaacatatggttgaagctcagggattcctatacacaggtctgcgaccaccgtctgatgtcagcagccattaaagatagtaaggctgtgcacgccgacatggggtactggatcgaatctgagaaaaatgaaacgtggaagctagcacgggcgagcttcattgaggttaagacctgtatctggccaaaatcccatactctgtggtcaaacggagtgctcgaaagcgagatgataatccccaagatttatggcggtcctatctctcaacacaattaccgaccaggctacttcacacagaccgccgggccgtggcatctgggaaaacttgagttggattttgacctgtgcgaaggcactacagtagtcgtggatgagcactgcgggaacagaggaccctccttaaggaccacgactgtgaccggcaagattatccacgaatggtgttgccgcagttgtacactccctccactgcggttcagaggtgaggacgggtgctggtatggaatggagataaggcccgtcaaagaaaaggaggaaaatcttgttaagagcatggtgtctgctggctccggtgaggtagactcatttagtctgggcttgctctgtattagcatcatgatcgaagaggtgatgcgctcgcgatggtcccggaaaatgctgatgaccgggactctagccgtcttctttctgctcattatgggacagctgacatggaacgatcttatccgtttgtgcattatggtgggcgcaaatgcttctgacagaatggggatgggaaccacatacctggccttaatggcaactttcaagatgaggcctatgtttgccgttggcctcctgttccgccggcttaccagcagagaggtgctgctactcacgataggtctgtcattggtcgctagtgtggaactgccaaactccttagaggaactcggggatggactggcgatgggcatcatgattcttaaactgttgacagactttcaatctcatcagctctgggccaccctgctaagcctgactttcatcaagaccacactttccctccactatgcatggaaaactatggctatggttctgtcaattgtgagcttgtttcccctgtgtttaagtaccacgtctcagaagacaacctggctcccggtcctgcttggctccctggggtgcaagcctttgactatgttcctcatcgccgagaataaaatatggggaaggcgaagctggccactgaacgaaggtatcatggccgtaggcattgtgtcgatcctactgtcatctcttctcaagaacgatgttcccctggctgggcctttgattgcaggaggcatgttaatcgcctgttacgtgataagtggttccagcgcggacctgtctctcgagaaagctgccgaggtcagctgggaagaggaagcagagcattccggggcctcacacaatattctggtggaagtacaggatgacggaacaatgaagatcaaagatgaggagcgcgacgatacccttactatcctgttgaaggctacactactggcagtgagtggcgtctatcccctcagcattccagccaccctgtttgtttggtacttctggcagaaaaagaagcagcggtctggcgtgctttgggacacgccttcacccccagaagtggagagagcggtcttagatgacgggatatataggatcatgcagcgtggactgctcggtcgcagccaggtgggcgttggggtattccaagaaaacgtgtttcatactatgtggcacgtcacccggggagctgtgttgatgtaccagggcaaaagactggagccgagttgggccagcgttaagaaagacctcatttcctacggtgggggatggaggctgcagggctcttggaatacaggcgaggaagtgcaggtcatcgcagtggagcctgggaagaaccccaaaaatgtacaaaccgccccaggaacattcaagactcccgaaggtgaggtcggcgctattgcccttgattttaagcctgggacctcgggaagcccaatcgtgaaccgagaaggcaaaatagttggtctgtatgggaatggagtggtcacgacatcaggcacttacgtgtccgcaatcgctcaggccaaggcgagtcaggagggccccttgcctgagattgaagacgaggttttccggaaacgcaacctaaccatcatggatctgcacccggggtctggaaagacaagaaggtatctcccagccattgtgcgggaagcaatcaaacgaaagttaagaaccctgatacttgctcccactcgcgtcgtggccagcgagatggctgaagcactgaagggtatgcctattaggtaccaaaccacagccgtaaaatccgagcatacgggcaaggagatcgtggacctcatgtgccacactacctttacaatgcgtttgctgtcaccagttcgggtccccaattataacatgatcattatggatgaagcccatttcaccgacccttctagcatcgctgcgagagggtacataagtactagggtgggaatgggcgaggcagccgctatttttatgacagccaccccgcccggttccgtggaagcattcccacagagcaatgccgtcatccaggatgaggaacgcgacattcctgagcgatcttggaactcagggtatgagtggatcacggattttcccggaaaaactgtatggttcgtgccatccataaagagtggcaatgacattgctaactgtctcaggaaaaatggcaagcgggttatccagctgagcaggaagacatttgataccgaataccagaaaaccaagaacaacgactgggactacgtggtcactacagatatctcggagatgggggcgaatttccgcgccgaccgtgtgattgatcctagacggtgccttaaacccgttatcctaaaggacggaccagaaagggtgattctggcaggtccgatgcctgtcaccgtggcttctgccgcacagcgccgaggcagaatagggcggaaccacaataaagagggagatcagtatatctacatgggccagcccttgaacaatgacgaggatcatgcccactggacagaagctaagatgttactggacaacattaatactccagagggtatcatccccgccctcttcgaacctgagagggaaaagtccgcggcaattgatggggagtatcgcctgagaggcgaggccaggaaaacgtttgtagaacttatgcggcgtggagacctgccagtgtggctcagctacaaggttgcttcagagggcttccaatatagtgatcgccgatggtgctttgacggggaaagaaacaatcaggtcttggaggaaaacatggatgtggagatatggaccaaagagggagaaaggaagaaactgcggccccgctggctagacgccagaacatactctgaccctctggctctcagggagttcaaggaatttgcagccggtcggcgatccgtgagcggcgatcttatcctggagattgggaaattaccgcagcacttgactcagagagctcaaaatgccctggacaacctcgtcatgctgcataattcagaacagggaggccgcgcatataggcacgcgatggaggagcttccagataccatcgaaacactgatgctcttggccctgattgctgttttaaccggtggggtgactctattctttctgagtggccggggactcggcaagacgagcatcgggcttctgtgtgtaatggcctcctctgtgttgctgtggatggcaagcgtcgagccccattggatagctgcctccatcattctcgagttctttctgatggtgcttctcatccctgagcccgaccgtcagagaaccccacaggataaccaactggcatacgttgtgattggattgctgttcatgatcttaacagtcgccgctaatgagatgggtctactggaaactaccaagaaagacctcggcatagggcacgtagcggtggagaaccaccatcacgccgcaatgcttgatgttgacctgcatcctgcttcagcctggacattgtacgccgtggcaaccactattatcacacccatgatgaggcacacgattgaaaacaccactgctaatatctctctgacagccatagcgaaccaggctgccatcctcatgggactggataagggctggccaattagtaaaatggacatcggtgtccctcttttagcactggggtgctatagccaggtgaatccgctcaccttgaccgccgctgtcctgatgctagtggcacattacgccattatcggccccggactgcaagcgaaggctacacgcgaggcccagaaacggactgcagccggcataatgaagaacccaacggttgatgggattgtggctatcgacctcgatcctgtagtgtatgacgccaagtttgaaaaacagcttggacagatcatgctgttgattctgtgtaccagccaaatcctcctgatgcgaacaacttgggcattatgcgagtccataacccttgctacaggccccctgaccactctctgggagggttctccagggaagttctggaatacgacaattgccgtctcaatggcgaacatctttagaggaagctacctagccggcgcaggtctggctttctccttgatgaaaagtctgggcgggggaaggcgcggcaccggggcccagggagaaactctcggcgagaagtggaaacggcagcttaatcagctgtctaagagcgagttcaacacctataagagatcaggtattatggaggttgaccgttccgaagcaaaagaggggttgaagaggggagagacaactaaacacgctgtgagtcggggcaccgccaagctgcgctggtttgtcgaacgaaatctcgtgaaacctgagggtaaggtaatcgatttaggctgtgggagaggaggctggagctactattgcgccgggctgaagaaagtgacagaagttaagggatacacgaaaggcggtcccgggcacgaggaaccgataccaatggcgacctacggatggaaccttgtgaagctgcattctggcaaagacgtcttctttatccctcccgagaagtgtgatactctactctgcgacattggcgagtcctcaccaaatcccacaatcgaagaggggaggaccctgcgggtgttgaaaatggtcgaaccttggctgcgcggaaaccaattctgtattaagatcctcaatccgtatatgcccagcgtggttgagactcttgagcagatgcagagaaagcacggtggcatgctggtaaggaacccattatcgcgaaattctacacatgaaatgtactgggtgagttgcgggaccggaaacattgtctccgctgtgaatatgacgagccggatgctgttgaaccgttttaccatggcacacagaaaacctacatatgagcgcgatgttgacctcggcgccggtactaggcacgtggctgtcgaacccgaggtggccaacctggatatcatagggcagcggattgaaaatatcaagcatgagcacaaatcaacctggcattacgacgaggataacccttataagacatgggcataccacggatcctatgaagtaaaaccatctggcagcgccagttccatggtgaatggcgttgtcaagctacttactaagccctgggacgtgatccctatggtgacccaaattgctatgacagataccactccattcgggcagcagagagtctttaaagagaaggttgacacgcgcacacccaaagcgaagaggggaaccgcccaaataatggaagtgactgcaaaatggctgtggggtttcctcagccgaaacaagaagccgcggatctgtaccagagaggaatttacaaggaaagtacgctctaatgctgccattggcgcagtgttcgtcgacgagaaccagtggaactcagccaaggaggctgtggaagatgagcgtttttgggacctggttcatcgggaaagagagttgcacaaacaggggaagtgcgccacgtgcgtgtacaacatgatgggaaaaagggaaaagaagctgggcgagttcggtaaagcgaaggggagtcgcgcaatctggtacatgtggctcggagcccgatttcttgagttcgaagctctgggcttcatgaatgaggatcactggttttcccgggaaaacagcttatctggcgtcgagggggagggactgcataaattgggttatattctcagagacatctcgaagatacctggcgggaatatgtacgccgatgacaccgcaggatgggatactaggatcacagaagacgatctgcagaacgaggctcgcattaccgacatcatggaaccagagcacgccctacttgctaaatcaattttcaagctgacttatcaaaataaagtggtaagagttcagcggcccgccaagaacggcacagtgatggatgtcatcagcaggcgtgaccagcgaggttccggacaggtgggaacctacggcctcaatacatttactaacatggaagcacaactgatacgccagatggagagtgagggcattttctctcctagcgaattggagaccccaaacttagcggaaagagtgctggattggctcgagaagtatggggtcgaacggcttaaaaggatggccatctccggagacgactgtgttgtgaagcccatcgatgaccgctttgctacggccctgaccgcactaaatgatatgggtaaagtaagaaaggacattccgcagtgggagccttcaaaaggctggaacgattggcagcaagtgcccttctgcagtcatcactttcaccagctgataatgaaggacgggcgggagatcgtcgtgccatgtaggaatcaggatgaactcgttggacgagctcgtgtgtctcagggcgccggttggagcttgagagagacagcatgcctggggaagtcctacgcccaaatgtggcagcttatgtatttccatcgccgggacctgaggctcgcggctaacgccatttgttcagcagtccctgtggattggatccccactagcagaaccacatggtctattcacgcccatcaccagtggatgactaccgaagacatgttatccgtatggaatcgcgtttggatcgaggaaaacccatggatggaggataaaacgcatataagtagctggggagacgtgccctacctgggcaagcgggaggaccaatggtgcggctcgttgatcgggctgacagctagggccacctgggcaactaatattcaggtcgctatcaaccaggtgcgaagactcattggaaatgaaaactaccttgattatatgacatccatgaaacggtttaagaatgagtctgaccctgaaggtgccctgtggtga

SEQ ID NO: 14093 - RNA, 9879 nt, synthetic construct
  misc_feature 1..9879: note = derived and/or modified CDS sequence (opt3) from DENV-1__JQ045642__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtgtgaaaacttaaaatactcagtcatcgtgaccgttcacactggagaccagcatcaagtgggtaatgagagtacggaacacggcacaaccgctactattacaccccaagcccctaccaccgagatccagctgactgactatggggcgctcacacttgattgcagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgtcgtctgaagatggataaactaactctcaaggggatgtcctacgtgatgtgcaccggtagcttcaaactggagaaggaagtcgccgagacgcagcacggaacagtgcttgttcagataaagtatgagggcaccgacgctccttgtaaaatcccattctcgactcaagatgaaaagggggtgacacagaacggacgcttgattaccgcgaatcccatcgtaactgacaaagagaagcctgtcaacatagaagcagagccaccctttggcgagtcttacattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatatggcgtgctgttttctggtgtaagctggactatgaagatagggatcggcgtgttgctcacatggctgggattaaattcacgaagtacctccctgagcatgacatgcattgcggttggcctagtcactctctacctgggggtgatggtgcaggctgattctggatgtgtcatcaactggaaaggccgcgaacttaagtgcggttcagggatcttcgttaccaatgaggtgcacacgtggacagaacaatacaagtttcaggccgacagtccgaaaagattgagcgcagccattggaaaggcttgggaggagggcgtgtgtggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtataaatactcgtggaaaagctggggcaaggccaagataatcggggcggacgtgcagaataccacatttattatcgatggaccaaacactcctgaatgccccgacgatcagagagcctggaatatttgggaggtcgaggactatggcttcggtatctttaccacaaacatatggcttaagttgagggattcctacacacaggtgtgtgaccaccgtctcatgtcagctgcaattaaagatagtaaggccgttcacgctgacatggggtattggatcgaatctgagaaaaatgaaacctggaagctggcccgggcatccttcattgaggtgaagacttgcatctggccaaaatcccatacactatggtcaaacggagtactggaaagcgagatgataatccccaagatttacggcggtcctatctctcaacacaattatcgaccaggctacttcacccagactgcggggccgtggcatctcggaaaactggagcttgattttgacttgtgcgaaggcacaaccgtcgtggtggatgagcactgtgggaacagaggaccctccctgaggacgactaccgtcacaggcaagattatccacgaatggtgctgtcgcagttgcaccttacctccactccggttcagaggtgaggacgggtgttggtacggaatggagataaggcccgttaaagaaaaggaggaaaatctggtaaagagcatggtatctgccggctccggtgaggtggactcatttagtcttggcctgttgtgcattagcatcatgatcgaagaggtcatgcgctcgcgatggtcccggaaaatgctcatgactgggacactggctgtgttctttctactgattatgggacagctcacctggaacgatctgatccgtctttgtattatggttggcgccaatgcatctgacagaatggggatgggaacaacttatttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactacgcctggaaaaccatggcaatggtgctttcaattgtcagcctcttccccctgtgcttgagtacgacatctcagaagaccacttggctgccggtattactcggctccctggggtgtaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgctatgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttaccccctaagcattccagcaacgctgttcgtgtggtatttctggcagaaaaagaagcagcggtctggcgtgctctgggacactccttcacccccagaagtcgggagagccgtgctggatgacggaatatacaggatcatgcagcgtggtcttttaggccgcagccaggttggggtaggagtgtttcaagagaacgtcttccataccatgtggcacgtgacacggggcgcggttctgatgtatcagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtacggaaatggcgtcgtgacaacttcaggcacctatgtttccgccatcgcacaggctaaggccagtcaggaagggccccttcctgagattgaggacgaagtgtttcggaaacgcaacctgacaatcatggatttgcacccgggatctggtaagaccagaaggtacctaccagcgattgtccgggaggccatcaaacgaaagctgagaactctcatattagcacccacccgcgtggtagctagcgaaatggccgaggctctgaagggcatgcctattaggtatcaaacaacggcagtgaaatccgaacatactgggaaggagatcgttgaccttatgtgtcacgccaccttcacaatgcgtctgctctcaccagtccgggtgcccaattacaacatgatcattatggatgaggcccattttaccgacccttctagcatcgctgcgagaggatatataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatacgagtggatcacggatttccccggcaaaactgtgtggtttgttccatccataaagagtggcaatgacattgctaactgcttgaggaaaaatgggaagcgggtgatccagctgagcaggaagacattcgataccgagtatcagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtacatctatatgggtcagcccctaaacaatgacgaggatcatgcccactggacagaggctaagatgctgttggacaacattaatactccagaagggatcatccccgccttatttgagcctgaaagggagaagtccgcggcaattgatggcgaataccgcctgagaggagaggccaggaaaacgttcgtggagctcatgcggcgtggcgacctgccagtttggcttagctataaggtcgcttcagaagggtttcaatacagtgatcgccgatggtgtttcgacggagagagaaacaatcaggtgctggaagagaacatggatgtggaaatatggaccaaagagggtgagaggaagaaactccggccccgctggttggacgccagaacatattctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatacaggcacgcgatggaggaactcccagataccatcgagacactgatgcttctggccctcattgctgtgttgaccgggggcgtaactctgtttttcttaagtggacggggcctagggaagacgagcatcggactgctctgcgtgatggcctcctctgtccttctgtggatggcaagcgtggaaccccattggatagctgcctccatcattttggagtttttcctgatggttctcctgatccctgaacccgaccgtcagagaaccccacaggataaccaacttgcatatgtggtcattggtctcctgtttatgatcttgacagtagccgctaatgagatgggcctgttagagactaccaagaaagacctagggataggacacgtggcggttgaaaaccaccatcacgccgcaatgctggatgtggacctccatcctgcttcagcctggacactttacgccgtcgcaaccactattatcacacccatgatgaggcacacgattgagaacaccactgctaatatctctctgacagccatagcgaaccaggctgccatcttgatgggcctggataagggttggccaattagtaaaatggacatcggggtgcctctcctggcacttggctgttactcgcaggtcaatccgttaaccctgaccgccgctgtgctcatgttggttgcacattatgccattatcggacccggcctgcaagcgaaggctacacgcgaagcccagaaacggactgcagccgggataatgaagaacccaacggtggatggaattgtagctatcgacctagatcctgtggtctacgacgccaagttcgagaaacagctgggccagatcatgctccttattctgtgcaccagccaaatcttgctgatgcgaacaacttgggcactctgtgaatccataaccctggctacaggtcccttaaccactctttgggaggggtctccaggaaagttttggaatacgacaattgccgtttcaatggcgaacatcttcagaggcagctatctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctacaagagatcagggattatggaagtggaccgttccgaggcaaaagaaggacttaagaggggcgagacaactaaacacgctgtcagtcggggtaccgccaagctgcgctggttcgtggagcgaaatttggtaaaacctgaaggcaaggtgatcgatctggggtgcggaagaggcgggtggagctattactgtgccggactcaagaaagttacagaggtgaagggctatacgaaaggtgggcccggacacgaggagccgataccaatggcgacctacggctggaacttagtcaagctgcattctggcaaagacgtgtttttcatccctcccgaaaagtgcgatactcttctgtgtgacattggggagtcctcaccaaatcccacaatcgaggaaggaaggaccctacgggtcctcaaaatggtggagccttggctgcgcggtaaccaattttgcattaagatcttgaatccgtacatgcccagcgttgtagaaactctggagcagatgcagagaaagcacggcgggatgctcgtgaggaacccactttcgcgaaattctacacatgagatgtattgggtcagttgtggaaccggcaacattgtgtccgctgttaatatgacgagccggatgctgttaaaccgtttcaccatggcacacagaaaacctacatacgaacgcgatgtggacctgggtgccgggactaggcacgtcgctgtggagcccgaagtagccaacttggatatcataggacagcggattgagaatatcaagcatgaacacaaatcaacctggcattatgacgaggataacccttacaagacatgggcatatcacggctcctacgaggtgaaaccatctggcagcgccagttccatggttaatggggtcgtgaagctcctgactaagccctgggacgtgatccctatggtcacccaaattgctatgacagataccactccatttggacagcagagagttttcaaagaaaaggtggacacgcgcacacccaaagcgaagaggggtaccgcccaaataatggaggtaactgcaaaatggctatggggctttcttagccgaaacaagaagccgcggatctgcaccagagaagagttcacaaggaaagtgcgctctaatgctgccattggggcagtctttgtggacgaaaaccagtggaactcagccaaggaggctgttgaggatgaacgtttctgggacctggtgcatcgggagagagaactccacaaacagggaaagtgcgccacgtgtgtctataacatgatgggcaaaagggagaagaagctgggtgaatttgggaaagcgaagggaagtcgcgcaatctggtacatgtggttgggcgcccgattcctggagttcgaggctctcggctttatgaatgaagatcactggttctcccgggagaacagcctttctggggtggaaggagagggtctgcataaattaggctacattctgagagacatctcgaagatacctgggggaaatatgtatgccgatgacaccgcaggctgggatactaggatcacagaggacgatttgcagaacgaagctcgcattaccgacatcatggagccagaacacgccctcctggctaaatcaatttttaagctaacttaccaaaataaagtagttagagtgcagcggcccgccaagaacggtacagtcatggatgtgatcagcaggcgtgaccagcgagggtccggacaggtgggcacctatggccttaatacattcactaacatggaggcacaactgatacgccagatggaaagtgaggggatattttctcctagcgagctcgaaaccccaaacctggcggagagagtcttggattggttagaaaagtacggagttgagcggctgaaaaggatggccatctccggtgacgactgcgtggtaaagcccatcgatgaccgcttcgctacggccctcaccgcacttaatgatatgggcaaagtgagaaaggacattccgcagtgggaaccttcaaaagggtggaacgattggcagcaagtccccttttgtagtcatcacttccaccagctgataatgaaggacggacgggagatcgtggttccatgcaggaatcaggatgagctagtgggccgagctcgtgtctctcagggtgccgggtggagcctgagagaaacagcatgtctcggaaagtcctatgcccaaatgtggcagttgatgtactttcatcgccgggacctgaggcttgcggctaacgccatttgctcagcagtgcctgtagattggatccccactagcagaaccacatggtctattcacgcccatcaccagtggatgactaccgaggacatgctgtccgtttggaatcgcgtgtggatcgaagagaacccatggatggaagataaaacgcatataagtagctggggcgacgtcccctatctcggcaagcgggaggaccaatggtgtgggtcgttaatcggactgacagctagggccacctgggcaactaatattcaggtggctatcaaccaggttcgaagattgattggtaatgagaactacctggattacatgacatccatgaaacggttcaagaatgaatctgaccctgagggcgccctctggtga

SEQ ID NO: 14094 - RNA, 9879 nt, synthetic construct
  misc_feature 1..9879: note = derived and/or modified CDS sequence (opt3) from DENV-1__JQ045644__SS-prME
  source 1..9879: mol_type = other RNA
agcgtgaccatgctgctcatgcttatgcccacggcactggctttccacttgactacgagaggaggggaacctcatatgatcgtctccaagcaggaaagaggaaaatctttactgtttaagacctcagccggtgttaacatgtgcacactaattgccatggacctcggcgaactgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccgcattcaagatgaggcctatgtttgccgtgggcttactcttccgccggctgaccagcagagaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaagaccacattttccctgcactatgcatggaaaactatggctatggtgctttcaattgtcagcctcttccccctgtgtttgagtaccacgtctcagaagacaacctggctgccggtattactcggctccctggggtgcaagcctcttactatgtttctgatcgccgagaataaaatatggggaaggcgaagctggccattgaacgaaggtatcatggccgtgggcattgtttcgatcctcctgtcatctctactgaagaacgatgtgccccttgctgggcctctcattgcaggaggcatgctgatcgcctgttacgtcataagtggttccagcgcggacttgtctttagagaaagctgccgaggtgagctgggaagaggaagcagagcattccggggcctcacacaatattctggtagaagtgcaggatgacggaacaatgaagatcaaagatgaggagcgcgacgataccctcactatcctgcttaaggctacactgttggcagtcagtggcgtttatcccctaagcattccagccaccctgttcgtgtggtacttctggcagaaaaagaagcagcggtctggcgtgctctgggacacgccttcacccccagaagtcgagagagcggtgctggatgacgggatatataggatcatgcagcgtggacttttaggtcgcagccaggttggcgtaggggtgtttcaagaaaacgtcttccatactatgtggcacgtgacccggggagctgttctgatgtaccagggcaaaagactcgagccgagttgggccagcgtgaagaaagacttgatttcctacggtgggggatggaggctgcagggctcttggaatacaggcgaggaagtccaggtgatcgcagtagagcctgggaagaaccccaaaaatgtccaaaccgccccaggaacatttaagactcccgaaggtgaggtgggcgctattgccctcgatttcaagcctgggacctcgggaagcccaatcgttaaccgagaaggcaaaatagtgggtctgtatgggaatggagtcgtgacgacatcaggcacttacgtttccgcaatcgctcaggccaaggcgagtcaggagggcccccttcctgagattgaagacgaggtgtttcggaaacgcaacctgaccatcatggatttgcacccggggtctggaaagacaagaaggtatctaccagccattgtccgggaagcaatcaaacgaaagctgagaaccctcatattagctcccactcgcgtggtagccagcgagatggctgaagcactgaagggtatgcctattaggtaccaaaccacagccgtgaaatccgagcatacgggcaaggagatcgttgaccttatgtgccacgccactttcaccatgcgtctgctctcaccagtccgggtgcccaattataacatgatcattatggatgaagctcattttacagacccttctagcatcgcggcaagagggtacataagtaccagggtgggaatgggcgaggccgctgccattttcatgactgcaacaccgcccggttccgtcgaagcctttccacagagcaatgctgtaatccaggatgaggaacgcgacattcctgagcgatcttggaactcagggtatgagtggatcaccgatttccccggaaaaacggtgtggtttgttccatccataaagagtggcaatgacattgcgaactgtttgaggaaaaatggcaagcgggtgatccagctgagcaggaagactttcgatacagaataccagaaaaccaagaacaacgactgggactacgtcgtgaccactgatatctcggagatgggggccaatttccgcgcagaccgtgttattgatcctagacggtgcctcaaacccgtgatcctgaaggacggaccagaaagggtcattcttgctggtccgatgcctgtgacagtagcctctgcagcccagcgccgaggcagaatagggcggaaccacaataaagagggagatcagtatatctacatgggccagcccctaaacaatgacgaggatcatgctcactggaccgaagccaagatgctgttggacaacattaatacaccagagggtatcatccccgcgttatttgaacctgagagggaaaagtccgcagccattgatggggagtatcgcctgagaggcgaggctaggaaaactttcgtggaactcatgcggcgtggagacctgccagtttggcttagctacaaggtcgcctcagagggctttcaatatagtgatcgccgatggtgcttcgacggggaaagaaacaatcaggtgctggaggaaaacatggatgtggagatatggacgaaagagggagaaaggaagaaactccggccccgctggttggacgctagaacctactctgaccctctggcactaagggagtttaaggagttcgccgctggtcggcgatccgtcagcggcgatctgatcctcgagattgggaaacttccgcagcacctgacacagagagcccaaaatgcattagacaacttggttatgctgcataattcagaacagggaggccgcgcgtataggcacgccatggaggagctcccagatactatcgaaaccctgatgcttctggctctcattgccgtgttgacaggtggggtaaccctgtttttcttaagtggccggggactaggcaagactagcatcgggctgctctgtgtgatggcatcctctgtccttctgtggatggctagcgtggagccccattggatagccgcatccatcattttggaatttttcctgatggttctcctgatccctgagcccgaccgtcagagaacgccacaggataaccaacttgcctacgtggtcattggactcctgtttatgatcttgaccgtagctgcgaatgagatgggtctgttagaaacaactaagaaagacctaggcatagggcacgtggccgttgagaaccaccatcacgcagctatgctggatgtggacctccatcctgcctcagcctggaccctttacgcagtcgctacaaccattatcactcccatgatgaggcacacaattgaaaacacgaccgccaatatctctctgactgcgatagctaaccaggccgcaatcttgatgggactggataagggctggccaattagtaaaatggacatcggtgtgcctctcctggcccttgggtgctattcgcaggtcaatccgttaacactgaccgctgcagtgctcatgttggttgcccattacgcgattatcggccccggactgcaagctaaggccacccgcgaggcacagaaacggacagccgctggcataatgaagaacccaactgtggatgggattgtagccatcgacctagatcctgtggtctatgacgcaaagttcgaaaaacagctgggacagatcatgctccttattctgtgtacgagccaaatcttgctgatgcgaaccacatgggctctctgcgagtccataactctggccaccggccccttaacaaccctttgggagggttctccagggaagttttggaatactacgattgcggtttcaatggccaacatcttcagaggaagctacctggcaggcgctggtctcgccttctccctaatgaaaagtctgggcgggggaaggcgcggcacaggggcacagggagaaaccttgggcgagaagtggaaacggcagctgaatcagctctctaagagcgaatttaacacttataagagatcaggtattatggaggtggaccgttccgaagctaaagaggggcttaagaggggagagaccacaaaacacgccgtcagtcggggcactgccaagctgcgctggttcgtggaacgaaatttggtaaaacctgagggtaaggtgatcgatctgggctgtgggagaggaggctggagctactattgcgcggggctcaagaaagttaccgaagtgaagggatacacaaaaggcggtcccgggcacgaggaaccgataccaatggctacgtacggatggaacttagtcaagctgcattctggcaaagacgtgtttttcatccctcccgagaagtgtgatacccttctgtgcgacattggcgagtcctcaccaaatcccactatcgaagaggggaggacactacgggtcctcaaaatggtggaaccttggctgcgcggaaaccaattttgtattaagatcttgaatccgtatatgcccagcgttgtagagaccctggagcagatgcagagaaagcacggtggcatgctcgtgaggaacccactttcgcgaaattctactcatgaaatgtactgggtcagttgcgggacaggaaacattgtgtccgcagttaatatgaccagccggatgctgttaaaccgtttcacgatggcccacagaaaacctacctatgagcgcgatgtggacctgggcgctggtacaaggcacgtcgccgtggaacccgaggtagcaaacttggatatcatagggcagcggattgaaaatatcaagcatgagcacaaatcaacttggcattacgacgaggataacccttataagacctgggcctaccacggatcctatgaagtgaaaccatctggcagcgctagttccatggttaatggcgtcgtgaagctcctgacaaagccctgggacgtgatccctatggtcactcaaattgcgatgaccgatacaaccccatttgggcagcagagagttttcaaagagaaggtggacactcgcacgcccaaagccaagaggggaacagcacaaataatggaagtaaccgctaaatggctatggggttttcttagccgaaacaagaagccgcggatctgtactagagaggagttcaccaggaaagtgcgctctaatgccgcaattggcgccgtctttgtggacgagaaccagtggaactcagctaaggaggccgttgaagatgagcgtttctgggacctggtgcatcgggaaagagagctccacaaacaggggaagtgcgcgacatgcgtctacaacatgatgggaaaaagggaaaagaagctgggcgagtttggtaaagcaaaggggagtcgcgccatctggtacatgtggttgggagctcgattcctggagttcgaagccctcggctttatgaatgaggatcactggttctcccgggaaaacagcctttctggcgtggagggggagggactgcataaattaggttatattctgagagacatctcgaagatacctggcgggaatatgtacgcagatgacacggctggatgggataccaggatcactgaagacgatttgcagaacgaggcccgcattacagacatcatggaaccagagcacgctctcctggccagatcaatttttaaactaacctatcaaaataaggtagttcgggtgcagaggcccgccaaaaatggcactgtcatggatgtgatcagccgtcgagaccagcgcggttccggacaggtgggaacatacggccttaataccttcacaaacatggaagcgcaactgataagacagatggagagtgagggcatattttctcctagcgaactcgagactccaaacctggccgaacgggtcttggattggttagagaagtatggggttgaaaggctgaagcgcatggctatctccggagacgactgtgtggtaaaacccatcgatgacagattcgccaccgcactcacggctcttaatgatatgggtaaggtgcggaaagacattccgcagtgggagccttcaaagggctggaacgattggcagcaagtccccttttgcagtcatcacttccaccagctgataatgaaagacgggagggagatcgtggttccatgtcgaaatcaggatgagctagtgggacgtgccagagtctctcagggcgcaggttggagcctgcgcgagaccgcctgcctcgggaagtcctacgcgcaaatgtggcagttgatgtattttcatcggagggacctgagacttgctgccaacgcaatttgttcagccgtgcctgtagattggatccccacaagccgcactacctggtctattcacgctcatcaccagtggatgacaactgaagacatgctgtccgtttggaatcgggtgtggatcgaggaaaacccatggatggaggataagacccatataagtagctggggagacgtcccctacctcggcaaaagggaggaccaatggtgcggctcgttaatcgggctgacggcccgagcaacatgggctaccaatattcaggtggccatcaaccaggttagacggttgattggaaatgaaaactacctggattatatgacttccatgaagaggttcaaaaatgagtctgaccctgaaggtgcgctctggtga

SEQ ID NO: 14095 - RNA, 9879 nt, synthetic construct
  misc_feature 1..9879: note = derived and/or modified CDS sequence (opt3) from DENV-1__JQ045648__SS-prME
  source 1..9879: mol_type = other RNA
tccgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttgcgcagaacggacgcctgattacagcaaatcccatcgtgaccgacaaagagaagcctgtaaacatagaagccgagccaccctttggcgagtcttatattgtcatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtgtttacatccgttgggaaactggtgcatcagattttcggaacggcgtacggcgtcttgttttctggtgtgagctggaccatgaagatagggatcggcgtactcctgacttggttaggactaaattcacgaagtacatccctaagcatgacctgtattgctgtgggcctcgttacactgtaccttggggtcatggtgcaggccgattctggatgcgtgatcaactggaaaggccgcgaattgaagtgtggttcagggatcttcgtcactaatgaggttcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtggtagtcggcgatgtggctgggattcttgcccagggcaaaaagatgatccgccctcaacccatggagtacaaatattcgtggaaaagctggggcaaggcgaagataatcggggccgacgttcagaatactacctttattatcgatggaccaaacacacctgaatgtcccgacgatcagagagcttggaatatttgggaggtggaggactacggcttcggtatctttactaccaacatatggttgaagctcagggattcctatacacaggtctgcgaccaccgtctgatgtcagcagccattaaagatagtaaggctgtgcacgccgacatggggtactggatcgaatctgagaaaaatgaaacgtggaagctagcacgggcgagcttcattgaggttaagacctgtatctggccaaaatcccatactctgtggtcaaacggagtgctcgaaagcgagatgataatccccaagatttatggcggtcctatctctcaacacaattaccgaccaggctacttcacacagaccgccgggccgtggcatctgggaaaacttgagttggattttgacctgtgcgaaggcactacagtagtcgtggatgagcactgcgggaacagaggaccctccttaaggaccacgactgtgaccggcaagattatccacgaatggtgttgccgcagttgtacactccctccactgcggttcagaggtgaggacgggtgctggtatggaatggagataaggcccgtcaaagaaaaggaggaaaatcttgttaagagcatggtgtctgctggctccggtgaggtagactcatttagtctgggcttgctctgtattagcatcatgatcgaagaggtgatgcgctcgcgatggtcccggaaaatgctgatgaccgggactctagccgtcttctttctgctcattatgggacagctgacatggaacgatcttatccgtttgtgcattatggtgggcgcaaatgcttctgacagaatggggatgggaaccacatacctggccttaatggcaactttcaagatgaggcctatgtttgccgttggcctcctgttccgccggcttaccagcagagaggtgctgctactcacgataggtctgtcattggtcgctagtgtggaactgccaaactccttagaggaactcggggatggactggcgatgggcatcatgattcttaaactgttgacagactttcaatctcatcagctctgggccaccctgctaagcctgactttcatcaagaccacactttccctccactatgcatggaaaactatggctatggttctgtcaattgtgagcttgtttcccctgtgtttaagtaccacgtctcagaagacaacctggctcccggtcctgcttggctccctggggtgcaagcctttgactatgttcctcatcgccgagaataaaatatggggaaggcgaagctggccactgaacgaaggtatcatggccgtaggcattgtgtcgatcctactgtcatctcttctcaagaacgatgttcccctggctgggcctttgattgcaggaggcatgttaatcgcctgttacgtgataagtggttccagcgcggacctgtctctcgagaaagctgccgaggtcagctgggaagaggaagcagagcattccggggcctcacacaatattctggtggaagtacaggatgacggaacaatgaagatcaaagatgaggagcgcgacgatacccttactatcctgttgaaggctacactactggcagtgagtggcgtctatcccctcagcattccagccaccctgtttgtttggtacttctggcagaaaaagaagcagcggtctggcgtgctttgggacacgccttcacccccagaagtggagagagcggtcttagatgacgggatatataggatcatgcagcgtggactgctcggtcgcagccaggtgggcgttggggtattccaagaaaacgtgtttcatactatgtggcacgtcacccggggagctgtgttgatgtaccagggcaaaagactggagccgagttgggccagcgttaagaaagacctcatttcctacggtgggggatggaggctgcagggctcttggaatacaggcgaggaagtgcaggtcatcgcagtggagcctgggaagaaccccaaaaatgtacaaaccgccccaggaacattcaagactcccgaaggtgaggtcggcgctattgcccttgattttaagcctgggacctcgggaagcccaatcgtgaaccgagaaggcaaaatagttggtctgtatgggaatggagtggtcacgacatcaggcacttacgtgtccgcaatcgctcaggccaaggcgagtcaggagggccccttgcctgagattgaagacgaggttttccggaaacgcaacctaaccatcatggatctgcacccggggtctggaaagacaagaaggtatctcccagccattgtgcgggaagcaatcaaacgaaagttaagaaccctgatacttgctcccactcgcgtcgtggccagcgagatggctgaagcactgaagggtatgcctattaggtaccaaaccacagccgtaaaatccgagcatacgggcaaggagatcgtggacctcatgtgccacactacctttacaatgcgtttgctgtcaccagttcgggtccccaattataacatgatcattatggatgaagcccatttcaccgacccttctagcatcgctgcgagagggtacataagtactagggtgggaatgggcgaggcagccgctatttttatgacagccaccccgcccggttccgtggaagcattcccacagagcaatgccgtcatccaggatgaggaacgcgacattcctgagcgatcttggaactcagggtatgagtggatcacggattttcccggaaaaactgtatggttcgtgccatccataaagagtggcaatgacattgctaactgtctcaggaaaaatggcaagcgggttatccagctgagcaggaagacatttgataccgaataccagaaaaccaagaacaacgactgggactacgtggtcactacagatatctcggagatgggggcgaatttccgcgccgaccgtgtgattgatcctagacggtgccttaaacccgttatcctaaaggacggaccagaaagggtgattctggcaggtccgatgcctgtcaccgtggcttctgccgcacagcgccgaggcagaatagggcggaaccacaataaagagggagatcagtatatctacatgggccagcccttgaacaatgacgaggatcatgcccactggacagaagctaagatgttactggacaacattaatactccagagggtatcatccccgccctcttcgaacctgagagggaaaagtccgcggcaattgatggggagtatcgcctgagaggcgaggccaggaaaacgtttgtagaacttatgcggcgtggagacctgccagtgtggctcagctacaaggttgcttcagagggcttccaatatagtgatcgccgatggtgctttgacggggaaagaaacaatcaggtcttggaggaaaacatggatgtggagatatggaccaaagagggagaaaggaagaaactgcggccccgctggctagacgccagaacatactctgaccctctggctctcagggagttcaaggaatttgcagccggtcggcgatccgtgagcggcgatcttatcctggagattgggaaattaccgcagcacttgactcagagagctcaaaatgccctggacaacctcgtcatgctgcataattcagaacagggaggccgcgcatataggcacgcgatggaggagcttccagataccatcgaaacactgatgctcttggccctgattgctgttttaaccggtggggtgactctattctttctgagtggccggggactcggcaagacgagcatcgggcttctgtgtgtaatggcctcctctgtgttgctgtggatggcaagcgtcgagccccattggatagctgcctccatcattctcgagttctttctgatggtgcttctcatccctgagcccgaccgtcagagaaccccacaggataaccaactggcatacgttgtgattggattgctgttcatgatcttaacagtcgccgctaatgagatgggtctactggaaactaccaagaaagacctcggcatagggcacgtagcggtggagaaccaccatcacgccgcaatgcttgatgttgacctgcatcctgcttcagcctggacattgtacgccgtggcaaccactattatcacacccatgatgaggcacacgattgaaaacaccactgctaatatctctctgacagccatagcgaaccaggctgccatcctcatgggactggataagggctggccaattagtaaaatggacatcggtgtccctcttttagcactggggtgctatagccaggtgaatccgctcaccttgaccgccgctgtcctgatgctagtggcacattacgccattatcggccccggactgcaagcgaaggctacacgcgaggcccagaaacggactgcagccggcataatgaagaacccaacggttgatgggattgtggctatcgacctcgatcctgtagtgtatgacgccaagtttgaaaaacagcttggacagatcatgctgttgattctgtgtaccagccaaatcctcctgatgcgaacaacttgggcattatgcgagtccataacccttgctacaggccccctgaccactctctgggagggttctccagggaagttctggaatacgacaattgccgtctcaatggcgaacatctttagaggaagctacctagccggcgcaggtctggctttctccttgatgaaaagtctgggcgggggaaggcgcggcaccggggcccagggagaaactctcggcgagaagtggaaacggcagcttaatcagctgtctaagagcgagttcaacacctataagagatcaggtattatggaggttgaccgttccgaagcaaaagaggggttgaagaggggagagacaactaaacacgctgtgagtcggggcaccgccaagctgcgctggtttgtcgaacgaaatctcgtgaaacctgagggtaaggtaatcgatttaggctgtgggagaggaggctggagctactattgcgccgggctgaagaaagtgacagaagttaagggatacacgaaaggcggtcccgggcacgaggaaccgataccaatggcgacctacggatggaaccttgtgaagctgcattctggcaaagacgtcttctttatccctcccgagaagtgtgatactctactctgcgacattggcgagtcctcaccaaatcccacaatcgaagaggggaggaccctgcgggtgttgaaaatggtcgaaccttggctgcgcggaaaccaattctgtattaagatcctcaatccgtatatgcccagcgtggttgagactcttgagcagatgcagagaaagcacggtggcatgctggtaaggaacccattatcgcgaaattctacacatgaaatgtactgggtgagttgcgggaccggaaacattgtctccgctgtgaatatgacgagccggatgctgttgaaccgttttaccatggcacacagaaaacctacatatgagcgcgatgttgacctcggcgccggtactaggcacgtggctgtcgaacccgaggtggccaacctggatatcatagggcagcggattgaaaatatcaagcatgagcacaaatcaacctggcattacgacgaggataacccttataagacatgggcataccacggatcctatgaagtaaaaccatctggcagcgccagttccatggtgaatggcgttgtcaagctacttactaagccctgggacgtgatccctatggtgacccaaattgctatgacagataccactccattcgggcagcagagagtctttaaagagaaggttgacacgcgcacacccaaagcgaagaggggaaccgcccaaataatggaagtgactgcaaaatggctgtggggtttcctcagccgaaacaagaagccgcggatctgtaccagagaggaatttacaaggaaagtacgctctaatgctgccattggcgcagtgttcgtcgacgagaaccagtggaactcagccaaggaggctgtggaagatgagcgtttttgggacctggttcatcgggaaagagagttgcacaaacaggggaagtgcgccacgtgcgtgtacaacatgatgggaaaaagggaaaagaagctgggcgagttcggtaaagcgaaggggagtcgcgcaatctggtacatgtggctcggagcccgatttcttgagttcgaagctctgggcttcatgaatgaggatcactggttttcccgggaaaacagcttatctggcgtcgagggggagggactgcataaattgggttatattctcagagacatctcgaagatacctggcgggaatatgtacgccgatgacaccgcaggatgggatactaggatcacagaagacgatctgcagaacgaggctcgcattaccgacatcatggaaccagagcacgccctacttgctaaatcaattttcaagctgacttatcaaaataaagtggtaagagttcagcggcccgccaagaacggcacagtgatggatgtcatcagcaggcgtgaccagcgaggttccggacaggtgggaacctacggcctcaatacatttactaacatggaagcacaactgatacgccagatggagagtgagggcattttctctcctagcgaattggagaccccaaacttagcggaaagagtgctggattggctcgagaagtatggggtcgaacggcttaaaaggatggccatctccggagacgactgtgttgtgaagcccatcgatgaccgctttgctacggccctgaccgcactaaatgatatgggtaaagtaagaaaggacattccgcagtgggagccttcaaaaggctggaacgattggcagcaagtgcccttctgcagtcatcactttcaccagctgataatgaaggacgggcgggagatcgtcgtgccatgtaggaatcaggatgaactcgttggacgagctcgtgtgtctcagggcgccggttggagcttgagagagacagcatgcctggggaagtcctacgcccaaatgtggcagcttatgtatttccatcgccgggacctgaggctcgcggctaacgccatttgttcagcagtccctgtggattggatccccactacctgcacaacttggagcattcacgcccatcaccagtggatgaccacggaagacatgttatctgtatggaatagagtttggatcgaggaaaacccatggatggaggataaaacacatatatccagttggggagacgtgccctacctgggcaagcgcgaggaccaatggtgtggcagcttgatcgggctgaccgctcgggccacttgggcaacaaatattcaggtcgctatcaaccaggtgaggcgactcattggaaatgaaaactaccttgattatatgacctcgatgaaaagatttaagaatgagtccgaccctgaaggtgccctgtggtga

SEQ ID NO: 14096 - RNA, 9879 nt, synthetic construct
  misc_feature 1..9879: note = derived and/or modified CDS sequence (opt3) from DENV-1__JQ045649__SS-prME
  source 1..9879: mol_type = other RNA
agcgtgaccatgctgctcatgcttatgcccaccgcactggctttccacttgactacgagaggaggggaacctcatatgatcgtctccaagcaggaaaggggaaaatctttactgtttaagacctcagccggtgttaacatgtgcacgctaattgccatggacctcggagaactgtgtgaagatactatgacctacaaatgcccacggataacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagcacaaatactcgtggaaaagctggggcaaggccaagataatcggggcggacgtgcagaataccacatttattatcgatggaccaaacactcctgaatgtcccgacgatcagagagcctggaatatttgggaggtcgaggactatggcttcggtatctttaccacaaacatatggcttaagttgagggattcctacacacaggtgtgcgaccaccgtctcatgtcagctgcaattaaagatagtaaggccgttcatgctgacatggggtattggatcgaatctgagaaaaatgaaacctggaagctggcccgggccagcttcattgaggtgaagacttgtatctggccaaaatcccacacactatggtcaaacggagtactggaaagcgagatgataatccccaagatttacggcggtcctatctctcaacataattatcgaccaggctacttcacccagactgcggggccgtggcacctcggaaaactggagcttgattttgacttgtgcgaaggcacaaccgtcgtggtggatgagcactgcgggaacagaggaccctccctgaggacgactaccgtcacaggcaagattatccatgaatggtgttgccgcagttgtaccttacctccactccggttcagaggtgaggacgggtgctggtacggaatggagataaggcccgttcgcgaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattgttggacagctcacctggaacgatctgatcagactttgcattatggtgggcgccaatgcatctgacaggatggggatgggaacaacttatttggctctgatggccaccttcaaaatgcgccctatgtttgcagtcggcttactcttccggagactgacgagcagggaggtgcttctgctaacaataggtctctcactggttgccagtgtggaattgccaaactccctggaggaattaggggatggactcgctatgggcatcatgattctgaaacttctgaccgactttcaatctcaccagttgtgggcgagcctcctgtccctaactttcatcaaaaccacattttcactgcattacgcctggaagactatggcaatggtccttagcgtagtgagtctcttccccctgtgtttgtctaccacgtcccagaaaacaacctggctgccggttttactcggcagcctggggtgcaagcctcttactatgtttctgattgctgagaataagatctggggacgacgctcgtggccattgaacgaaggtataatggccgtgggcatcgtctcaattctcctgtctagtctactgaaaaacgatgtgccccttgccgggcctctcatcgctggaggcatgctgattgcatgttatgtaatctccggtagctctgccgacttgagcttagagaaggcggctgaggtgtcctgggaagaggaagccgagcactcaggggcaagtcataatatactggtcgaagttcaggatgacggaacaatgaaaattaaggatgaggagcgggacgataccctcactatcctgcttaaagccacactgttggctgtgagcggcgtgtaccccctatctatcccagcaaccctgttcgtctggtatttctggcaaaagaaaaagcagagatccggcgtgctctgggacacgccttcacccccagaagttgagagggccgtactggatgacgggatttaccgtataatgcagcgcggacttttaggtcggagtcaggtgggcgtcggggtgtttcaagaaaacgttttccacactatgtggcacgtgaccagaggagcggtcctgatgtatcagggcaagaggctcgagccgagctgggcttccgtgaaaaaggacttgatctcttacggtgggggatggcgactgcagggctcgtggaatacaggcgaggaagtacaggtcattgccgtggagcctgggaaaaaccccaagaatgttcaaaccgcaccaggaacatttaaaactcccgaaggtgaggtgggcgccatcgctctcgatttcaagcctgggaccagcggatcaccaattgtcaaccgggaaggcaagatcgtgggtctgtacgggaatggagttgtgacgacatccggcacttatgtcagtgccatagcacaggctaaagcctctcaggagggcccccttcctgagatcgaagacgaggtgtttcgcaagagaaacctgaccattatggatttgcatccggggagcggaaaaacaaggcggtacctaccagcgatcgtacgagaagccattaagagaaaactgcgcaccctcatcttagcacccactagggtggttgcttccgagatggccgaagctctgaagggtatgcctatacgttatcaaaccacagcagtcaagtcagagcacacgggcaaagagattgtggaccttatgtgccatgccactttcaccatgcggctgctctctccagtgagagtccccaattacaacatgatcatcatggatgaagcccactttacagaccctagcagtattgctgcgagggggtatatctccacccgcgtaggaatgggcgaggcagccgctatattcatgactgccacaccgcccggtagcgtggaagcatttccacagtctaatgccgttattcaggatgaggaacgagacatccctgagagatcatggaactccgggtacgagtggattaccgatttccccggaaagacggtgtggtttgtcccaagtatcaaaagcggcaatgacatagctaactgtttgcggaagaatggcaaaagggtgattcagctgtcgcgcaagactttcgatacagaatatcaaaagaccaaaaacaacgactgggactacgttgtgaccactgatatctctgagatgggggcgaatttccgtgccgacagagtcatcgatcctcggaggtgcctcaagcccgtgattctgaaagacggaccagaacgcgtaatccttgcaggtccgatgcctgtgacagttgcttccgccgcacagcgaagaggccggattgggaggaaccataataaggagggagatcagtacatatatatgggccagcccctaaacaatgacgaggatcacgcccactggaccgaagctaaaatgctgttggacaacatcaatacaccagagggtattatccccgccttatttgaacctgagcgcgaaaagagcgcggcaatcgatggggagtacagactgaggggcgaggcccggaagactttcgtcgaactcatgcgtcgcggagacctgccagtgtggctttcatataaagtggctagtgagggctttcaatactctgatcgaagatggtgcttcgacggggaaaggaacaatcaggtcctggaggaaaacatggatgttgagatttggacgaaggagggagaacggaaaaagctccgccccagatggttggacgccaggacctattccgaccctctggctctacgggagtttaaagagttcgcagccggtcgaagaagcgtgtcaggcgatctgatactcgagatcgggaaacttccgcagcatctgacacagcgcgctcaaaatgccttagacaacttggtaatgctgcacaatagtgaacagggaggcagggcataccggcatgcgatggaggagctcccagatactattgaaaccctgatgcttctggccctcatcgctgtgttgacaggtggggtcaccctgtttttcttaagcggccgtggactaggcaaaacttccattgggctgctctgtgtgatggcctctagcgttcttctgtggatggcatccgtggagccccactggatcgctgcctcaataatcttggaatttttcctgatggtcctcctgattcctgagcccgacagacagaggacgccacaggataaccaacttgcatatgtagtgatcggactcctgtttatgattttgaccgttgccgctaatgagatgggtctgttagaaacaactaagaaggacctaggcatcgggcacgtggcggtcgagaaccatcaccatgccgcaatgctggatgtggacctccaccctgcttctgcctggaccctttacgccgtcgcaacaaccataattactcccatgatgcgccatacaatcgaaaacacgaccgctaatattagtctgactgccatcgcgaaccaggctgccatattgatgggactggataaaggctggccaatctcgaagatggacattggtgtgcctctcctggcacttgggtgctacagccaggttaatccgttaacactgaccgccgctgtgctcatgttggtagcacactatgccatcattggccccggactgcaagcgaaagctacccgggaggcccagaagcgaacagcagccggcatcatgaaaaacccaactgtggatgggatagtcgctattgacctagatcctgttgtgtacgacgccaagttcgaaaagcagctgggacagatcatgctccttatcctgtgtacgtcccaaattttgctgatgagaaccacatgggcactctgcgagtctatcactctggctaccggccccttaacaaccctttgggagggttcaccagggaaattttggaatactacgatagccgtcagcatggcgaacattttcaggggatcctatctggccggcgcaggtctcgctttcagtctaatgaagtctctgggcgggggacgccggggcacaggggcccagggagaaaccttgggcgagaaatggaagagacagctgaatcagctcagcaaatcagaatttaacacttacaagcgttccggtatcatggaggtggacaggagtgaagcaaaggaggggcttaaacggggagagaccacaaagcacgctgtaagccgcggcactgccaaactgcgatggttcgtggaaagaaatttggttaagcctgagggtaaagtgattgatctgggctgtgggaggggaggctggtcttattactgcgccgggctcaagaaggtcaccgaagtgaaaggatatacaaagggcggtcccgggcatgaggaaccgatcccaatggcgacgtacggatggaacttagtcaaactgcactccggcaaggacgtgtttttcatacctcccgagaaatgtgatacccttctgtgcgacatcggcgagtcaagcccaaatcccactattgaagaggggcggacactacgcgttctcaagatggtagaaccttggctgagaggaaaccaattttgtatcaaaattttgaatccgtacatgccctcggtggtcgagaccctggagcagatgcagaggaagcatggtggcatgctcgtgcgaaacccactttctcggaatagtactcacgaaatgtattgggtttcctgcgggacaggaaacatcgtgagcgctgtcaatatgacctcacgtatgctgttaaacagattcacgatggcacaccgcaagcctacctacgagagggatgtggacctgggcgccggtacacggcatgtagctgtggaacccgaggttgccaacttggatattatcgggcagagaatagaaaatattaaacacgagcataagtccacttggcactatgacgaggataacccttacaaaacctgggcatatcatggatcttacgaagtcaagccaagcggcagtgcctccagcatggtgaatggcgtggtcaaactcctgacaaagccctgggacgttatccctatggtgactcaaatcgctatgaccgatacaaccccatttgggcagcagcgcgtattcaaggagaaagtggacactaggacgcccaaggcgaaacgaggaacagcccaaattatggaagtcaccgcaaagtggctatggggttttctttctcggaacaaaaagccgagaatatgtactagggaggagttcacccgcaaggtgcgttcaaatgctgccatcggcgcagtttttgtggacgagaaccagtggaatagtgccaaagaggctgtcgaagatgagcggttctgggacctggtgcacagagaaagggagctccacaagcaggggaaatgcgccacatgcgtatataacatgatgggaaagcgcgagaagaagctgggcgagtttggtaaggcgaaagggtcccgagcaatttggtacatgtggttgggagcccggttcctggagttcgaagctctcggctttatgaatgaggatcattggttcagcagagaaaactctctttcgggcgttgagggggagggactgcacaagttaggttacatcctgagggacatttcaaaaatccctggcgggaatatgtatgccgatgacacggcaggatgggatacccgcataactgaagacgatttgaagaacgaggctagaatcacagacattatggaaccagagcatgccctcctggctaaaagcatctttaagctaacctaccagaataaagtggtccgggtgcaaaggcccgccaagaacggcactgtgatggatgtcatttcccgtcgagaccagcgcggtagtgggcaggttggaacatatggccttaataccttcacaaacatggaagcacagctgatcagacaaatggagtctgagggcatatttagcccttccgaactcgagactccaaacctggcggaacgggtgttgcactggttagagaagtacggggtagaaaggctgaaacgcatggccatttcaggagatgactgtgtggtcaagcccatcgacgatagattcgctaccgccctcacggcacttaatgacatgggtaaagtgcggaaggatatcccgcagtgggagcctagtaaaggctggaacgactggcagcaggttcccttttgctctcaccatttccaccaactgattatgaaggatgggagggagatagtggtcccatgtcgaaatcaggacgagctagtgggacgtgctagagtaagccagggcgccggttggtccctgcgcgagaccgcatgcctcgggaagtcatatgcccagatgtggcaattgatgtactttcatcggagggatctgagacttgcggctaacgccatctgtagcgcagttcctgtggactggattcccacatctcgcactacctggtccatccacgcccatcaccagtggatgacaactgaagatatgctgagtgtctggaatcgggtgtggattgaggaaaacccatggatggaggacaaaacccacatcagctcgtggggagatgttccctatctcggcaagagggaggaccagtggtgcggctccttaatagggctgacggctcgagccacatgggcaaccaatatccaagtggctattaaccaggtcagacggttgatcggaaatgaaaactacctggactacatgacttctatgaaaaggttcaagaatgagtcagatcctgaaggtgccctctggtga

SEQ ID NO: 14097 - RNA, 9879 nt, synthetic construct
  misc_feature 1..9879: note = derived and/or modified CDS sequence (opt3) from DENV-1__JQ045650__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaatatgtgcacactgattgccatggacctcggagaactgtgtgaagatactatgacctacaaatgcccacggataacagagaccgaaccggacgatgtggactgttggtgcaatgcgactgatacatgggtaacctatgggacgtgtagtcagactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagcacaaatactcgtggaaaagctggggcaaggccaagataatcggggcggacgttcagaataccacatttattatcgatggaccaaacactcctgaatgtcccgacgatcagagagcctggaatatttgggaggtggaggactatggcttcggtatctttaccacaaacatatggttgaagctcagggattcctacacgcaggtctgcgaccaccgtctgatgtcagctgcaattaaagatagtaaggccgtgcatgctgacatggggtattggatcgaatctgagaaaaatgaaacctggaagctagcccgggccagcttcattgaggttaagacttgtatctggccaaaatcccacacactgtggtcaaacggagtgctcgaaagcgagatgataatccccaagatttacggcggtcctatctctcaacataattatcgaccaggctacttcacccagactgcggggccgtggcacctgggaaaacttgagttggattttgacctgtgcgaaggcacaaccgtagtcgtggatgagcactgcgggaacagaggaccctccttaaggacgactaccgtgacaggcaagattatccatgaatggtgttgccgcagttgtaccctccctccactgcggttcagaggtgaggacgggtgctggtacggaatggagataaggcccgtccgcgaaaaagaggaaaatcttgttaagagcatggtgtctgccggctccggtgaggtagactcatttagtctgggcttgctctgtattagcatcatgatcgaagaggtgatgcgatcgcggtggtcccgtaagatgctgatgactgggacactagctgtcttctttctgctcattgtgggacagctgacctggaacgatcttatcagattgtgcattatggttggcgccaatgcatctgacaggatggggatgggaacaacttatctggctttaatggccaccttcaaaatgcgccctatgtttgcagtgggcctcctgttccggagacttacgagcagggaggtcctgctactcacaataggtctgtcattggtggccagtgttgaactgccaaactccttagaggaactcggggatggactggctatgggcatcatgattcttaagctgttgaccgactttcaatctcaccagctctgggcgagcctgctatccctgactttcatcaaaaccacattttcacttcattacgcctggaagactatggcaatggtgctcagcgtcgtaagtctgttccccttgtgtctgtctaccacgtcccagaaaacaacctggttaccggtgctcctgggcagccttgggtgcaagcctctgactatgtttttgattgctgagaataagatctggggacgacgctcgtggccactcaacgaaggtataatggccgttggcatcgtgtcaattctgctatctagtctgcttaaaaacgatgtccccctcgccgggcctctgatcgctggaggcatgttgattgcatgttatgtgatctccggtagctctgccgacttaagcctggagaaggcggctgaggtatcctgggaagaggaagccgagcactcaggggcaagtcataatatactcgtggaagtccaggatgacggaacaatgaaaattaaggatgaggagcgggacgataccctgactatccttctgaaagccacattgctagctgttagcggcgtgtaccccctgtctatcccagcaaccctcttcgtgtggtatttctggcaaaagaaaaagcagagatccggcgtcctgtgggacacgccttcacccccagaagtggagagggccgttcttgatgacgggatttaccgtataatgcagcgcggattactgggtcggagtcaggtaggcgtgggggtctttcaagaaaacgtgttccacactatgtggcacgttaccagaggagcggtgctcatgtatcagggcaagaggttggagccgagctgggcttccgtcaaaaaggacctgatctcttacggtgggggatggcgactccagggctcgtggaatacaggcgaggaagtgcaggtaattgccgtcgagcctgggaaaaaccccaagaatgtgcaaaccgcaccaggaacatttaaaactcccgaaggtgaggttggcgccatcgctctggatttcaagcctgggaccagcggatcaccaattgtgaaccgggaaggcaagatcgtcggtctttacgggaatggagtggttacgacatccggcacttatgtgagtgccatagcacaggctaaagcctctcaggagggccccctgcctgagatcgaagacgaggtctttcgcaagagaaacttgaccattatggatctacatccggggagcggaaaaacaaggcggtacctgccagcgatcgtgcgagaagccattaagagaaaactccgcaccttaatcctggcacccactagggtagtggcttccgagatggccgaagctcttaagggtatgcctatacgttatcaaaccacagcagttaagtcagagcacacgggcaaagagattgtcgacctgatgtgccatgccactttcaccatgcggctcttgtctccagtgagagtgcccaattacaacatgatcatcatggatgaagcccactttacagaccctagcagtattgctgcgagggggtatatctccacccgcgtcggaatgggcgaggcagccgctatattcatgactgccacaccgcccggtagcgtagaagcatttccacagtctaatgccgtgattcaggatgaggaacgagacatccctgagagatcatggaactccgggtacgagtggattaccgatttccccggaaagacggtttggtttgtgccaagtatcaaaagcggcaatgacatagctaactgtctgcggaagaatggcaaaagggtcattcagctctcgcgcaagactttcgatacagaatatcaaaagaccaaaaacaacgactgggactacgtggttaccactgatatctctgagatgggggcgaatttccgtgccgacagagtgatcgatcctcggaggtgcctgaagcccgtcattcttaaagacggaccagaacgcgtgatcctagcaggtccgatgcctgtaacagtggcttccgccgcacagcgaagaggccggattgggaggaaccataataaggagggagatcagtacatatatatgggccagcccctgaacaatgacgaggatcacgcccactggaccgaagctaaaatgttgttagacaacatcaatacaccagagggtattatccccgccctgtttgaacctgagcgcgaaaagagcgcggcaatcgatggggagtacagactcaggggcgaggcccggaagactttcgttgaactgatgcgtcgcggagaccttccagtctggctgtcatataaagtggctagtgagggctttcaatactctgatcgaagatggtgcttcgacggggaaaggaacaatcaggtgctcgaggaaaacatggatgtcgagatttggacgaaggagggagaacggaaaaagttgcgccccagatggctggacgccaggacctattccgaccctctagctctgcgggagtttaaagagttcgcagccggtcgaagaagcgtttcaggcgatctcatacttgagatcgggaagctgccgcagcatttaacacagcgcgctcaaaatgccttggacaacctggtgatgctccacaatagtgaacagggaggcagggcataccggcatgcgatggaggagctgccagatactattgaaacccttatgctgctcgccttgatcgctgtactgacaggtggggtgaccttatttttcctaagcggccgtggactgggcaaaacttccattgggctcctttgtgtcatggcctctagcgtgctgttgtggatggcatccgttgagccccactggatcgctgcctcaataatcctggaatttttcctcatggtgctgcttattcctgagcccgacagacagaggacgccacaggataaccaactcgcatatgtcgtaatcggactgttgtttatgattctgaccgtggccgctaatgagatgggtttactagaaacaactaagaaggacctgggcatcgggcacgttgcggtggagaaccatcaccatgccgcaatgctcgatgtcgaccttcaccctgcttctgcctggaccctgtacgccgtggcaacaaccataattactcccatgatgcgccatacaatcgaaaacacgaccgctaatattagtttgactgccatcgcgaaccaggctgccatactgatgggactcgataaaggctggccaatctcgaagatggacattggtgtccctctgcttgcattagggtgctacagccaggtgaatccgctgacactcaccgccgctgttttgatgctggtggcacactatgccatcattggccccggactacaagcgaaagctacccgggaggcccagaagcgaacagcagccggcatcatgaaaaacccaactgtagatgggatagtggctattgacctggatcctgtcgtttacgacgccaagttcgaaaagcagctcggacagatcatgcttctgatcttgtgtacgtcccaaattctgctcatgagaaccacatgggcactgtgcgagtctatcactttagctaccggcccccttacaaccctgtgggagggttcaccagggaaattttggaatactacgatagccgtgagcatggcgaacattttcaggggatcctatctcgccggcgcaggtctagctttcagtctgatgaagtctttgggcgggggacgccggggcacaggggcccagggagaaaccctgggcgagaaatggaagagacagctcaatcagcttagcaaatcagaatttaacacttacaagcgttccggtatcatggaggtcgacaggagtgaagcaaaggaggggctgaaacggggagagaccacaaagcacgctgtgagccgcggcactgccaaattgcgatggttcgtagaaagaaatctggtgaagcctgagggtaaagttattgatctcggctgtgggaggggaggctgggcctattactgcgcggggttaaagaaggtgaccgaagtcaaaggatatacaaagggcggtcccgggcatgaggaaccgatcccaatggctacgtacggatggaacctggtgaaacttcactctggcaaggacgtctttttcatacctcccgagaaatgtgataccctgctatgcgacatcggcgagtcctcaccaaatcccactattgaagaggggcggacactccgcgtgctgaagatggttgaaccttggttgagaggaaaccaattttgtatcaaaattctgaatccgtacatgcccagcgtagtggagaccctcgagcagatgcagaggaagcatggtggcatgcttgtccgaaacccactgtcgagaaattctactcacgaaatgtattgggtgagttgcgggacaggaaacatcgtttccgcagtgaatatgaccagccgtatgttactgaacagattcacgatggcccaccgcaagcctacctacgagagggatgtcgacttgggcgctggtacacggcatgtggccgtagaacccgaggtggcaaacctcgatattatcgggcagagaatagaaaatattaaacacgagcataagtcaacttggcactatgacgaggataacccttacaaaacctgggcctatcatggatcctacgaagttaagccatctggcagcgctagttccatggtcaatggcgtggtgaaactgctaacaaagccctgggacgtcatccctatggttactcaaatcgcgatgaccgatacaaccccatttgggcagcagcgcgtgttcaaggagaaagtagacactaggacgcccaaggccaaacgaggaacagcacaaattatggaagtgaccgctaagtggctttggggttttctgagccggaacaaaaagccgagaatatgtactagggaggagttcacccgcaaggtccgttctaatgccgcaatcggcgccgtgtttgttgacgagaaccagtggaactcagctaaagaggccgtggaagatgagcggttctgggacctcgtccacagagaaagggagctgcacaagcaggggaaatgcgcgacatgcgtgtataacatgatgggaaagcgcgagaaaaagttgggcgagtttggtaaggcaaaagggagtcgagccatttggtacatgtggctgggagctcggttcctcgagttcgaagcccttggctttatgaatgaggatcattggttctccagagaaaacagcctgtctggcgtagagggggagggattacacaagctgggttacatcttgagggacatttcgaaaatccctggcgggaatatgtatgcagatgacacggctggatgggatacccgcataactgaagacgatctcaagaacgaggccagaatcacagacattatggaaccagagcatgctctgctagccaaatcaatctttaaacttacctaccagaataaagttgtgcgggtccaaaggcccgcaaagaacggcactgtgatggatgtgattagccgtcgagaccagcgcggttccgggcaggtcggaacatatggcctgaataccttcacaaacatggaagcgcagctcatcagacaaatggagagtgagggcatattttctcctagcgaactggagactccaaacttggccgaacgggttttacactggctggagaagtacggggtggaaaggctcaaacgcatggctatttccggagatgactgtgtagtgaagcccatcgacgatagattcgccaccgcacttacggctctgaatgacatgggtaaagtccggaaggatatcccgcagtgggagccttcaaaaggctggaacgactggcaacaggtgcccttttgcagtcaccatttccaccaactaattatgaaggatgggagggagatagttgtgccatgtcgaaatcaggacgaactggtcggacgtgccagagtgtctcagggcgcaggttggagcctccgcgagaccgcctgcttggggaagtcctatgcgcagatgtggcaactgatgtactttcatcggagggatcttagactggctgccaacgcaatctgttcagccgtacctgttgactggattcccacaagccgcactacctggtctatccacgctcatcaccagtggatgacaactgaagatatgctctccgtgtggaatcgggtctggattgaggaaaacccatggatggaggacaaaacccacatcagtagctggggagatgtgccctatttaggcaagagggaggaccagtggtgcggctcgctgatagggttgacggcccgagcaacatgggctaccaatatccaagttgccattaaccaggtgagacggctgatcggaaatgaaaactacctcgactacatgacttccatgaaaaggttcaagaatgagtctgatcctgaaggtgcgctttggtga

SEQ ID NO: 14098 - RNA, 9879 nt, synthetic construct
  misc_feature 1..9879: note = derived and/or modified CDS sequence (opt3) from DENV-1__JQ045651__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatggttctctcaattgtgagcctgttccccttgtgtctgagtacgacatctcagaagaccacttggttaccggtcctcctgggctcccttgggtgcaagcctctgacaatgtttttgatcgctgagaataaaatatggggaaggcgaagctggccactcaacgaaggtatcatggccgtaggcattgtgtcgatcctgctatcatctctgcttaagaacgatgttcccctcgccgggcctctgattgctggaggcatgttgatcgcatgttacgtgataagtggttccagcgccgacttatctctggagaaagcggctgaggtcagctgggaagaggaagccgagcattccggggcatcacacaatattctcgtggaagtacaggatgacggaaccatgaagatcaaagatgaggagcgcgacgatactctgacaatccttctgaaggccaccttgctagctgtgagtggcgtctatcccctgagcattccagcaacactcttcgtttggtacttctggcagaagaagaagcagcggtctggcgtgctgtgggacactccttcacccccagaagtggagagagccgtccttgatgacgggatatataggatcatgcagcgtggattactgggtcgcagccaggtgggcgttggggtatttcaagaaaacgtgttccataccatgtggcacgtcacacggggagcggtgctcatgtaccagggcaaaagattggagccgagttgggctagcgttaagaaagacctgatttcctacggtgggggatggaggctccagggctcttggaataccggcgaggaagtgcaggtcatcgccgtggagcctgggaagaaccccaaaaatgtacaaacagcaccaggaacttttaagacccccgaaggtgaggtcggcgccattgctctggatttcaagcctgggacgtcgggaagcccaatcgtgaaccgagaaggcaaaatagttggtctttatgggaatggagtggtcacaacttcaggcacctacgtgtccgccatcgcacaggctaaggccagtcaggagggccccctgcctgagattgaagacgaggtttttcggaaacgcaacttgacaatcatggatctacacccggggtctggaaagaccagaaggtatctgccagcgattgtgcgggaagccatcaaacgaaagctcagaactttaatactggcacccacccgcgtcgtggctagcgagatggccgaagctcttaagggtatgcctattaggtaccaaacaacggcagtaaaatccgagcatactggcaaggagatcgtggacctgatgtgccacgccaccttcacaatgcgtctcttgtcaccagttcgggtccccaattataacatgatcattatggatgaagcccattttaccgacccttctagcatcgctgcgagagggtacataagtactagggtgggaatgggcgaggcagccgctattttcatgacagccaccccgcccggttccgtggaagcatttccacagagcaatgccgtcatccaggatgaggaacgcgacattcctgagcgatcttggaactcagggtatgagtggatcacggatttccccggaaaaactgtatggtttgtgccatccataaagagtggcaatgacattgctaactgtctgaggaaaaatggcaagcgggttatccagctcagcaggaagacattcgataccgaataccagaaaaccaagaacaacgactgggactacgtggtcactacagatatctcggagatgggggcgaatttccgcgccgaccgtgtgattgatcctagacggtgcctgaaacccgttatccttaaggacggaccagaaagggtgattctagcaggtccgatgcctgtcaccgtggcttctgccgcacagcgccgaggcagaatagggcggaaccacaataaagagggagatcagtatatctacatgggccagcccctgaacaatgacgaggatcatgcccactggacagaagctaagatgttgttagacaacattaatactccagagggtatcatccccgccctgtttgaacctgagagggaaaagtccgcggcaattgatggggagtatcgcctcagaggcgaggccaggaaaacgttcgtagaactgatgcggcgtggagaccttccagtgtggctgagctacaaggttgcttcagagggctttcaatatagtgatcgccgatggtgcttcgacggggaaagaaacaatcaggtcctcgaggaaaacatggatgtggagatatggaccaaagagggagaaaggaagaaattgcggccccgctggctggacgccagaacatactctgaccctctagctctgagggagtttaaggagttcgcagccggtcggcgatccgtgagcggcgatctcatccttgagattgggaaactgccgcagcacttaactcagagagctcaaaatgccttggacaacctggtcatgctccataattcagaacagggaggccgcgcatataggcacgcgatggaggagctgccagataccatcgaaacacttatgctgctcgccttgattgctgttctgaccggtggggtgactttatttttcctaagtggccggggactgggcaagacgagcatcgggctcctttgtgtaatggcctcctctgtgctgttgtggatggcaagcgtcgagccccattggatagctgcctccatcattctggaatttttcctcatggtgctgcttatccctgagcccgaccgtcagagaaccccacaggataaccaactcgcatacgttgtgattggactgttgtttatgatcctgacagtcgccgctaatgagatgggtttactagaaactaccaagaaagacctgggcatagggcacgtagcggtggagaaccaccatcacgccgcaatgctcgatgttgaccttcatcctgcttcagcctggacactgtacgccgtggcaaccactattatcacacccatgatgaggcacacgattgaaaacaccactgctaatatctctttgacagccatagcgaaccaggctgccatcctgatgggactcgataagggctggccaattagtaaaatggacatcggtgtccctctgcttgcattagggtgctatagccaggtgaatccgctgaccctcaccgccgctgtcttgatgctggtggcacattacgccattatcggccccggactacaagcgaaggctacacgcgaggcccagaaacggactgcagccggcataatgaagaacccaacggttgatgggattgtggctatcgacctggatcctgtagtgtatgacgccaagttcgaaaaacagctcggacagatcatgcttctgattttgtgtaccagccaaatcctgctcatgcgaacaacttgggcactgtgcgagtccataaccttagctacaggcccccttaccactctgtgggagggttctccagggaagttttggaatacgacaattgccgtctcaatggcgaacatcttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtattatggaggttgaccgttccgaagcaaaagaggggctgaagaggggagagacaactaaatacgctgtgagtcggggcaccgccaagttgcgctggttcgtcgaacgaaatctggtgaaacctgagggtaaggtaatcgatctcggctgtgggagaggaggctggagctattactgcgccgggttaaagaaagtgacagaagttaagggatacacgaaaggcggtcccgggcacgaggaaccgataccaatggcgacctatggatggaacctggtgaaacttcactctggcaaagacgtctttttcgtgcctcccgagaagtgtgatactctgctatgcgacatcggcgagtcctcaccaaatcccacaattgaagaggggaggaccctccgggtcctgaaaatggtggaaccttggttgcgcggaaaccaattttgtatcaagattctgaatccgtacatgcccagcgttgtagagactctcgagcagatgcagagaaagcatggtggcatgcttgtgaggaacccactgtcgcgaaattctacacacgaaatgtattgggtcagttgcgggaccggaaacatcgtgtccgctgttaatatgacgagccggatgttactgaaccgtttcaccatggcacatagaaaacctacatacgagcgcgatgtggacttgggcgccggtactaggcacgtcgctgtggaacccgaggtagccaacctcgatattatcgggcagcggatagaaaatattaagcacgagcataaatcaacctggcactatgacgaggataacccttacaagacatgggcatatcatggatcctacgaagtgaaaccatctggcagcgccagttccatggttaatggcgtcgtgaagctgctaactaagccctgggacgtgatccctatggtcacccaaatcgctatgacagataccactccatttgggcagcagagagttttcaaagagaaggtggacacgcgcacacccaaagcgaagaggggaaccgcccaaattatggaagtaactgcaaaatggctttggggttttctgagccgaaacaagaagccgcggatatgtaccagagaggagttcacaaggaaagtgcgctctaatgctgccatcggcgcagtctttgtggacgagaaccagtggaactcagccaaggaggctgttgaagatgagcgtttctgggacctcgtgcaccgggaaagagagctgcataaacaggggaagtgcgccacgtgcgtctacaacatgatgggaaaaagggaaaagaagttgggcgagtttggtaaagcgaaggggagtcgcgcaatttggtatatgtggctgggagcccgattcctcgagttcgaagctcttggctttatgaatgaggatcactggttctcccgggaaaacagcctgtctggcgtggagggggagggattacacaaactgggttacatcttgagagacatttcgaagatccctggcgggaatatgtatgccgatgacaccgcaggatgggatactaggataacagaagacgatctccagaacgaggctcgcatcaccgacattatggaaccagagcatgccctgctagctaaatcaatctttaaacttacttaccaaaataaagtagttagagtgcagcggcccgccaagaacggcacagtcatggatgtgattagcaggcgtgaccagcgaggttccggacaggtgggaacctatggcctgaatacattcactaacatggaagcacaactcatccgccagatggagagtgagggcatattttctcctagcgaactggagaccccaaacttggcggaaagagtcttagattggctggagaagtacggggttgaacggctcaaaaggatggccatttccggagacgactgtgtggtaaagcccatcgatgaccgcttcgctacggcccttaccgcactgaatgatatgggtaaagtgagaaaggacatcccgcagtgggagccttcaaaaggctggaacgattggcagcaagtccccttttgcagtcaccatttccaccagctaattatgaaggacgggcgggagatagtggttccatgtaggaatcaggatgaactggtgggacgagctcgtgtctctcagggcgccggttggagcctcagagagacagcatgcttggggaagtcctatgcccaaatgtggcagctgatgtactttcaccgccgggaccttaggctggcggctaacgccatctgttcagcagtgcctgtagattggattcccactagcagaaccacatggtctatccatgcccaccatcagtggatgactaccgaagacatgctctccgtttggaatcgcgtgtggattgaggaaaacccatggatggaggataaaacgcacatcagtagctgggaggacgtcccctacttaggaaagcgggaagaccaatggtgcggctcgctgataggcttgacagctagggccacctgggcaactaatatccaggtggctattaaccaggttcgaagactgatcgggaatgagaactatctcgattacatgacatccatgaaacggttcaagaatgaatctgaccctgagggagccctttggtga

SEQ ID NO: 14099 - RNA, 9879 nt, synthetic construct
  misc_feature 1..9879: note = derived and/or modified CDS sequence (opt3) from DENV-1__JQ045652__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatggttctctcaattgtgagcctgttccccttgtgtctgagtacgacatctcagaagaccacttggttaccggtcctcctgggctcccttgggtgcaagcctctgacaatgtttttgatcgctgagaataaaatatggggaaggcgaagctggccactcaacgaaggtatcatggccgtaggcattgtgtcgatcctgctatcatctctgcttaagaacgatgttcccctcgccgggcctctgattgctggaggcatgttgatcgcatgttacgtgataagtggttccagcgccgacttatctctggagaaagcggctgaggtcagctgggaagaggaagccgagcattccggggcatcacacaatattctcgtggaagtacaggatgacggaaccatgaagatcaaagatgaggagcgcgacgatactctgacaatccttctgaaggccaccttgctagctgtgagtggcgtctatcccctgagcattccagcaacactcttcgtttggtacttctggcagaagaagaagcagcggtctggcgtgctgtgggacactccttcacccccagaagtggagagagccgtccttgatgacgggatatataggatcatgcagcgtggattactgggtcgcagccaggtgggcgttggggtatttcaagaaaacgtgttccataccatgtggcacgtcacacggggagcggtgctcatgtaccagggcaaaagattggagccgagttgggctagcgttaagaaagacctgatttcctacggtgggggatggaggctccagggctcttggaataccggcgaggaagtgcaggtcatcgccgtggagcctgggaagaaccccaaaaatgtacaaacagcaccaggaacttttaagacccccgaaggtgaggtcggcgccattgctctggatttcaagcctgggacgtcgggaagcccaatcgtgaaccgagaaggcaaaatagttggtctttatgggaatggagtggtcacaacttcaggcacctacgtgtccgccatcgcacaggctaaggccagtcaggagggccccctgcctgagattgaagacgaggtttttcggaaacgcaacttgacaatcatggatctacacccggggtctggaaagaccagaaggtatctgccagcgattgtgcgggaagccatcaaacgaaagctcagaactttaatactggcacccacccgcgtcgtggctagcgagatggccgaagctcttaagggtatgcctattaggtaccaaacaacggcagtaaaatccgagcatactggcaaggagatcgtggacctgatgtgccacgccaccttcacaatgcgtctcttgtcaccagttcgggtccccaattataacatgatcattatggatgaagcccattttaccgacccttctagcatcgctgcgagagggtacataagtactagggtgggaatgggcgaggcagccgctattttcatgacagccaccccgcccggttccgtggaagcatttccacagagcaatgccgtcatccaggatgaggaacgcgacattcctgagcgatcttggaactcagggtatgagtggatcacggatttccccggaaaaactgtatggtttgtgccatccataaagagtggcaatgacattgctaactgtctgaggaaaaatggcaagcgggttatccagctcagcaggaagacattcgataccgaataccagaaaaccaagaacaacgactgggactacgtggtcactacagatatctcggagatgggggcgaatttccgcgccgaccgtgtgattgatcctagacggtgcctgaaacccgttatccttaaggacggaccagaaagggtgattctagcaggtccgatgcctgtcaccgtggcttctgccgcacagcgccgaggcagaatagggcggaaccacaataaagagggagatcagtatatctacatgggccagcccctgaacaatgacgaggatcatgcccactggacagaagctaagatgttgttagacaacattaatactccagagggtatcatccccgccctgtttgaacctgagagggaaaagtccgcggcaattgatggggagtatcgcctcagaggcgaggccaggaaaacgttcgtagaactgatgcggcgtggagaccttccagtgtggctgagctacaaggttgcttcagagggctttcaatatagtgatcgccgatggtgcttcgacggggaaagaaacaatcaggtcctcgaggaaaacatggatgtggagatatggaccaaagagggagaaaggaagaaattgcggccccgctggctggacgccagaacatactctgaccctctagctctgagggagtttaaggagttcgcagccggtcggcgatccgtgagcggcgatctcatccttgagattgggaaactgccgcagcacttaactcagagagctcaaaatgccttggacaacctggtcatgctccataattcagaacagggaggccgcgcatataggcacgcgatggaggagctgccagataccatcgaaacacttatgctgctcgccttgattgctgttctgaccggtggggtgactttatttttcctaagtggccggggactgggcaagacgagcatcgggctcctttgtgtaatggcctcctctgtgctgttgtggatggcaagcgtcgagccccattggatagctgcctccatcattctggaatttttcctcatggtgctgcttatccctgagcccgaccgtcagagaaccccacaggataaccaactcgcatacgttgtgattggactgttgtttatgatcctgacagtcgccgctaatgagatgggtttactagaaactaccaagaaagacctgggcatagggcacgtagcggtggagaaccaccatcacgccgcaatgctcgatgttgaccttcatcctgcttcagcctggacactgtacgccgtggcaaccactattatcacacccatgatgaggcacacgattgaaaacaccactgctaatatctctttgacagccatagcgaaccaggctgccatcctgatgggactcgataagggctggccaattagtaaaatggacatcggtgtccctctgcttgcattagggtgctatagccaggtgaatccgctgaccctcaccgccgctgtcttgatgctggtggcacattacgccattatcggccccggactacaagcgaaggctacacgcgaggcccagaaacggactgcagccggcataatgaagaacccaacggttgatgggattgtggctatcgacctggatcctgtagtgtatgacgccaagttcgaaaaacagctcggacagatcatgcttctgattttgtgtaccagccaaatcctgctcatgcgaacaacttgggcactgtgcgagtccataaccttagctacaggcccccttaccactctgtgggagggttctccagggaagttttggaatacgacaattgccgtctcaatggcgaacatcttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtattatggaggttgaccgttccgaagcaaaagaggggctgaagaggggagagacaactaaatacgctgtgagtcggggcaccgccaagttgcgctggttcgtcgaacgaaatctggtgaaacctgagggtaaggtaatcgatctcggctgtgggagaggaggctggagctattactgcgccgggttaaagaaagtgacagaagttaagggatacacgaaaggcggtcccgggcacgaggaaccgataccaatggcgacctatggatggaacctggtgaaacttcactctggcaaagacgtctttttcgtgcctcccgagaagtgtgatactctgctatgcgacatcggcgagtcctcaccaaatcccacaattgaagaggggaggaccctccgggtcctgaaaatggtggaaccttggttgcgcggaaaccaattttgtatcaagattctgaatccgtacatgcccagcgttgtagagactctcgagcagatgcagagaaagcatggtggcatgcttgtgaggaacccactgtcgcgaaattctacacacgaaatgtattgggtcagttgcgggaccggaaacatcgtgtccgctgttaatatgacgagccggatgttactgaaccgtttcaccatggcacatagaaaacctacatacgagcgcgatgtggacttgggcgccggtactaggcacgtcgctgtggaacccgaggtagccaacctcgatattatcgggcagcggatagaaaatattaagcacgagcataaatcaacctggcactatgacgaggataacccttacaagacatgggcatatcatggatcctacgaagtgaaaccatctggcagcgccagttccatggttaatggcgtcgtgaagctgctaactaagccctgggacgtgatccctatggtcacccaaatcgctatgacagataccactccatttgggcagcagagagttttcaaagagaaggtggacacgcgcacacccaaagcgaagaggggaaccgcccaaattatggaagtaactgcaaaatggctttggggttttctgagccgaaacaagaagccgcggatatgtaccagagaggagttcacaaggaaagtgcgctctaatgctgccatcggcgcagtctttgtggacgagaaccagtggaactcagccaaggaggctgttgaagatgagcgtttctgggacctcgtgcaccgggaaagagagctgcataaacaggggaagtgcgccacgtgcgtctacaacatgatgggaaaaagggaaaagaagttgggcgagtttggtaaagcgaaggggagtcgcgcaatttggtatatgtggctgggagcccgattcctcgagttcgaagctcttggctttatgaatgaggatcactggttctcccgggaaaacagcctgtctggcgtggagggggagggattacacaaactgggttacatcttgagagacatttcgaagatccctggcgggaatatgtatgccgatgacaccgcaggatgggatactaggataacagaagacgatctccagaacgaggctcgcatcaccgacattatggaaccagagcatgccctgctagctaaatcaatctttaaacttacttaccaaaataaagtagttagagtgcagcggcccgccaagaacggcacagtcatggatgtgattagcaggcgtgaccagcgaggttccggacaggtgggaacctatggcctgaatacattcactaacatggaagcacaactcatccgccagatggagagtgagggcatattttctcctagcgaactggagaccccaaacttggcggaaagagtcttagattggctggagaagtacggggttgaacggctcaaaaggatggccatttccggagacgactgtgtggtaaagcccatcgatgaccgcttcgctacggcccttaccgcactgaatgatatgggtaaagtgagaaaggacatcccgcagtgggagccttcaaaaggctggaacgattggcagcaagtccccttttgcagtcaccatttccaccagctaattatgaaggacgggcgggagatagtggttccatgtaggaatcaggatgaactggtgggacgagctcgtgtctctcagggcgccggttggagcctcagagagacagcatgcttggggaagtcctatgcccaaatgtggcagctgatgtactttcaccgccgggaccttaggctggcggctaacgccatctgttcagcagtgcctgtagattggattcccactagcagaaccacatggtctatccatgcccaccatcagtggatgactaccgaagacatgctctccgtttggaatcgcgtgtggattgaggaaaacccatggatggaggataaaacgcacatcagtagctggggagacgtcccctacttaggcaagcgggaggaccaatggtgcggctcgctgatagggttgacagctagggccacctgggcaactaatatccaggtggctattaaccaggttcgaagactgatcggaaatgaaaactatctcgattacatgacatccatgaaacggttcaagaatgagtctgaccctgaaggtgccctttggtga

SEQ ID NO: 14100 - RNA, 9879 nt, synthetic construct
  misc_feature 1..9879: note = derived and/or modified CDS sequence (opt3) from DENV-1__JQ045653__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaacatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaactttggtggatagaggctggggtaatgggtgtggactctttggcaaaggctccctgataacctgcgcaaagttcaagtgcgtaacaaaattagaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagctcactgactacggggcgcttacactggattgtagcccaaggacgggattggactttaacgaaatggtcctactgaccatgaaggagaaatcttggctcgtgcataagcagtggttcctggatcttccgctgccctggacttccggcgcctcaacaagccaagagacctggaatcggcaggacttgctcgtaacatttaaaactgcacacgctaagaagcaggaagttgtggtcctgggtagtcaagagggggccatgcacaccgctttaacgggcgccaccgaaatccagacatctggaactaccacaattttcgcaggccatctgaaatgccgtctaaagatggataaactcactctgaaggggatgtcctatgtgatgtgtaccggtagctttaaacttgagaaggaattggccgagacgcagcacggaacagtcctggtgcagataaagtacgagggcaccgacgctccttgcaaaatcccattctcgactcaagatgaaaagggggttacacagaacggacgcctcattaccgcgaatcccatcgtgactgacaaagagaagcctgtaaacatagaagcagagccacccttcggcgagtcttatattgtcatcggtgccggggaaaaagctctgaaactttcctggtttaagaaaggctcaagtatcggaaagatgttcgaggccaccgcaagaggcgccaggcggatggctattctgggggatacagcctgggactttggaagcatcggtggcgtgttcacgtccgttgggaaattggtgcatcagatttttggaaccgcatacggcgtcctcttctctggtgtgagctggactatgaagatagggatcggcgtactgttaacatggctgggactaaattcacgaagtacctccctcagcatgacatgtattgcggtgggcctggttactctttacttgggggtcatggtgcaggctgattctggatgcgtgatcaactggaaaggccgcgaactgaagtgtggttcagggatctttgtcaccaatgaggttcacacgtggacagaacaatataagttccaggccgacagtccgaaaagactcagcgcagccattggaaaggcttgggaggagggcgtgtgcggtataaggtccgccacccggctggaaaacatcatgtggaaacagatttctaacgagttaaatcatatcctgcttgaaaacgacatgaagtttactgtggtagtcggcgatgtggcagggattttggctcagggcaagaagatgatccgccctcaacccatggagtacaaatattcgtggaaaagctggggcaaggccaagataatcggggcggacgttcagaataccacattcattatcgatggaccaaacactcctgaatgtcccgacgatcagagagcctggaatatttgggaggtggaggactacggctttggtatcttcaccacaaacatatggctcaagctgagggattcctatacgcaggtctgcgaccaccgtctaatgtcagctgcaattaaagatagtaaggccgtgcacgctgacatggggtactggatcgaatctgagaaaaatgaaacctggaagctggcccgggcatcctttattgaggttaagacttgtatctggccacgatcccatacactctggtcaaacggagtgctggaaagcgagatgataatccccaaaatttatggcggtcctatctctcaacacaattacagaccaggctacttcacccagactgcggggccgtggcatcttggaaagttggagctggatttcgacttatgcgaaggcacaaccgtagtcgtggatgagcactgcgggaacaggggaccctccctccgcacgactaccgtgacaggcaaaattatccacgaatggtgttgccggagttgtaccctgcctccacttagatttaggggtgaggacgggtgctggtatggaatggagatacgccccgtcaaggaaaaagaggaaaatctggttaagagcatggtgtctgccggctccggtgaggtagactcattcagtttgggcctcctgtgtattagcatcatgatcgaagaggtgatgcgatcgcggtggtccaagaaaatgctaatgactgggacactggctgtctttttcctcctgattatgggacagcttacctggaacgatttgatccgtctgtgcattatggtgggcgccaatgcatctgacagaatggggatgggaacaacttacttagctctcatggccacctttaagatgaggcctatgttcgcagttggcctgctttttcgccggctgacgagcagagaggtgctactcctgacaataggtttgtcactggtcgccagtgtggaattaccaaactccctcgaggaactgggggatggacttgctatgggcatcatgattctgaaattgctcaccgacttccaatctcatcagctgtgggcgactctactgagccttacctttatcaagacaactttctccctccactgtgcctggaaaaccatggcaatgattctgtcaatcgttagcttgtttcccctgtgcttaagtacgacatctcagaagaccacttggctcccggtgctgcttggctccctggggtgtaagcctttgacaatgttcctcatagctgagaataaaatctggggaaggcgaagctggccactgaacgaaggtattatggccgtcggcatcgtatcgattctactgtcatctcttctcaagaacgatgtgcccctggccgggcctttgatcgctggaggcatgttaatagcatgctatgttattagtggttccagcgccgacctgtctctcgagaaagcggctgaggtgagctgggaagaggaagccgagcattccggggcatcacacaatatcctggtcgaagtgcaggatgacggaaccatgaagatcaaagatgaggagcgcgacgatactcttacaattctgttgaaggccaccctactggctgtaagtggcgtgtaccccctcagcataccagcaacgctgtttgtctggtatttctggcagaaaaagaagcagcggtctggcgttctttgggacactccttcacccccagaagtggagagagccgtgttagatgacgggatctacaggattatgcagcgtggactgctcggtcgcagccaggtcggcgtgggggttttccaagaagacgtatttcataccatgtggcacgtgacacggggagcggtcttgatgtatcagggcaaaagactggagccgagttgggctagcgtgaagaaagatctcatctcctacggtgggggatggaggctgcagggctcttggaacaccggcgaggaagttcaggtgattgccgtcgagcctgggaagaatcccaaaaacgtgcaaacagcaccaggaactttcaagacccccgaaggtgaggtaggcgccatcgctcttgactttaagcctgggacgtcgggaagcccaatagtcaatcgagaaggcaaaatcgtgggtctgtacgggaacggagttgtgacaacttcaggcacctatgtctccgccattgcacaggctaaggccagtcaggagggccccttgcctgagatcgaagatgaggtgttccggaaacgcaatctaacaattatggacctgcacccggggtctggaaagaccagaaggtacctcccagcgatcgttcgggaagccataaaacgaaagttaagaactctgattcttgcacccacccgcgtggtcgctagcgagatggccgaagctctgaagggtatgcctatcaggtatcaaacaacggcagtgaaatccgagcatactggcaaggagatcgtagatctcatgtgtcacgccacctttacaatgcgtttgctgtcaccagtgcgggttcccaactacaatatgattatcatggacgaagcccatttcaccgatccttctagcatagctgcgagagggtatattagtactagggtcggaatgggcgaggcagccgctatctttatgacagccaccccgcccggttccgtggaagcattcccacagagcaacgccgtgattcaggacgaggaacgcgatatccctgagcgatcttggaactcagggtacgagtggataacggactttcccggaaaaactgtctggttcgtaccatccattaagagtggcaacgatatcgctaattgcctcaggaaaaatggcaagcgggtgatccagctgagcaggaagacatttgacaccgaatatcagaaaaccaagaataacgactgggattacgttgtgactacagacatttcggagatgggggcgaacttccgcgccgatcgtgtcatcgaccctagacggtgccttaaacccgtgattctaaaggatggaccagaaagggttatactggcaggtccgatgcctgtgaccgtcgcttctgccgcacagcgccgaggcagaatcgggcggaatcacaacaaagagggagaccagtacatttatatgggccagcccttgaataacgatgaggaccatgcccactggacagaagctaagatgttactggataatatcaacactccagagggtatcattcccgccctcttcgaacctgagagggaaaagtccgcggcaatagacggggagtaccgcctgagaggcgaggccaggaaaacgtttgtggaacttatgcggcgtggagatctgccagtatggctcagctataaggtggcttcagagggcttccaatacagtgaccgccgatggtgttttgatggggaaagaaataaccaggttttggaggaaaatatggacgtcgagatctggaccaaagagggagaaaggaagaaactgcggccccgctggctagacgccagaacatattctgatcctctggctctcagggagttcaaggaatttgcagccggtcggcgatccgtgagcggcgaccttattctggagatcgggaaattaccgcagcacttgactcagagagctcaaaacgccctggataatctcgtgatgctgcataactcagaacagggaggccgcgcatacaggcacgcgatggaggagcttccagacaccattgaaacactgatgctcttggccctgatcgctgtcttaaccggtggggttactctattctttctgagtggccggggactcggcaagacgagcatagggcttctgtgcgtgatggcctcctctgtattgctgtggatggcaagcgtggagccccattggatcgctgcctccattatcctcgagttctttctgatggtccttctcattcctgagcccgatcgtcagagaaccccacaggacaatcaactggcatatgtggttatcggattgctgttcatgatattaacagtggccgctaacgagatgggtctactggaaactaccaagaaagatctcggcattgggcacgtcgcggtagagaatcaccatcacgccgcaatgcttgacgtggatctgcatcctgcttcagcctggacattgtacgccgttgcaaccactatcattacacccatgatgaggcacacgatcgaaaacaccactgctaacatatctctgacagccatcgcgaatcaggctgccattctcatgggactggacaagggctggccaatcagtaaaatggatattggtgtgcctcttttagcactggggtgttactcgcaggtcaacccgctcaccttgaccgccgctgtgctgatgctagtcgcacattatgccatcataggccccggactgcaagcgaaggctacacgcgaggcccagaaacggactgcagccggcattatgaagaatccaacggtggacgggatcgttgctatcgatctcgaccctgtggtatacgacgccaagtttgaaaaacagcttggacagattatgctgttgatcctgtgcaccagccaaatactcctgatgcgaacaacttgggcattatgtgagtccattacccttgctacaggccccctgaccactctctgggagggttctccagggaagttctggaacacgacaatcgccgtgtcaatggcgaatatttttagaggaagctatctagccggcgcaggtctggctttctccttgatgaaaagtctgggcgggggaaggcgcggcaccggggcccagggagaaactctcggcgagaagtggaaacggcagcttaaccagctgtctaagagcgagttcaatacctacaagagatcaggtatcatggaggtcgatcgttccgaagcaaaagaggggttgaagaggggagagacaactaaacacgctgttagtcggggcaccgccaagctgcgctggtttgtggaacgaaacctcgtcaaacctgagggtaaggtgatagacttaggctgcgggagaggaggctggagctattactgtgccgggctgaagaaagtaacagaagtgaagggatatacgaaaggcggtcccgggcacgaggaaccgatcccaatggcgacctacggatggaatcttgttaagctgcattctggcaaagatgtgttctttattcctcccgagaagtgcgacactctactctgtgatatcggcgagtcctcaccaaaccccacaattgaagaggggaggaccctgcgggtcttgaaaatggtggaaccttggctgcgcggaaatcaattctgcatcaagattctcaacccgtacatgcccagcgtcgtggagactcttgagcagatgcagagaaagcacggtggcatgctggttaggaatccattatcgcgaaactctacacatgaaatgtattgggtaagttgtgggaccggaaatatcgtgtccgctgtcaacatgacgagccggatgctgttgaatcgttttaccatggcacacagaaaacctacatacgagcgcgacgtggatctcggcgccggtactaggcacgttgctgtggaacccgaggtcgccaacctggacataattgggcagcggatcgaaaacatcaagcatgagcacaaatcaacctggcattatgatgaggacaatccttacaagacatgggcatatcacggatcctacgaagtgaaaccatctggcagcgccagttccatggtaaacggcgtggttaagctacttactaagccctgggatgtcattcctatggtgacccaaatagctatgacagacaccactccattcgggcagcagagagtgtttaaagagaaggtcgacacgcgcacacccaaagcgaagaggggaaccgcccaaatcatggaagttactgcaaaatggctgtggggtttcctcagccgaaataagaagccgcggatttgcaccagagaggaatttacaaggaaagtgcgctctaacgctgccatcggcgcagtattcgtggatgagaatcagtggaactcagccaaggaggctgtcgaagacgagcgtttttgggatctggtgcatcgggaaagagagttgcacaaacaggggaagtgcgccacgtgtgtttataatatgatgggaaaaagggaaaagaagctgggcgagttcggtaaagcgaaggggagtcgcgcaatttggtacatgtggctcggagcccgatttcttgagttcgaagctctgggcttcatgaacgaggaccactggttttcccgggaaaatagcttatctggcgtggagggggagggactgcataaattgggttacatcctcagagatatatcgaagatccctggcgggaacatgtatgccgacgataccgcaggatgggacactaggattacagaagatgacctgcagaatgaggctcgcatcaccgatattatggaaccagagcacgccctacttgctaaatcaatcttcaagctgacttaccaaaacaaagtcgtgagagtacagcggcccgccaagaatggcacagttatggacgtgataagcaggcgtgatcagcgaggttccgggcaggtcggaacctatggcctcaacacatttactaatatggaagcacaactgattcgccagatggagagtgagggcatcttctctcctagcgaattggagaccccaaacttagcggaaagagtgctggactggctcgagaagtacggggtggaacggcttaaaaggatggccatctccggagacgattgcgtcgttaagcccattgacgatcgctttgctacggccctgaccgcactaaacgacatgggtaaagtgagaaaggatataccgcagtgggagccttcaaaaggctggaatgactggcagcaagtacccttctgtagtcatcactttcaccagctgatcatgaaggatgggcgggagattgtggtcccatgcaggaaccaggacgaactcgtgggacgagctcgtgtttctcagggcgccggttggagcttgagagagacagcatgtctggggaagtcctatgcccaaatgtggcagcttatgtacttccatcgccgggatctgaggctcgcggctaatgccatctgctcagcagtgcctgtcgactggattcccactagcagaaccacatggtctatccacgcccatcaccagtggatgactaccgaagatatgttatccgtgtggaaccgcgtatggatagaggaaaatccatggatggaggacaaaacgcatatcagtagctggggagacgttccctatctgggcaagcgggaggatcaatggtgtggctcgttgattgggctgacagctagggccacctgggcaactaacatccaggtggctattaatcaggtccgaagactcatcggaaacgaaaattaccttgactacatgacatccatgaaacggtttaagaacgagtctgatcctgaaggtgccctgtggtga

SEQ ID NO: 14101 - RNA, 9879 nt, synthetic construct
  misc_feature 1..9879: note = derived and/or modified CDS sequence (opt3) from DENV-1__JQ045657__SS-prME
  source 1..9879: mol_type = other RNA
agcgtgaccatgctgctaatgcttatgcccacagcactggctttccacttgactacgcgaggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctacgacacggttggaaaacatcatgtggaagcagatttcgaacgagctgaatcatatcctcctggaaaacgacatgaaatttaccgtagtcgtgggcgatgttgcagggattttagctcagggaaagaaaatgatccgccctcagcccatggagtacaagtatagctggaagtcctggggcaaagccaagataatcggggcggacgtgcaaaatactaccttcattatcgatggaccaaacacacctgaatgtcccgacgatcagagagcctggaatatttgggaggtcgaggactacggctttggtatcttcactaccaacatatggctgaaacttagggattcatatacacaggtgtgcgaccaccgtttgatgagtgctgcaattaaggattctaaagccgttcacgctgacatggggtactggatcgaaagcgagaagaatgaaacgtggaagctcgcccgggcatccttcattgaggtgaaaacctgtatctggccaaagtcacatactctgtggagcaacggagtactagaatctgagatgataatccccaaaatttatggcggtcctatctcccagcacaattaccgaccaggctactttacacaaaccgcggggccgtggcatctgggaaagctcgagctggatttcgacctttgcgaaggcactacagtcgtggtggatgagcactgcgggaacagaggacccagtttgaggaccacgactgtcaccggcaaaattatccacgaatggtgttgccgcagctgtacactgcctccattacggtttaagggtgaggacgggtgctggtatggaatggagataagacccgttaaggaaaaagaggaaaatctcgtgaagtctatggtatccgccggctcaggtgaggtggacagtttcagcctgggccttctgtgtatttcgatcatgatcgaagaggtcatgaggtcccgctggtctcgaaaaatgttgatgaccgggactctcgctgtgtttttcctgctaattatgggacagctgacatggaacgatctcatccggctgtgcattatggttggcgccaatgcaagcgaccgtatggggatgggaaccacataccttgctttgatggccacttttaagatgagacctatgttcgcagtgggcctgttatttaggcgcctcacctcacgggaggtcctgcttctgacgataggtctaagtctcgtggcctccgttgaactgccaaactctttggaggaactgggggatggattagctatgggcatcatgattctcaaactgcttacagacttccagagccatcaactgtgggcgaccttgctctccctgacttttatcaagaccacattctcactacactatgcctggaagactatggcaatggtgctgagcattgtcagtctttttcccctctgtctgtctaccacgtcccagaaaacaacctggttgccggtactgttaggcagcctcgggtgcaagcctctgactatgttccttatcgctgagaataaaatatggggaagaaagtcgtggccactgaacgaaggtatcatggccgtgggcattgtttcaatcttgctctctagtctgctcaagaatgatgtgcccctggccgggcctcttattgctggaggcatgctcatcgcatgttacgtcatatccggtagctctgccgacctgagcttggagaaggcggctgaggtgtcctgggaagaggaagccgagcattcaggggcaagtcacaatattttagtagaagtgcaggatgacggaacaatgaaaatcaaggatgaggagagggacgataccctgactatcctcctgaaggccacacttctggctgtcagcggcgtttatcccttgtctattccagcaaccctattcgtgtggtacttttggcagaaaaagaaacaacgatccggcgtgctgtgggacacgccttcacccccagaagtcgagcgcgccgtgctcgatgacgggatatatcggatcatgcagagaggactgcttggtaggagtcaggttggcgtaggggtgttccaggaaaacgtctttcatactatgtggcacgtgacccgtggagcggttttaatgtaccaaggcaagcgcctggagccgagctgggcttccgtgaaaaaggacctcatttcttacggtgggggatggcggttgcagggctcgtggaatacaggcgaggaagtccaggtgatcgccgtagagcctgggaagaaccccaaaaatgtccagaccgcaccaggaacattcaagactagcgaaggtgaggtgggcgccattgctctggattttaaacccgggacctcaggatcccctatcgttaacagagaaggcaagatagtgggtctctatgggaatggagtcgtgacgacaagtggcacttacgtttctgccatcgcacaagctaaagccagccaggagggcccactgcccgagattgaagacgaggtgttcaggaagcgaaaccttaccatcatggatctgcaccctgggtccggaaagacacggcgctatttgccggcgattgtcagagaagccatcaaaaggaagctacggaccctgatactcgcaccaactcgagtggtagcttcagagatggccgaggctttaaaaggtatgcccattagataccagaccacagcagtgaagtctgagcatacgggcaaagagatcgttgacctgatgtgccacgccacttttaccatgcgccttctgagccctgtcagggtgccaaattataacatgatcattatggatgaagcccatttcacagaccccagttccatcgctgcgcgtgggtacataagcacccgggtgggaatgggcgaggcagccgctatttttatgactgccacacctccgggttctgtcgaagcattcccccaatcaaatgccgtaatccaggatgaggaaagagacattccagagaggtcctggaacagtgggtatgagtggatcaccgattttcctggaaagacggtgtggttcgttcccagcataaagtcgggcaatgacattgctaactgtctccgcaaaaatggcaagcgagtgatccagttgtctagaaaaactttcgatacagaataccagaagaccaaaaacaacgactgggactacgtcgtgaccactgatatctccgagatgggggcgaattttcgggccgacagggttattgatccacgccgttgcctgaagcctgtgatcctcaaggacggacccgaaagagtcattctggcaggtccaatgccggtgacagtagctagcgccgcacaacggaggggccgcatagggcgaaaccacaataaagagggagatcagtatatctacatgggccagcctcttaacaatgacgaggatcatgcccactggaccgaagctaagatgctactggacaacattaatacacccgagggtatcatcccagccttgttcgaacccgagagagaaaaatcagcggcaattgatggggagtatcggttaaggggcgaggcccgcaagacttttgtggaactgatgagaaggggagacctccctgtttggctgagttacaaagtcgcttctgagggcttccagtattccgatcggcgttggtgctttgacggggaacgcaacaatcaagtgcttgaggaaaacatggatgtggagatatggacgaaggagggagaaagaaagaagctgagaccaaggtggctcgacgcccggacctacagcgaccccttggctctgcgcgagttcaaggaatttgcagccggtagaaggtcagtcagtggcgatctaatcctggagattgggaaactccctcagcaccttacacagcgggctcagaatgccctggacaacttagttatgttgcataatagcgaacaaggaggccgagcatatagacacgcgatggaggagctgccggatactatcgaaaccctcatgctgcttgccctgattgctgtgctcacaggtggggtaaccttgttctttctgtccggccgcggattaggcaagacttctatcgggctactgtgtgtgatggccagctccgtcctcctttggatggcatcagtggagccacattggatagctgcctctatcattctggagttctttttgatggttctgctcatccccgagcctgacaggcagcggacgccccaggataaccagctggcatacgtggtcattggacttctcttcatgatcctgaccgtagccgctaatgagatgggtttgctggaaacaactaaaaaggacttaggcatagggcacgtggcggccgagaaccaccatcacgcagctatgctagatgttgacctgcatccagccagtgcctggaccctctacgcagtggctacaaccattatcactcctatgatgcgtcacacaattgaaaacacgaccgccaatatctcgcttactgcgatagctaaccaagccgcaatcctgatgggattggataaaggctggcccattagcaagatggacatcggtgtcccactgctcgccctggggtgctattcccaggtgaatcctcttacattaaccgctgcagtcctgatgctcgtggcccattacgcgattatcggcccgggattgcaggctaaggccaccagagaggcacagaaaaggacagccgctggcataatgaagaaccccactgttgatgggattgtggccatcgacctggatccagtagtgtatgacgcaaaatttgaaaagcagctaggacagatcatgctgctcattctttgtacgtctcagatcctgttgatgcgcaccacatgggctctgtgcgagtcaataactctcgccaccggccctctgacaaccttatgggagggtagccccgggaaattctggaatactacgattgcggtctccatggccaacatcttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtattatggaggttgaccggagcgaagctaaggaggggctcaaaagaggagagaccacaaagcacgccgtgtctcgtggcactgccaaacttaggtggtttgtcgaacggaatctggtgaaaccagagggtaaggtaatcgatttgggctgtgggcgcggaggctggtcctactattgcgcggggctgaaaaaggtgaccgaagttaaaggatacacaaagggcggtcctgggcacgaggaacccataccgatggctacgtacggatggaacctcgtgaaattacattcaggcaaggacgtcttctttgtgccacctgagaagtgtgataccctgctttgcgacatcggcgagagctcgcccaatccaactattgaagaggggcgaacactgagagtcctaaaaatggtggaaccctggctcaggggaaaccagttctgtatcaagattctgaatccttatatgccgtctgttgtagagaccttggagcaaatgcagcggaaacacggtggcatgctggtgcgcaaccccctcagtagaaattccactcatgaaatgtactgggtcagctgcgggacaggaaacatcgtgtcagcagttaatatgacctccaggatgcttctgaaccgatttacgatggcccaccggaagccaacctatgagcgtgatgtggacttaggcgctggtacaagacacgtcgccgtggaacctgaggtagcaaacctggatattatcgggcagcgcatagaaaatattaaacatgagcacaagtctacttggcattacgacgaggataacccctataagacctgggcctaccacggaagctatgaagtgaaacctagtggctccgctagctctatggttaatggcgtcgtgaagttgctcacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctgtggggtttcctatcacgcaacaagaaacccaggatatgtactcgagaggaatttacccggaaggtgagaagtaatgccgcaatcggcgccgtcttcgtggacgagaaccaatggaactccgctaaagaggccgttgaagatgagaggttttgggaccttgtgcatcgcgaacgtgagctgcacaagcaggggaagtgcgcgacatgcgtctacaacatgatgggaaaacgggaaaagaaactcggcgagttcggtaaggcaaaagggagcagagccatttggtacatgtggctgggagctaggttcttggagtttgaagccctgggcttcatgaatgaggatcactggttttctcgcgaaaactcgctctcaggcgtggagggggagggacttcataagctgggttatatcttacgagacattagcaaaatcccgggcgggaatatgtacgcagatgacacggctggatgggatacccggataactgaagacgatctgcagaacgaggccagaatcacagacattatggaacctgagcacgctttgctcgccaagtccatcttcaagctgacctatcagaataaagtagttagggtgcaacgcccagcaaagaacggcactgtcatggatgtgattagtagacgggaccagaggggttctggacaggtgggaacatacggcctaaatacctttacaaacatggaagcgcagcttatccgtcaaatggagagcgaggaaatattctccccctcagagctggaaactcctaacctcgccggccgagtcctggattggttggagaaacatggggttgaacgcttaaagagaatggctattagtggagacgactgtgtggtaaaaccaatcgatgaccggtttgccaccgcactgacggctctcaatgatatgggtaaggtgaggaaggacatcccccagtgggagccgtctaaaggctggaacgattggcagcaggtccctttctgcagccaccactttcatcaacttattatgaaggacgggcgcgagatagtggttccctgtagaaatcaggatgaactggtgggacgggccagggtctcccagggcgcaggttggtcactacgagagaccgcctgcctggggaaaagctatgcgcagatgtggcaactcatgtacttccaccgtagagacttgcgcctggctgccaacgcaatctgttctgccgtgccagtagattgggttcctacatcccggactacctggagtattcatgctcaccatcagtggatgacaactgaagacatgcttagcgtgtggaatagggtctggatcgaggaaaacccctggatggaggataagacccacatttcgtcctggggagacgtgccatatctgggcaaaagagaggaccagtggtgcggctctctcatcgggttaacggcccgcgcaacatgggctaccaatatacaagttgccatcaaccaggtgcggaggctgattggaaatgaaaactacttggattacatgacttcaatgaagcgatttaagaatgagagcgaccccgaaggtgcgctgtggtga

SEQ ID NO: 14102 - RNA, 9879 nt, synthetic construct
  misc_feature 1..9879: note = derived and/or modified CDS sequence (opt3) from DENV-1__JQ045659__SS-prME
  source 1..9879: mol_type = other RNA
agcgtgaccatgctgctcatgcttatgcccacagccctggctttccacttgactacgagaggaggggaacctcatatgatcgtctccaagcaggaaaggggaaaatctttactgtttaagacctcagccggtgttaacatgtgcacactgattgccatggacctcggagagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggttgacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggttcgttcaaactggagaaggaagtcgccgagacgcagcacggtacagtgcttgttcagataaagtacgagggcaccgacgctccttgcaaaatcccattctcgactcaagatgaaaagggggcgacacagaacggacgcttgattaccgcaaatcccatcgtgactgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaaccgccagaggcgctaggcggatggccattctgggggatacagcatgggacttcggaagcatcggtggcgtgtttacgtccgttgggaaacttgtgcatcagattttcggaaccgcgtacggcgtcctgttttctggtgtgagctggactatgaagatagggatcggcgtattgctcacatggctgggattaaattcacgaagtacctccctgagcatgacatgtattgctgtgggcctagttactctctacctgggggtcatggtgcaggccgattctggatgcgtgatcaactggaaaggccgcgaacttaagtgtggttcagggatcttcgtcaccaatgaggttcacacgtggacagaacaatataagtttcaggcagacagtccgaaaagattgagcgccgctattggaaaggcctgggaggagggcgtgtgcggtataaggtccgcaacccggctggaaaacatcatgtggaaacagatttctaacgagctcaatcatatcctgttagaaaacgacatgaagttcactgtggtagtcggcgatgtgaccgggattctggctcagggcaagaagatgatccgccctcaacccatggagtacaaatattcgtggaaaagctggggcaaggccaagataatcggggcggacgttcagaatacaacttttattatcgatggaccaaacacccctgaatgtcccgacgatcagagagcctggaatatttgggaggtggaggactacggcttcggtatctttacaacgaacatatggcttaagttgagggattcccacacccaggtctgcgaccaccgtctcatgtcagctgcaattaaagatagtaaggccgtgcatgctgacatggggtattggatcgaatctgagaaaaatgaaacttggaagctggcccgggcatccttcattgaggttaagacatgtatctggccaaaatcccacaccctatggtcaaacggagtgctggaaagcgagatgataatccccaagatttacggcggtcctatctctcaacataattatcgaccaggctacttcactcagacagcggggccgtggcacctcggaaaactggagcttgattttgacttgtgcgaaggcaccacggtagccgtcgatgagcactgcgggaacagaggaccctccctgaggactaccacagtgaccggcaagattatccatgaatggtgttgccgcagttgtactttacctccactccggttcagaggtgaggacgggtgctggtacggaatggagataaggcccgtgaaagaaaaggaggaaaatctggtcaagagcatggtttctgctggctccggtgaggtggactcatttagtcttggcctgttgtgtattagcatcatgatcgaagaggtaatgcgctcgcgatggtcccggaaaatgctcatgacagggaccctggccgtgttctttctactgattatgggacagctcacatggaacgatctgatccgtctttgcattatggtcggcgcaaatgcttctgacagaatggggatgggaactacctatttggccctgatggcaacgttcaagatgaggcctatgtttgccgtgggcttactcttccgccggctgacaagcagagaggttcttctgctaaccataggtctctcactggtggctagtatggaattgccaaactccctggaggaattaggggatggactcgcgatgggcatcatgattctgaaacttctgactgactttcaatctcaccagttgtgggccaccctcctgagcctaacattcatcaagactaccttttccctgcattacgcatggaaaacgatggctatggtcctttcaattgtgagcctcttccccctgtgtttgagtacaacctctcagaagactacatggctgccggttttactcggctccctggggtgcaagcctcttaccatgtttctgatcgccgagaataaaatatggggaaggcgaagctggccattgaacgaaggtatcatggccgtgggcattgtctcgatcctcctgtcatctctactgaagaacgatgtaccccttgctgggcctctcattgcaggaggcatgctgatcgcctgttatgtgataagtggttccagcgcggacttgtctttagagaaagctgccgaggttagctgggaaaaggaggcagaacactccggggcctcacataatattctggtggaggtccaggatgacggaactatgaaaatcaaggatgaagaacgcgacgatacactcaccatcctgcttaaagctacgctgttggcagtgagtggcgtataccccctaagcattccagccactctgttcgtgtggtatttctggcaaaagaagaaacagcggtctggcgtcctctgggacaccccttcacccccagaggttgggagagcggtgctggatgacggaatatacaggatcatgcagcgtggtcttttaggccgcagccaggtgggggtcggagtgtttcaagaaaacgttttccacacaatgtggcacgtaacccggggcgctgtgctgatgtatcagggtaagagactcgagccgagttgggccagcgtcaaaaaggacttgatttcctacgggggaggctggaggctgcagggctcttggaatacaggggaagaggtgcaggttatcgcagtggagcctggcaaaaatcccaagaatgtccaaactgccccaggtacctttaagacgcccgaaggcgaggtgggggctattgccctcgatttcaaacctggaacatcgggcagcccaatcgtaaaccgagaaggtaagatagtcgggctgtacggaaatggcgtggttactacctcaggcacatatgtgtccgcaatcgctcaggccaaagcgagtcaggaggggccccttcctgaaattgaggacgaggtctttcggaagcgcaacctgaccatcatggatttgcatccgggatctggtaaaactagaaggtacctaccagccattgtgcgggaagcaatcaagcgaaagctgagaaccctcatattagctcccacacgcgttgtggccagcgagatggctgaagcactgaaaggcatgcctattaggtatcaaacgactgccgtcaagtccgagcacaccgggaaagaaatcgtggaccttatgtgccatgccacattcaccatgcgtctgctctcaccagtacgggtgcccaattacaacatgatcattatggatgaggctcactttactgacccttctagcatcgcggcaagaggatatataagtacaagggttggcatgggtgaggccgctgccattttcatgaccgcaacgccgcccgggtccgtcgaagcctttccacagagcaatgctgtgatccaggatgaggaacgcgacattcctgagcgatcttggaactcaggatacgaatggatcactgatttccccggcaagacagtgtggtttgtcccatccataaaaagtggcaatgacattgcgaactgtttgagaaagaatgggaagcgggtaatccagctgagcaggaaaaccttcgataccgagtatcaaaagactaaaaacaacgactgggactacgtggttacaaccgatatctcggagatgggagccaatttccgcgcagaccgtgtgattgatcctagacggtgcctcaagcccgtcatcctgaaagacggtccagaaagggtgattcttgctggcccgatgcctgttacagtggcctctgcagcccagcgccgagggagaataggacggaaccataataaggagggcgatcagtacatctatatgggtcagcccctaaacaatgacgaagatcacgctcactggactgaggccaagatgctgttggacaacattaatacgccagaggggatcatccccgcgttatttgaacctgagagggaaaaatccgcagccattgatggcgagtaccgcctgagaggagaagctaggaagaccttcgtcgagctcatgcggcgtggcgacctgccagtgtggcttagctataaagtagcctcagaggggtttcaatacagtgatcgccgatggtgcttcgacggagaaagaaacaatcaggtgctggaggaaaacatggatgttgagatatggacaaaggaaggtgagaggaaaaagctccggccccgctggttggacgctagaacttattctgaccctctggcactaagggagtttaaagagttcgccgctggccggcgatccgtcagcggggatctgatcctcgagattggaaaacttccgcagcatctgacccagagagcccaaaatgcattagacaacttggtgatgctgcacaattcagaacagggcggtcgcgcgtacaggcatgccatggaggaactcccagatacaatcgagaccctgatgcttctggctctcattgccgtgttgactgggggcgtcacgctgtttttcttaagtggacggggcctagggaagaccagcatcggactgctctgtgttatggcatcctctgtgcttctgtggatggctagcgtagagccccactggatagccgcatccatcattttggaatttttcctgatggtgctcctgatccctgagcccgaccgtcagagaacaccacaggataaccaacttgcctatgtcgtgattggtctcctgtttatgatcttgactgttgctgcgaatgaaatgggcctgttagagaccaccaaaaaggacctagggataggacacgtggccgtcgagaaccatcaccatgcagctatgctggatgtagacctccaccctgcctcagcctggaccctttacgcagtggctactacaattatcacgcccatgatgaggcataccattgaaaacactacagccaatatctctctgaccgcgatagctaaccaggccgcaatcttgatgggcctggataaaggttggccaattagtaagatggacatcggggttcctctcctggcccttggctgctacagccaggtgaatccgttaaccctgacagctgcagtcctcatgttggtggcccactatgcgattatcggacccggcctgcaagctaaagccactcgcgaggcacagaagcggacggccgctgggataatgaagaacccaaccgtcgatggaattgtggccatcgacctagatcctgttgtgtacgacgcaaaattcgaaaagcagctgggccagatcatgctccttattctgtgtacaagccaaatcttgctgatgcgaactacctgggctctctgcgagtccataacactggccaccggtcccttaactacgctttgggaagggtctccaggaaaattttggaatacaaccattgcggtatcaatggccaacatcttcagaggcagctatctggcaggagctggcctcgccttctccctaatgaagagtctagggggaggcaggcgcgggactggagcacagggcgagaccttgggtgagaaatggaagcggcagctgaatcagctctctaagagcgaatttaacacatacaaaagatcagggattatggaggtggaccgttccgaagctaaggagggacttaaaaggggcgaaactaccaagcacgccgtcagtcggggtacagccaaactgcgctggttcgttgagcgaaatttggtgaagcctgagggcaaggtcatcgatctggggtgtggaagaggcgggtggagctattactgcgcgggactcaaaaaggtgacggaagtaaaaggctataccaagggtgggcccggacatgaggaaccgataccaatggctacttacggctggaacttagtgaaactgcactctggcaaggacgtatttttcatccctcccgagaaatgtgatacacttctgtgcgacattggggaatcctcaccaaatcccaccatcgaggagggaaggactctacgggtgctcaagatggtcgaaccttggctgcgcggtaaccaattttgtattaagatcttgaatccgtacatgcccagcgtggtcgagacactggaacagatgcagagaaaacatggcgggatgctcgtgaggaacccactttcgcgaaattctacccacgagatgtattgggttagttgcggaacgggcaacattgtatccgcagtgaatatgaccagccggatgctgttaaaccgtttcacaatggcccacagaaagcctacttacgagcgcgatgtcgacctgggtgctgggaccaggcatgtggccgttgaacccgaggtggcaaacttggatatcataggacagcggattgaaaatatcaaacacgagcataagtcaacatggcactatgacgaagataacccttacaaaacttgggcctatcatggctcctacgaggtcaagccatctggcagcgctagttccatggtgaatggggtagtgaagctcctgaccaaaccctgggacgttatccctatggtcacacaaattgcgatgaccgatactacgccatttggacagcagagagtgttcaaggagaaagtggacacacgcacccccaaggccaaaaggggtactgcacaaataatggaagtcaccgctaagtggctatggggctttcttagccgaaacaagcggccgagaatctgtacaagggaggagttcacgcgcaaagttcgttctaatgccgcaattggggccgtgtttgtagacgagaaccagtggaactcagctaaggaagccgtggaggatgagcggttctgggacctggtccacagagaaagggagctccacaaacagggaaagtgcgcgacctgcgtgtataacatgatgggcaaacgcgaaaagaagctgggtgagtttgggaaagcaaagggaagtcgagccatctggtacatgtggttgggcgctcggttcctggagttcgaggccctcggctttatgaatgaggatcattggttctccagagaaaacagcctttctggggttgagggagaaggtctgcacaaattaggctacattctgagggacatctcgaagatacctgggggaaatatgtatgcagatgacactgctggctgggatacacgcatcaccgaggacgatttgcagaacgaggccagaattactgacatcatggaaccagagcatgctctcctggccaaatcaatttttaagctaacataccaaaataaagtggtccgggtgcagaggcccgcaaagaacggtaccgtaatggatgttatcagccgtcgagaccagcgcgggtccggacaggtgggcacatatggccttaatactttcaccaacatggaagcgcaactgataagacagatggagagtgaagggatattttctcctagcgagctcgagacgccaaacctggccgaacgggtcttggattggttagagaagtacggagtggaaaggctgaaacgcatggctatctccggtgacgactgtgtggtcaagcccatcgatgacagattcgccaccgcactcacagctcttaatgatatgggcaaagttcggaaggacattccgcagtgggagccttcaaaagggtggaacgattggcagcaagtgcccttttgcagtcaccacttccatcagctgataatgaaggacggaagggaaatcgtagtgccatgtcgaaatcaggatgagctagtcggccgtgccagagtgtctcagggtgcagggtggagcctgcgcgagactgcctgcctcggaaagtcctatgcgcaaatgtggcagttgatgtactttcaccggagggacctgagacttgctgccaacgcaatttgttcagccgttcctgtggattggatccccaccagccgcacaacttggtctattcatgctcaccatcagtggatgaccacggaagacatgctgtccgtctggaatcgggtgtggatcgaggaaaacccatggatggaggataaaacacacataagtagctggggcgacgtaccctatctcggcaagagggaagaccaatggtgcgggtcgttaatcggactgaccgcccgagcaacttgggctacaaatattcaggttgccatcaaccaggtgagacggttgattggtaatgagaactacctggattacatgacctccatgaaaaggttcaagaatgagtctgaccctgaaggcgcgctctggtga

SEQ ID NO: 14103 - RNA, 9879 nt, synthetic construct
  misc_feature 1..9879: note = derived and/or modified CDS sequence (opt3) from DENV-1__JQ045661__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagcacaaatactcgtggaaaagctggggcaaggccaagataatcggggcggacgttcagaataccacatttattatcgatggaccaaacactcctgaatgtcccgacgatcagagagcctggaatatttgggaggtggaggactatggcttcggtatctttaccacaaacatatggttgaagctcagggattcctacacgcaggtctgcgaccaccgtctgatgtcagctgcaattaaagatagtaaggccgtgcatgctgacatggggtattggatcgaatctgagaaaaatgaaacctggaagctagcccgggcctccttcattgaggttaagacttgtacatggccaaaatcccacaccctgtggtcaaacggagtgctcgaaagcgagatgatcatacccaagatctacggcggtcctatttctcaacataattatcgaccaggctacttcactcagacagcggggccgtggcacctgggaaaacttgagttggattttgacctgtgcgaaggcaccacggtagtcgtggatgagcactgcgggaacagaggaccctccttaaggactaccacagtgaccggcaagatcattcatgaatggtgttgccgcagttgtactctccctccactgcggttcagaggtgaggacgggtgctggtacggaatggagatcaggcccgtcaaagaaaaggaggaaaatcttgttaagagcatggtgtctgccggctccggtgaggtagactcatttagtctgggcttgctctgtataagcattatgatcgaagaggtgatgcgctcgcgatggtcccggaaaatgctgatgacagggaccctagctgtcttctttctgctcatcgtgggacagctgacatggaacgatcttattcgtttgtgcatcatgattggcgccaatgcatctgacagaatggggatgggaactacctatctggctttaatggccacgttcaagatgaggcctatgtttgcagttggcctcctgttccgccggcttacaagcagagaggtgctgctactcaccataggtctgtcattggtcgccagtgtggaactgccaaactccttagaggaactcggggatggactggctatgggcatcatgattcttaaactgttgactgactttcaatctcaccagctctgggcgaccctgctaagcctgacattcatcaagactaccttttcccttcattacgcctggaaaacgatggcaatggttctctcagtggtcagcctgttccccttgtgtctgagtacaacctctcagaagactacatggttaccggtactcctgggctcccttgggtgcaagcctctgaccatgtttttgattgctgagaataaaatctggggaaggcgaagctggccactcaacgaaggtataatggccgtgggcatcgtttcgattctgctatcatctctgcttaagaacgatgtgcccctcgccgggcctctgatcgctggaggcatgttgattgcatgttatgtcatcagtggttccagcgccgacttatctctggagaaagcggctgaggtgagctgggaagaggaagccgagcactccggggcatcacataatatactcgtagaagtgcaggatgacggaactatgaagattaaagatgaggagcgcgacgatacactgaccatccttctgaaggccacgttgctagctgtcagtggcgtttaccccctgagcatcccagcaactctcttcgtgtggtatttctggcagaagaagaagcagcggtctggcgtgctgtgggacaccccttcacccccagaagtcgagagagccgtgcttgatgacgggatttacaggataatgcagcgtggattactgggtcgcagccaggttggcgtaggggtgtttcaagaaaacgtcttccacacaatgtggcacgtgacccggggagcggttctcatgtatcagggcaaaagattggagccgagttgggctagcgtgaagaaagacctgatctcctacggtgggggatggaggctccagggctcttggaatacaggcgaggaagtccaggtgattgccgtagagcctgggaagaaccccaaaaatgtccaaactgcaccaggaacctttaagacgcccgaaggtgaggtgggcgccatcgctctggatttcaagcctgggacatcgggaagcccaattgttaaccgagaaggcaaaatcgtgggtctttacgggaatggagtcgtgactacctcaggcacatatgtttccgccatagcacaggctaaggccagtcaggagggccccctgcctgagatcgaagacgaggtgtttcggaaacgcaacttgaccattatggatctacatccggggtctggaaagactagaaggtacctgccagcgatcgtccgggaagccattaaacgaaagctcagaaccttaatcctggcacccacacgcgtggtagctagcgagatggccgaagctcttaagggtatgcctataaggtatcaaacgactgcagtgaaatccgagcacaccggcaaggagattgttgacctgatgtgccatgccacattcaccatgcgtctcttgtcaccagtccgggtgcccaattacaacatgatcatcatggatgaagcccactttactgacccttctagcattgctgcgagagggtatatcagtacaagggtgggaatgggcgaggcagccgctatattcatgaccgccacgccgcccggttccgtcgaagcatttccacagagcaatgccgtaattcaggatgaggaacgcgacatccctgagcgatcttggaactcagggtacgagtggattactgatttccccggaaaaacagtgtggtttgttccatccatcaagagtggcaatgacatagctaactgtctgaggaaaaatggcaagcgggtgattcagctcagcaggaagaccttcgataccgaatatcagaaaactaagaacaacgactgggactacgtcgtgacaaccgatatctcggagatgggggcgaatttccgcgccgaccgtgttatcgatcctagacggtgcctgaaacccgtgattcttaaggacggaccagaaagggtcatcctagcaggtccgatgcctgtgacagtagcttctgccgcacagcgccgaggcagaattgggcggaaccataataaagagggagatcagtacatatatatgggccagcccctgaacaatgacgaggatcacgcccactggactgaagctaagatgttgttagacaacatcaatacgccagagggtattatccccgccctgtttgaacctgagagggaaaagtccgcggcaatcgatggggagtaccgcctcagaggcgaggccaggaaaaccttcgtggaactgatgcggcgtggagaccttccagtttggctgagctataaggtcgcttcagagggctttcaatacagtgatcgccgatggtgcttcgacggggaaagaaacaatcaggtgctcgaggaaaacatggatgtggagatttggacaaaagagggagaaaggaagaaattgcggccccgctggctggacgccagaacttattctgaccctctagctctgagggagtttaaggagttcgcagccggtcggcgatccgtcagcggcgatctcatacttgagatcgggaaactgccgcagcatttaacccagagagctcaaaatgccttggacaacctggttatgctccacaattcagaacagggaggccgcgcatacaggcatgcgatggaggagctgccagatacaattgaaacccttatgctgctcgccttgatcgctgtgctgactggtggggtaacgttatttttcctaagtggccggggactgggcaagaccagcattgggctcctttgtgtgatggcctcctctgtcctgttgtggatggcaagcgtggagccccactggatcgctgcctccataatcctggaatttttcctcatggttctgcttattcctgagcccgaccgtcagagaacaccacaggataaccaactcgcatatgtggtcatcggactgttgtttatgattctgactgtagccgctaatgagatgggtttactagaaaccacaaagaaagacctgggcatcgggcacgtggcggttgagaaccatcaccatgccgcaatgctcgatgtggaccttcaccctgcttcagcctggaccctgtacgccgtcgcaactacaataattacgcccatgatgaggcataccatcgaaaacactacagctaatatttctttgaccgccatcgcgaaccaggctgccatactgatgggactcgataagggctggccaatcagtaaaatggacattggtgtgcctctgcttgcattagggtgctactcgcaggtcaatccgctgaccctcacagccgctgtgttgatgctggttgcacactatgccatcattggccccggactacaagcgaaggctactcgcgaggcccagaaacggacggcagccggcatcatgaagaacccaaccgtggatgggatagtagctattgacctggatcctgtggtctacgacgccaagttcgaaaaacagctcggacagatcatgcttctgatcttgtgtacaagccaaattctgctcatgcgaactacctgggcactgtgcgagtccatcacattagctaccggcccccttactacgctgtgggagggttctccagggaagttttggaatacaaccatagccgtttcaatggcgaacattttcagaggaagctatctcgccggcgcaggtctagctttctccctgatgaaaagtttgggcgggggaaggcgcggcactggggcccagggagaaaccctgggcgagaagtggaaacggcagctcaatcagctttctaagagcgaatttaacacatacaagagatcaggtatcatggaggtggaccgttccgaagcaaaagaggggctgaagaggggagagactaccaaatatgctgtcagtcggggcacagccaagttgcgctggttcgtggaacgaaatctggtaaaacctgagggtaaggtgattgatctcggctgtgggagaggaggctggagctactattgcgccgggttaaagaaagttacggaagtgaagggatacaccaaaggcggtcccgggcacgaggaaccgatcccaatggcgacttacggatggaacctggtcaaacttcattctggcaaagacgtgtttttcatacctcccgagaagtgtgatacactgctatgcgacatcggcgagtcctcaccaaatcccaccattgaagaggggaggactctccgggtcctgaaaatggtggaaccttggttgcgcggaaaccaattttgtatcaagattctgaatccgtatatgcccagcgttgtagagacactcgagcagatgcagagaaagcacggtggcatgcttgtgaggaacccactgtcgcgaaattctacccatgaaatgtactgggtcagttgcgggacgggaaacatcgtgtccgctgttaatatgaccagccggatgttactgaaccgtttcacaatggcacacagaaaacctacttatgagcgcgatgtggacttgggcgccggtaccaggcacgtcgctgtggaacccgaggtagccaacctcgatattatcgggcagcggatagaaaatattaagcatgagcacaaatcaacatggcattacgacgaggataacccttataagacttgggcataccacggatcctatgaagtgaaaccatctggcagcgccagttccatggttaatggcgtcgtgaagctgctaaccaagccctgggacgtgatccctatggtcacacaaatcgctatgaccgatactacgccatttgggcagcagagagttttcaaagagaaggtggacacacgcacccccaaagcgaagaggggaactgcccaaattatggaagtaaccgcaaaatggctttggggttttctgagccgaaacaagaagccgcggatatgtacaagagaggagttcacgaggaaagtgcgctctaatgctgccatcggcgcagtctttgtggacgagaaccagtggaactcagccaaggaggctgttgaagatgagcgtttctgggacctcgtgcatcgggaaagagagctgcacaaacaggggaagtgcgcaacctgcgtctacaacatgatgggaaaaagggaaaagaagttgggcgagtttggtaaagcgaaggggagtcgcgcaatttggtacatgtggctgggagcccgattcctcgagttcgaagctcttggctttatgaatgaggatcactggttctcccgggaaaacagcctgtctggcgtggagggggagggattacataaactgggttatatcttgagagacatttcgaagatccctggcgggaatatgtacgccgatgacactgcaggatgggatacaaggataaccgaagacgatctccagaacgaggctcgcatcactgacattatggaaccagagcacgccctgctagctaaatcaatctttaaacttacatatcaaaataaagtagttagagtgcagcggcccgccaagaacggcaccgtcatggatgtgattagcaggcgtgaccagcgaggttccggacaggtgggaacatacggcctgaatactttcaccaacatggaagcacaactcatccgccagatggagagtgagggcatattttctcctagcgaactggagacgccaaacttggcggaaagagtcttagattggctggagaagtatggggttgaacggctcaaaaggatggccatttccggagacgactgtgtggtaaagcccatcgatgaccgcttcgctaccgcccttacagcactgaatgatatgggtaaagtgagaaaggacatcccgcagtgggagccttcaaaaggctggaacgattggcagcaagtccccttttgcagtcatcacttccaccagctaattatgaaggacgggcgggagatagtggttccatgtaggaatcaggatgaactggtgggacgagctcgtgtctctcagggcgccggttggagcctcagagagactgcatgcttggggaagtcctacgcccaaatgtggcagctgatgtattttcatcgccgggaccttaggctggcggctaacgccatctgttcagcagtgcctgtagattggattcccaccagcagaacaacttggtctatccacgcccatcaccagtggatgaccacggaagacatgctctccgtttggaatcgcgtgtggattgaggaaaacccatggatggaggataaaacacatatcagtagctggggagacgtcccctacttaggcaagcgggaggaccaatggtgcggctcgctgatagggttgaccgctagggccacttgggcaacaaatatccaggtggctattaaccaggttcgaagactgatcggaaatgaaaactacctcgattatatgacctccatgaaacggttcaagaatgagtctgaccctgaaggtgccctttggtga

SEQ ID NO: 14104 - RNA, 9879 nt, synthetic construct
  misc_feature 1..9879: note = derived and/or modified CDS sequence (opt3) from DENV-1__JQ045663__SS-prME
  source 1..9879: mol_type = other RNA
agcgtgaccatgctgctcatgcttatgcccactgccctggctttccacttgactacgagaggaggggaacctcatatgatcgtctccaagcaggaaagagggaaatctttactgtttaagacctcagccggtgttaacatgtgcaccctgattgccatggacctcggagaactgtgtgaagatactatgacctacaaatgcccacggattacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaaacttactgtggtagtcggcgatgtggcagggattttggctcagggcaagaagatgatccgccctcaacccatggagtacaaatattcgtggaaaagctggggcaaggccaagataatcggggcggacgttcagaataccacattcattatcgatggaccatccactcctgaatgtcccgacgatcagagagcctggaacatttgggaggtggaggactacggctttggtatcttcaccacaaatatatggctcaagctgagggattcacacacgcaggtctgcgaccaccgtctaatgagtgctgcaattaaagattctaaggccgtgcatgctgacatggggtattggatcgaaagcgagaaaaacgaaacctggaagctggcccgggcatcctttattgaggttaagacttgtatctggccaaaatcacacacactctggagcaatggagtgctggaatctgagatgataatccccaagatttacggcggtcctatctcccaacataactatcgaccaggctacttcacccagactgcggggccgtggcaccttggaaaattggagctggatttcgacttatgcgaaggcacaaccgtagtcgtggatgagcactgcgggaatagaggacccagtctcaggacgactaccgtgacaggcaagattatccatgaatggtgttgccgcagctgtaccctgcctccacttcggtttagaggtgaggacgggtgctggtacggaatggagataaggcccgtcaaagaaaaggaggaaaacctggttaagtctatggtgtccgccggctcaggtgaggtagacagtttcagcttgggcctcctgtgtatttcgatcatgatcgaagaggtgatgcgctcccgatggtctcggaaaatgctaatgactgggacactggctgtctttttcctcctgattatgggacagcttacctggaatgatttgatccgtctgtgcattatggtgggcgccaacgcaagcgacagaatggggatgggaacaacttatttagctctcatggccacctttaagatgaggcctatgttcgcagttggcctgctttttcgccggctgacgtcaagagaggtgctactcctgacaataggtttgagtctggtcgcctccgtggaattaccaaattctctcgaggaactgggggatggacttgctatgggcatcatgattctgaaattgctcaccgacttccaaagccaccagctgtgggcgactctactgtcccttacctttatcaagacaactttctcactccattacgcctggaaaaccatggcaatggttctgagcattgtgagtttgtttcccctgtgtttatctacgacatcccagaagaccacttggctcccggtcctgcttggcagcctggggtgcaagcctttgacaatgttcctcatcgctgagaacaaaatatggggaaggcgatcgtggccactgaatgaaggtatcatggccgtaggcattgtgtcaatcctactgtctagtcttctcaagaacgatgttcccctggccgggcctttgattgctggaggcatgttaatcgcatgttatgtgatatccggtagctctgccgacctgagcctcgagaaagcggctgaggtctcctgggaagaggaagccgagcactcaggggcaagtcataacattctggtggaagtacaggatgacggaaccatgaagatcaaagatgaggagcgcgacgatactcttacaatcctgttgaaggccaccctactggctgtgagcggcgtctaccccctctctattccagcaacgctgtttgtttggtatttctggcagaagaagaagcagcggtccggcgtgctttgggacactccttcacccccagaagtggagagagccgtcttagatgacgggatatacaggatcatgcagcgtggactgctcggtcgcagtcaggtgggcgttggggtattccaagaaaatgtgtttcacaccatgtggcacgtcacacggggagcggtgttgatgtatcagggcaaaagactggagccgagctgggcttccgttaagaaagacctcatttcttacggtgggggatggaggctgcagggctcgtggaacaccggcgaggaagtgcaggtcatcgccgtggagcctgggaagaatagcaaaaacgtacaaacagcacccggaactttcaagaccccagaaggtgaggtcggcgccattgctcttgattttaagcccgggacgtcaggatcccctatcgtgaatcgagaaggcaaaatagttggtctgtacgggaacggagtggtcacaacaagtggcacctatgtgtctgccatcgcacaggctaaggccagccaggagggcccattgcccgagattgaagacgaggttttccggaaacgcaatctaacaatcatggatctgcatcctgggtccggaaagaccagaaggtacctcccggcgattgtgcgggaagccatcaaacgaaagttaagaactctgatacttgcaccaacccgcgtcgtggcttcagagatggccgaagctctgaagggtatgcccattaggtatcaaacaacggcagtaaaatctgagcacactggcaaggagatcgtggacctcatgtgccatgccacctttacaatgcgtttgctgagccctgttcgggtcccaaactacaatatgatcattatggatgaagcccacttcaccgaccccagttccatcgctgcgagagggtatataagcactagggtgggaatgggcgaggcagccgctatttttatgacagccacccctccgggttctgtggaagcattcccccagtcaaacgccgtcatccaggatgaggaacgcgacattccagagcgatcctggaatagtgggtacgagtggatcacggattttcctggaaaaactgtatggttcgtgcccagcataaagtcgggcaacgacattgctaattgtctcaggaaaaacggcaagcgggttatccagctgtctaggaagacatttgataccgaatatcagaaaaccaagaataacgactgggactacgtggtcactacagatatctccgagatgggggcgaacttccgcgccgaccgtgtgattgatccaagacggtgccttaaacctgttatcctaaaggacggacccgaaagggtgattctggcaggtccaatgccggtcaccgtggctagcgccgcacagcgccgaggcagaatagggcggaatcataacaaagagggagatcagtacatctatatgggccagcctttgaataacgacgaggatcacgcccactggacagaagctaagatgttactggacaatattaacactcccgagggtatcatcccagccctcttcgaacccgagagggaaaagtcagcggcaattgatggggagtaccgcctgagaggcgaggccaggaaaacgtttgtagaacttatgcggcgtggagacctgcctgtgtggctcagttataaggttgcttctgagggcttccaatactccgatcgccgatggtgctttgacggggaaagaaataaccaggtcttggaggaaaatatggatgtggagatatggaccaaagagggagaaaggaagaaactgcggccacgctggctagacgccagaacatatagcgaccccctggctctcagggagttcaaggaatttgcagccggtcggcgatcagtgagtggcgatcttatcctggagattgggaaattacctcagcatttgactcagagagctcaaaacgccctggacaatctcgtcatgctgcacaacagcgaacagggaggccgcgcatacaggcatgcgatggaggagcttccggataccatcgaaacactgatgctcttggccctgattgctgttttaaccggtggggtgactctattcctgctctccggccggggacttggcaagacgtctatcgggctgttgtgtgtaatggccagctccgtgctgctctggatggcatcagtcgagccacactggatagctgcctctatcattctggaatttttccttatggtgctcctgatccccgagcctgaccgtcagagaacaccccaggataatcaattggcatatgttgtgattggactgttatttatgatcctaacagtcgccgctaacgagatgggtctgctcgaaactaccaagaaagaccttggcatagggcacgtagcggtggagaatcatcaccatgccgcaatgctggatgttgacttgcacccagctagtgcctggacactgtacgccgtggcaaccactattatcacacctatgatgaggcatacgattgaaaacaccactgctaacatctcgctcacagccatagcgaatcaggctgccatcctgatgggacttgataagggctggcccattagcaaaatggacatcggtgtcccattactggcactcgggtgctactcccaggtgaaccctttgaccctgaccgccgctgtcctaatgctggtggcacactatgccattatcggcccgggactccaagcgaaggctacacgcgaggcccagaaacggactgcagccggcataatgaagaatcccacggttgatgggattgtggctatcgaccttgatccagtagtgtacgacgccaagttcgaaaaacagctgggacagatcatgttgctgattctctgtacctctcaaatcctgttaatgcgaacaacttgggcactttgcgagtcaataaccctggctacaggccctctcaccactctatgggagggtagccccgggaagttttggaacacgacaattgccgtctccatggcgaatatcttcagaggaagttatctggccggcgcaggtttggctttttctctgatgaaaagcctcggcgggggaaggcgcggcaccggggcccagggagaaactcttggcgagaagtggaaacggcagctgaaccagttgtcaaagtccgagttcaatacctacaagagaagtggtattatggaggttgaccgtagcgaagcaaaagaggggctgaagaggggagagacaactaaacacgctgtgtctcggggcaccgccaagctccgctggttcgtcgaacgaaacttagtgaaaccagagggtaaggtaatcgatctgggctgtgggagaggaggctggtcctattactgcgccgggcttaagaaagtgacagaagttaagggatatacgaaaggcggtcctgggcatgaggaacccataccgatggcgacctacggatggaatctggtgaagctacactcaggcaaagacgtctttttcatcccacctgagaagtgtgatactctcctgtgcgacattggcgagagctcgcccaacccaacaatcgaagaggggaggaccttgcgggtgctgaaaatggtcgaaccctggctccgcggaaatcaattttgtattaagatccttaacccttacatgccgtctgtggttgagactctggagcagatgcagagaaagcatggtggcatgttagtaaggaatcccctgagtcgaaactccacacacgaaatgtattgggtgagctgcgggaccggaaatattgtctcagctgtgaacatgacgtcccggatgttgctcaatcgtttcaccatggcacacagaaaaccaacatacgagcgcgatgttgacctgggcgccggtactaggcatgtggctgtcgaacctgaggtggccaacctagatatcatagggcagcggattgaaaacatcaagcacgagcataaatctacctggcactatgacgaggataatccctacaagacatgggcatatcatggaagctacgaagtaaaacctagtggctccgccagctctatggtgaacggcgttgtcaaacttctgactaagccatgggacgtgatccccatggtgacccaaattgctatgacagataccactccttttgggcagcagagagtcttcaaagagaaggttgacacgcgcacaccaaaagcgaagaggggaaccgcccaaataatggaagtgactgcaaaatggctctggggttttctgtcacgaaataagaagccccggatctgtaccagagaggagttcacaaggaaagtacgcagtaacgctgccattggcgcagtgtttgtcgacgagaatcagtggaactccgccaaggaggctgtggaagatgagcgtttctgggacttggttcaccgggaaagagagctgcacaaacaggggaagtgcgccacgtgcgtgtataatatgatgggaaaaagggaaaagaagctcggcgagtttggtaaagcgaaggggagccgcgcaatctggtacatgtggcttggagcccgattcctggagtttgaggctttaggcttcatgaacgaggatcattggttctctcgggaaaattcgctgtcaggcgtcgagggggagggattgcacaaactcggttacattctgagagacatcagcaagataccgggcgggaacatgtatgccgatgacaccgcaggatgggatactaggatcacagaagacgatctacagaatgaggctcgcattaccgacatcatggaacctgagcatgcccttctggctaaatccatttttaagctcacttaccaaaacaaagtggtaagagttcagcggccagccaagaatggcacagtgatggatgtcatcagtaggcgtgaccagcgaggttctggacaggtgggaacctatggcctgaacacattcactaatatggaagcacaattgatacgccagatggagagcgagggcatattttccccctcagaattagagacccctaacctggcggaaagagtgctcgattggcttgagaagtacggggtcgaacggctgaaaaggatggccatcagtggagacgactgtgttgtgaagccaatcgatgaccgcttcgctacggccctaaccgcactgaacgatatgggtaaagtaagaaaggacattccccagtgggagccgtctaaaggctggaatgattggcagcaagtgcctttttgcagccaccacttccatcagctcataatgaaggacgggcgggagatcgtcgtgccctgtaggaaccaggatgaattggttggacgagctcgtgtgtcccagggcgccggttggtcactgagagagacagcatgccttggaaagagctatgcccaaatgtggcagctgatgtactttcaccgccgggacctcaggttagcggctaatgccatttgttctgcagtcccagtggattggatccctacttccagaaccacatggagtattcatgcccaccatcagtggatgactaccgaagacatgctgagcgtatggaaccgcgtttggatcgaggaaaatccctggatggaggataaaacgcacatatcgtcctggggagacgtgccatatttgggcaagcgggaggaccaatggtgcggctctctgatcgggctcacagctagggccacctgggcaactaacattcaggtcgctatcaatcaggtgcgaagacttattggaaacgaaaattacctggattacatgacatcaatgaaacggttcaagaacgagagcgaccccgaaggtgccctatggtga

SEQ ID NO: 14105 - RNA, 9879 nt, synthetic construct
  misc_feature 1..9879: note = derived and/or modified CDS sequence (opt3) from DENV-1__JQ045665__SS-prME
  source 1..9879: mol_type = other RNA
agcgtgaccatgctgctcatgcttatgcccacagccctggctttccacttgactgcaagaggaggggaacctcatatgatcgtctccaagcaggaaagaggaaaatctttactgtttaagacgtcagccggtgttaacatgtgcaccctgattgcgatggacctcggcgaactgtgtgaagatacaatgacttacaaatgcccacggataaccgaaacagaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggttgacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaacttgctgagacccagcacggaacggtcttggtgcagataaagtacgagggcacagacgcgccttgcaaaatcccattctcgacccaagatgaaaagggggcaactcagaacggacgcctgattacagccaatcccatcgttaccgacaaagagaagcctgtgaacatagaagctgagccaccctttggcgagtcttatattgtaatcggtgccggggaaaaagcactcaagctgtcctggttcaagaaaggctcaagtatcggaaagatgtttgaggccactgctagaggcgccaggcggatggcaattcttggggataccgcgtgggacttcggaagcatcggtggcgtctttacatccgtggggaaactggttcatcagattttcggaacggcttacggcgtgttgttttctggtgtcagctggaccatgaagatagggatcggcgtgctcctgacttggttaggactaaattcacgaagtacatccctaagcatgacctgtattgccgtaggcctcgtgacactgtaccttggggttatggtccaggcagattctggatgcgtgatcaactggaaaggccgcgaattgaagtgtggttcagggatcttcgtgactaatgaggtccacacctggacggaacaatataagtttcaggccgacagtccgaaaagactgagcgctgccattggaaaggcatgggaggagggcgtttgcggtataaggtccgctacacggctcgaaaacatcatgtggaaacagatttctaacgagctgaatcatatcttactggaaaacgacatgaagttcaccgtggtggtaggcgatgtcgccgggattcttgcgcagggcaaaaagatgatccgccctcaacccatggagtacaaatattcgtggaaaagctggggcaaggccaagataatcggggctgacgtgcagaatactacctttattatcgatggaccaaacacacctgaatgtcccgacgatcagagagcatggaatatttgggaggttgaggactacggcttcggtatctttactaccaacatatggttgaagctcagggattcctatacacaggtgtgcgaccaccgtctgatgtcagccgctattaaagatagtaaggccgtccacgcagacatggggtactggatcgaatctgagaaaaatgaaacgtggaagctagcgcgggccagcttcattgaggtgaagacctgtatctggccaaaatcccatactctgtggtcaaacggagttctcgaaagcgagatgataatccccaagatttatggcggtcctatctctcaacacaattaccgaccaggctacttcacacagaccgctgggccgtggcatctgggaaaacttgagttggattttgacctgtgcgaaggcactacagtggtagtcaacgagcactgcgggaatagaggaccctccttaaggaccacgactgtgaccggcaagattatccacgaatggtgttgccgcagttgtacactccctccactgcggttcagaggtgaggatgggtgctggtatggaatggagataaggcccgtgaaagaaaaggaggaaaaccttgtcaagagcatggtttctgccggctccggtgaggtggactcatttagtctgggcttgctctgtattagcatcatgatcgaagaggtaatgcgctcgcgactgtcccggaaaatgctaatgaccgggactctggcagtgttctttctcctgattatgggacagcttacatggaatgacttgatccgtctgtgcattatggtcggcgctaacgcctctgatagaatggggatgggaaccacatacttagcactcatggccactttcaagatgaggcctatgtttgctgtgggcctgcttttccgccggctgaccagcagagaggttctactcctgacgataggtttgtcactggtggcgagtgtcgaattaccaaattccctcgaggaactgggggacggacttgccatgggcatcatgattctgaaattgctcacagattttcaatctcatcagctgtgggcaaccctactgagccttactttcatcaagaccacattttccctccaccatgcttggaaaactatggccatgattctgtcaatcgtgagcttgttccccctgtgtttaagtaccacgtctcagaagacaacctggctcccggttctgcttggctccctggggtgcaagcctttgactatgtttctcatagccgagaacaaaatctggggaaggcgaagctggccactgaacgaaggtattatggctgtgggcatcgtctcgattctactgtcatctcttctcaagaatgacgtacccctggcagggcctttgatcgccggaggcatgttaatagcgtgttatgtgattagtggttccagcgctgatctgtctctcgagaaagccgcagaggttagctgggaagaggaagccgagcactccggggcttcacataacatcctggtggaagtccaggacgatggaacaatgaagatcaaagacgaggagcgcgatgacacccttactattctgttgaaggcaacactactggccgtgagtggcgtataccccctcagcataccagcgaccctgttcgtgtggtatttctggcagaaaaagaagcagcggtctggcgtcctttgggatacgccttcacccccagaagttgagagagctgtgttagacgatgggatctacaggattatgcagcgtggactgctcggtcgcagccaggtgggcgtcggggtgtttcaagaaaatgttttccacactatgtggcacgtaacccggggagccgtgttgatgtatcagggcaaaagactggagccgagttgggcaagcgtcaagaaagacctcatctcctacggtgggggatggaggctgcagggctcttggaacacaggcgaggaagtgcaggttattgccgtggagcctgggaagaatcccaaaaacgtccaaaccgctccaggaacatttaagactcccgaaggtgaggtgggcgccatcgcacttgacttcaagcctgggacctcgggaagcccaatagtaaatcgagaaggcaaaatcgtcggtctgtacgggaacggagtggttacgacatcaggcacttatgtgtccgctattgcccaggcgaaggccagtcaggagggccccttgcctgagatcgaagatgaggtctttcggaaacgcaatctaaccattatggacctgcatccggggtctggaaagacaagaaggtacctcccagcaatcgtgcgggaagctataaaacgaaagttaagaaccctgattcttgcccccactcgcgttgtggctagcgagatggcagaagccctgaagggtatgcctatcaggtatcaaaccacagccgtcaaatccgagcacacgggcaaggagatcgtggatctcatgtgccatgctactttcaccatgcgtttgctgtcaccagtacgggtgcccaactacaatatgattatcatggacgaagcgcactttacagatccttctagcatagcagccagagggtatattagtaccagggttggaatgggcgaggctgccgcaatcttcatgactgccacaccgcccggttccgtcgaggcttttccacagagcaacgcggtgattcaggacgaggaacgcgatatccctgagcgatcttggaactcagggtacgagtggataaccgacttccccggaaaaacggtgtggtttgtcccatccattaagagtggcaacgatatcgccaattgtctcaggaaaaatggcaagcgggtaatccagctgagcaggaagactttcgacacagaatatcagaaaaccaagaacaatgattgggactacgtggttaccactgacatttcggagatgggggcaaacttccgcgctgatcgtgtgatcgaccctagacggtgccttaaacccgtcattctaaaggatggaccagaaagggtgatactggccggtccgatgcctgttacagtggcatctgccgctcagcgccgaggcagaatcgggcggaatcataacaaagagggagaccagtacatttatatgggccagcccttgaataacgatgaggaccacgcccactggaccgaagcgaagatgttactggataatatcaacacaccagagggtatcattcccgcactctttgaacctgagagggaaaagtccgccgctatagacggggagtaccgcctgagaggcgaggccaggaaatccttcgtcgaacttatgcggcgtggagatctgccagtgtggctctcatataaggtagctagtgagggctttcaatactctgaccgccgatggtgcttcgatggggaaagaaataaccaggtgttggaggaaaatatggacgttgagatctggactaaagagggagaaaggaagaaactgcggccccgctggctagatgcaagaacgtattccgaccctctggccctcagggagtttaaggagttcgctgccggtcggcgaagcgtctcaggcgaccttattctggagatcgggaaattaccgcagcatttgacccagagagcacaaaacgcgctggataatctcgtgatgctgcacaacagtgaacagggaggccgcgcctacaggcatgctatggaggagcttccagacacaattgaaactctgatgctcttggccctgatcgcagtgttaaccggtggggtcacactatttttcctgagcggccggggactcggcaagacctccatagggcttctgtgtgttatggcttctagcgtgttgctgtggatggcctccgtagagccccactggatcgcagcctcaattatcctcgaatttttcctgatggtgcttctcattcctgagcccgatcgtcagagaactccacaggacaatcaactggcttatgtcgtgatcggattgctgtttatgatattaacggttgcggccaacgagatgggtctactggaaaccacaaagaaagatctcggcattgggcacgtggcagtcgagaaccatcaccatgctgccatgcttgacgtagatctgcaccctgcctctgcatggactttgtacgctgtggccaccacaatcattacccccatgatgaggcatactatcgaaaatacaacggcgaacataagtctgaccgctatcgccaatcaggcagccattctcatgggactggacaagggctggccaatctcgaaaatggatattggtgttcctcttttagctctggggtgctacagccaggtgaacccgctcactttgacagcagccgtcctgatgctagtggcgcactatgctatcataggccccggactgcaagccaaggcaacccgcgaggcccagaaacggaccgctgccggcattatgaagaatccaacagtcgacgggatcgtggcaatcgatctcgaccctgttgtgtacgatgctaagttcgaaaaacagcttggacagattatgctgttgatcctgtgtacttcccaaatactcctgatgcgaacgacctgggccttatgcgagtctattacacttgcgactggccccctgaccacactctgggagggttcaccagggaagttttggaacaccactatcgccgtaagcatggcaaatattttcagaggatcctatctagctggcgccggtctggcattcagtttgatgaaatctctgggcgggggaaggcgcggcacgggggctcagggagaaacactcggcgagaagtggaaacggcagcttaaccagctgagcaagtcagaatttaatacctacaagagatccggtatcatggaggtggaccgtagtgaagccaaagaggggttgaagaggggagagactaccaaacacgccgtcagccggggcacagcgaagctgcgctggttcgttgaacgaaacctcgtgaaacctgagggtaaggtcatagacttaggctgtgggagaggaggctggtcttattactgcgctgggctgaagaaagtgactgaagtaaagggatataccaaaggcggtcccgggcatgaggaaccgatcccaatggcaacatacggatggaatcttgtgaagctgcactccggcaaagatgtatttttcattcctcccgagaagtgtgacacgctactctgcgatatcggcgagtcaagcccaaaccccaccattgaagaggggaggactctgcgggtgttgaaaatggtcgaaccttggctgcgcggaaatcaattttgtatcaagattctcaacccgtacatgccctcggtggtcgagacacttgagcagatgcagagaaggcatggtggcatgctggtgcgaaatccattatctcggaacagtacccacgaaatgtattgggtttcctgcgggactggaaatatcgtaagcgccgtgaacatgacatcacgtatgctgttgaacagattcaccatggctcaccgcaagcctacgtacgagagggacgtcgatctcggcgccggtacccggcatgtggcagttgaacccgaggtggccaatctggacataattgggcagagaatcgaaaacatcaaacacgagcataagtccacatggcactatgatgaggacaatccttacaaaacttgggcttatcatggatcttacgaagtcaagccaagcggcagtgcgtccagcatggtgaacggcgtagtgaaactacttaccaagccctgggatgttattcctatggtcacacaaatagccatgactgacaccacaccatttgggcagcagcgcgtgttcaaggagaaagtggataccaggactcccaaggcaaaacgaggaacggctcaaatcatggaagtcacagccaagtggctgtggggttttctctctcggaataaaaagccgagaatttgtaccagggaggagttcactcgcaaggttcgttcaaacgcagccatcggcgctgtgtttgtagacgagaatcagtggaacagtgccaaagaggcggtggaagacgagcggttctgggatctggtccacagagaaagggagttgcacaagcaggggaaatgcgcaacctgcgtgtataatatgatgggaaagcgcgagaaaaagctgggcgagtttggtaaggccaaagggtcccgagctatttggtacatgtggctcggagcccggttccttgagttcgaagcactgggctttatgaacgaggaccattggttcagcagagaaaattctttatcgggcgttgagggggagggactgcacaagttgggttacatcctcagggatatatcaaaaatccctggcgggaacatgtatgctgacgatacagccggatgggacacgcgcattaccgaagatgacctgcagaatgaggctagaatcactgatattatggaaccagagcatgccctacttgcaaagagcatctttaaactgacataccaaaacaaggtggtccgggtgcagaggcccgcgaaaaatggcaccgtaatggacgttatatcccgtcgagatcagcgcggtagtgggcaagtgggaacttatggcctcaacacattcaccaacatggaagcccaactgattagacagatggagtctgagggcatctttagcccttccgaattggagacaccaaatttagctgaacgggtcctggactggctcgagaagtacggggtggaaaggcttaagcgcatggccatctcaggagatgactgtgtggtcaaacccattgacgatagattcgcaactgctctgaccgccctaaacgacatgggtaaggttcggaaagatataccgcagtgggagcctagtaagggctggaatgactggcagcaagtgcccttttgctctcaccacttccatcagctgatcatgaaagatgggagggagattgtagtgccatgtcgaaaccaggacgaactcgtcggacgtgcaagagtgagccagggcgccggttggtccttgcgcgagacggcgtgcctggggaagtcatatgctcaaatgtggcagcttatgtactttcaccggagggatctgagactcgccgcaaatgccatctgtagcgctgttcctgtggactggattcccaccacatgcactacctggtctatccatgcccaccatcagtggatgacaactgaagatatgttatccgtctggaaccgcgtgtggatagaggaaaatccatggatggaggacaagacccacatcagtagctggggagatgtaccctatctgggcaaacgggaggaccaatggtgtggctcgttgattgggctgacggcaagggctacatgggccaccaacatccaggttgcgattaatcaggtgcgaagactcatcggaaacgaaaattaccttgactacatgacttccatgaagcggttcaaaaacgagtctgatcctgaaggtgctctgtggtga

SEQ ID NO: 14106 - RNA, 9879 nt, synthetic construct
  misc_feature 1..9879: note = derived and/or modified CDS sequence (opt3) from DENV-1__JQ045666__SS-prME
  source 1..9879: mol_type = other RNA
agcgtgaccatgctgctcatgcttatgcccacagccctggctttccacttgactgcaagaggaggggaacctcatatgatcgtctccaagcaggaaagaggaaaatctttactgtttaagacgtcagccggtgttaacatgtgcaccctgattgcgatggacctcggcgaactgtgtgaagatacaatgacttacaaatgcccacggataaccgaaacagaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggttgacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaacttgctgagacccagcacggaacggtcttggtgcagataaagtacgagggcacagacgcgccttgcaaaatcccattctcgacccaagatgaaaagggggcaactcagaacggacgcctgattacagccaatcccatcgttaccgacaaagagaagcctgtgaacatagaagctgagccaccctttggcgagtcttatattgtaatcggtgccggggaaaaagcactcaagctgtcctggttcaagaaaggctcaagtatcggaaagatgtttgaggccactgctagaggcgccaggcggatggcaattcttggggataccgcgtgggacttcggaagcatcggtggcgtctttacatccgtggggaaactggttcatcagattttcggaacggcttacggcgtgttgttttctggtgtcagctggaccatgaagatagggatcggcgtgctcctgacttggttaggactaaattcacgaagtacatccctaagcatgacctgtattgccgtaggcctcgtgacactgtaccttggggttatggtccaggcagattctggatgcgtgatcaactggaaaggccgcgaattgaagtgtggttcagggatcttcgtgactaatgaggtccacacctggacggaacaatataagtttcaggccgacagtccgaaaagactgagcgctgccattggaaaggcatgggaggagggcgtttgcggtataaggtccgctacacggctcgaaaacatcatgtggaaacagatttctaacgagctgaatcatatcttactggaaaacgacatgaagttcaccgtggtggtaggcgatgtcgccgggattcttgcgcagggcaaaaagatgatccgccctcaacccatggagtacaaatattcgtggaaaagctggggcaaggccaagataatcggggctgacgtgcagaatactacctttattatcgatggaccaaacacacctgaatgtcccgacgatcagagagcatggaatatttgggaggttgaggactacggcttcggtatctttactaccaacatatggttgaagctcagggattcctatacacaggtgtgcgaccaccgtctgatgtcagccgctattaaagatagtaaggccgtccacgcagacatggggtactggatcgaatctgagaaaaatgaaacgtggaagctagcgcgggccagcttcattgaggtgaagacctgtatctggccaaaatcccatactctgtggtcaaacggagttctcgaaagcgagatgataatccccaagatttatggcggtcctatctctcaacacaattaccgaccaggctacttcacacagaccgctgggccgtggcatctgggaaaacttgagttggattttgacctgtgcgaaggcactacagtggtagtcaacgagcactgcgggaatagaggaccctccttaaggaccacgactgtgaccggcaagattatccacgaatggtgttgccgcagttgtacactccctccactgcggttcagaggtgaggatgggtgctggtatggaatggagataaggcccgtgaaagaaaaggaggaaaaccttgtcaagagcatggtttctgccggctccggtgaggtggactcatttagtctgggcttgctctgtattagcatcatgatcgaagaggtaatgcgctcgcgactgtcccggaaaatgctaatgaccgggactctggcagtgttctttctcctgattatgggacagcttacatggaatgacttgatccgtctgtgcattatggtcggcgctaacgcctctgatagaatggggatgggaaccacatacttagcactcatggccactttcaagatgaggcctatgtttgctgtgggcctgcttttccgccggctgaccagcagagaggttctactcctgacgataggtttgtcactggtggcgagtgtcgaattaccaaattccctcgaggaactgggggacggacttgccatgggcatcatgattctgaaattgctcacagattttcaatctcatcagctgtgggcaaccctactgagccttactttcatcaagaccacattttccctccaccatgcttggaaaactatggccatgattctgtcaatcgtgagcttgttccccctgtgtttaagtaccacgtctcagaagacaacctggctcccggttctgcttggctccctggggtgcaagcctttgactatgtttctcatagccgagaacaaaatctggggaaggcgaagctggccactgaacgaaggtattatggctgtgggcatcgtctcgattctactgtcatctcttctcaagaatgacgtacccctggcagggcctttgatcgccggaggcatgttaatagcgtgttatgtgattagtggttccagcgctgatctgtctctcgagaaagccgcagaggttagctgggaagaggaagccgagcactccggggcttcacataacatcctggtggaagtccaggacgatggaacaatgaagatcaaagacgaggagcgcgatgacacccttactattctgttgaaggcaacactactggccgtgagtggcgtataccccctcagcataccagcgaccctgttcgtgtggtatttctggcagaaaaagaagcagcggtctggcgtcctttgggatacgccttcacccccagaagttgagagagctgtgttagacgatgggatctacaggattatgcagcgtggactgctcggtcgcagccaggtgggcgtcggggtgtttcaagaaaatgttttccacactatgtggcacgtaacccggggagccgtgttgatgtatcagggcaaaagactggagccgagttgggcaagcgtcaagaaagacctcatctcctacggtgggggatggaggctgcagggctcttggaacacaggcgaggaagtgcaggttattgccgtggagcctgggaagaatcccaaaaacgtccaaaccgctccaggaacatttaagactcccgaaggtgaggtgggcgccatcgcacttgacttcaagcctgggacctcgggaagcccaatagtaaatcgagaaggcaaaatcgtcggtctgtacgggaacggagtggttacgacatcaggcacttatgtgtccgctattgcccaggcgaaggccagtcaggagggccccttgcctgagatcgaagatgaggtctttcggaaacgcaatctaaccattatggacctgcatccggggtctggaaagacaagaaggtacctcccagcaatcgtgcgggaagctataaaacgaaagttaagaaccctgattcttgcccccactcgcgttgtggctagcgagatggcagaagccctgaagggtatgcctatcaggtatcaaaccacagccgtcaaatccgagcacacgggcaaggagatcgtggatctcatgtgccatgctactttcaccatgcgtttgctgtcaccagtacgggtgcccaactacaatatgattatcatggacgaagcgcactttacagatccttctagcatagcagccagagggtatattagtaccagggttggaatgggcgaggctgccgcaatcttcatgactgccacaccgcccggttccgtcgaggcttttccacagagcaacgcggtgattcaggacgaggaacgcgatatccctgagcgatcttggaactcagggtacgagtggataaccgacttccccggaaaaacggtgtggtttgtcccatccattaagagtggcaacgatatcgccaattgtctcaggaaaaatggcaagcgggtaatccagctgagcaggaagactttcgacacagaatatcagaaaaccaagaacaatgattgggactacgtggttaccactgacatttcggagatgggggcaaacttccgcgctgatcgtgtgatcgaccctagacggtgccttaaacccgtcattctaaaggatggaccagaaagggtgatactggccggtccgatgcctgttacagtggcatctgccgctcagcgccgaggcagaatcgggcggaatcataacaaagagggagaccagtacatttatatgggccagcccttgaataacgatgaggaccacgcccactggaccgaagcgaagatgttactggataatatcaacacaccagagggtatcattcccgcactctttgaacctgagagggaaaagtccgccgctatagacggggagtaccgcctgagaggcgaggccaggaaatccttcgtcgaacttatgcggcgtggagatctgccagtgtggctctcatataaggtagctagtgagggctttcaatactctgaccgccgatggtgcttcgatggggaaagaaataaccaggtgttggaggaaaatatggacgttgagatctggactaaagagggagaaaggaagaaactgcggccccgctggctagatgcaagaacgtattccgaccctctggccctcagggagtttaaggagttcgctgccggtcggcgaagcgtctcaggcgaccttattctggagatcgggaaattaccgcagcatttgacccagagagcacaaaacgcgctggataatctcgtgatgctgcacaacagtgaacagggaggccgcgcctacaggcatgctatggaggagcttccagacacaattgaaactctgatgctcttggccctgatcgcagtgttaaccggtggggtcacactatttttcctgagcggccggggactcggcaagacctccatagggcttctgtgtgttatggcttctagcgtgttgctgtggatggcctccgtagagccccactggatcgcagcctcaattatcctcgaatttttcctgatggtgcttctcattcctgagcccgatcgtcagagaactccacaggacaatcaactggcttatgtcgtgatcggattgctgtttatgatattaacggttgcggccaacgagatgggtctactggaaaccacaaagaaagatctcggcattgggcacgtggcagtcgagaaccatcaccatgctgccatgcttgacgtagatctgcaccctgcctctgcatggactttgtacgctgtggccaccacaatcattacccccatgatgaggcatactatcgaaaatacaacggcgaacataagtctgaccgctatcgccaatcaggcagccattctcatgggactggacaagggctggccaatctcgaaaatggatattggtgttcctcttttagctctggggtgctacagccaggtgaacccgctcactttgacagcagccgtcctgatgctagtggcgcactatgctatcataggccccggactgcaagccaaggcaacccgcgaggcccagaaacggaccgctgccggcattatgaagaatccaacagtcgacgggatcgtggcaatcgatctcgaccctgttgtgtacgatgctaagttcgaaaaacagcttggacagattatgctgttgatcctgtgtacttcccaaatactcctgatgcgaacgacctgggccttatgcgagtctattacacttgcgactggccccctgaccacactctgggagggttcaccagggaagttttggaacaccactatcgccgtaagcatggcaaatattttcagaggatcctatctagctggcgccggtctggcattcagtttgatgaaatctctgggcgggggaaggcgcggcacgggggctcagggagaaacactcggcgagaagtggaaacggcagcttaaccagctgagcaagtcagaatttaatacctacaagagatccggtatcatggaggtggaccgtagtgaagccaaagaggggttgaagaggggagagactaccaaacacgccgtcagccggggcacagcgaagctgcgctggttcgttgaacgaaacctcgtgaaacctgagggtaaggtcatagacttaggctgtgggagaggaggctggtcttattactgcgctgggctgaagaaagtgactgaagtaaagggatataccaaaggcggtcccgggcatgaggaaccgatcccaatggcaacatacggatggaatcttgtgaagctgcactccggcaaagatgtatttttcattcctcccgagaagtgtgacacgctactctgcgatatcggcgagtcaagcccaaaccccaccattgaagaggggaggactctgcgggtgttgaaaatggtcgaaccttggctgcgcggaaatcaattttgtatcaagattctcaacccgtacatgccctcggtggtcgagacacttgagcagatgcagagaaggcatggtggcatgctggtgcgaaatccattatctcggaacagtacccacgaaatgtattgggtttcctgcgggactggaaatatcgtaagcgccgtgaacatgacatcacgtatgctgttgaacagattcaccatggctcaccgcaagcctacgtacgagagggacgtcgatctcggcgccggtacccggcatgtggcagttgaacccgaggtggccaatctggacataattgggcagagaatcgaaaacatcaaacacgagcataagtccacatggcactatgatgaggacaatccttacaaaacttgggcttatcatggatcttacgaagtcaagccaagcggcagtgcgtccagcatggtgaacggcgtagtgaaactacttaccaagccctgggatgttattcctatggtcacacaaatagccatgactgacaccacaccatttgggcagcagcgcgtgttcaaggagaaagtggataccaggactcccaaggcaaaacgaggaacggctcaaatcatggaagtcacagccaagtggctgtggggttttctctctcggaataaaaagccgagaatttgtaccagggaggagttcactcgcaaggttcgttcaaacgcagccatcggcgctgtgtttgtagacgagaatcagtggaacagtgccaaagaggcggtggaagacgagcggttctgggatctggtccacagagaaagggagttgcacaagcaggggaaatgcgcaacctgcgtgtataatatgatgggaaagcgcgagaaaaagctgggcgagtttggtaaggccaaagggtcccgagctatttggtacatgtggctcggagcccggttccttgagttcgaagcactgggctttatgaacgaggaccattggttcagcagagaaaattctttatcgggcgttgagggggagggactgcacaagttgggttacatcctcagggatatatcaaaaatccctggcgggaacatgtatgctgacgatacagccggatgggacacgcgcattaccgaagatgacctgcagaatgaggctagaatcactgatattatggaaccagagcatgccctacttgcaaagagcatctttaaactgacataccaaaacaaggtggtccgggtgcagaggcccgcgaaaaatggcaccgtaatggacgttatatcccgtcgagatcagcgcggtagtgggcaagtgggaacttatggcctcaacacattcaccaacatggaagcccaactgattagacagatggagtctgagggcatctttagcccttccgaattggagacaccaaatttagctgaacgggtcctggactggctcgagaagtacggggtggaaaggcttaagcgcatggccatctcaggagatgactgtgtggtcaaacccattgacgatagattcgcaactgctctgaccgccctaaacgacatgggtaaggttcggaaagatataccgcagtgggagcctagtaagggctggaatgactggcagcaagtgcccttttgctctcaccacttccatcagctgatcatgaaagatgggagggagattgtagtgccatgtcgaaaccaggacgaactcgtcggacgtgcaagagtgagccagggcgccggttggtccttgcgcgagacggcgtgcctggggaagtcatatgctcaaatgtggcagcttatgtactttcaccggagggatctgagactcgccgcaaatgccatctgtagcgctgttcctgtggactggattcccacctctcgcacaacttggtccatccatgcccaccatcagtggatgaccacagaagatatgttaagtgtctggaaccgggtgtggatagaggaaaatccatggatggaggacaagactcacatcagctcgtggggagatgtaccctatctgggcaaaagggaggaccaatggtgcggctccttgattgggctgaccgcacgagctacgtgggccacaaacatccaggttgcgattaatcaggtgagacggctcatcggaaacgaaaattaccttgactacatgacctctatgaagaggttcaaaaacgagtcagatcctgaaggtgctctgtggtga

SEQ ID NO: 14107 - RNA, 9879 nt, synthetic construct
  misc_feature 1..9879: note = derived and/or modified CDS sequence (opt3) from DENV-1__JQ045667__SS-prME
  source 1..9879: mol_type = other RNA
tccgtgaccatgctgctcatgcttatgcccacagccctggctttccacttgactacgcggggcggggaacctcatatgatcgtctccaagcaggaaagagggaaatctttactgtttaagacctcagccggtgttaacatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcagactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactaacagccggtgtccaacccaaggagaggctacactggtggaagaacaagatgccaatttcgtctgccgccgaacttttgttgacagaggctggggtaacgggtgtggattgttcggcaaaggctccctcattacctgcgcaaagtttaagtgcgtgacaaaactggaggggaagatcgtacagtacgaaaatttaaaatattcagtgattgtcaccgtgcacactggagatcagcatcaagttggtaacgagagtacggaacacggcacaaccgctactatcacaccccaagcccctaccaccgagatccagctgactgactacggggcgctcacacttgactgtagcccaaggacgggactggatttcaatgaaatggtgttgctaaccatgaagggcaaatcttggctggtccataagcagtggtttctcgacctgccgcttccctggacttccggtgcctcaacaagccaagagacctggaaccggcaggatctgttggtgacattcaaaactgcacacgctaagaagcaggaggtagttgtgctcgggagtcaagaaggcgccatgcacaccgctctgacgggagccaccgagattcagacatctggcactaccacaatatttgcagggcatttaaaatgccgtctgaagatggacaaactaactctcaagggaatgtcctatgtcatgtgtaccggtagcttcaaactggaaaaggaggtggccgaaacgcagcacggcacagtccttgtgcagatcaagtacgaggggaccgatgctccttgcaaaattccattctcgactcaagacgagaagggagttacacagaatggccgcttgatcaccgcgaaccccatagtgactgataaagaaaagcctgtaaatattgaggcagaaccaccctttggtgagtcttatatcgtcatcggggccggcgagaaagctctgaagctctcctggttcaagaaaggatcaagtattggcaagatgtttgaagccaccgcaagaggggccaggcggatggctatcctgggagacacagcctgggatttcggtagcattggcggggtgtttacgtccgttggaaaacttgtgcatcagatattcggcaccgcatacggtgtcctgttttctggggtgagctggactatgaagatcggcattggagtattgctcacatggctgggcttaaactcacgaagtacctccctgagcatgacatgtatcgcggtggggctagttactctctacctgggagtcatggtgcaggctgactctggctgcgtgatcaattggaaaggtcgcgagcttaagtgtgggtcaggaattttcgtcaccaacgaagttcacacgtggacagagcaatataagtttcaggccgatagtccgaaaagattgagcgcagccataggcaaggcttgggaagagggtgtgtgcggcatcaggtccgccacccggctggagaacattatgtggaaacagatctctaatgaactcaaccatattctgttagagaatgacatgaagttcactgtggtagtcggggacgtggcaggaatcctggctcagggcaaaaagatgatacgccctcaacccatggaatacaaatattcgtggaaaagctgggggaaggccaagatcattggagcggatgttcagaacaccacatttatcattgacggcccaaatactcctgagtgtcccgatgaccagagagcctggaacatctgggaagtggaggattacggtttcgggatatttaccacaaatatttggcttaagttgagggactcctatacgcaggtctgcgatcaccgtctcatgtcagctgcaatcaaagacagtaaggccgtgcacgctgatatgggatactggattgagtctgagaaaaatgagacctggaagctggcccgggcatcgttcatcgaagttaagacttgtatatggccaaaatcccatacactatggtcaaatggcgtgctggagagcgaaatgatcattcccaagatctatggtggccctatttctcaacacaactaccgaccagggtacttcacccagactgcgggaccgtggcatctcggcaaactggagcttgactttgatttgtgcgaggggacaaccgtagtcgtggacgaacactgcggaaatagaggcccctccctgaggacgactaccgtgacaggtaagatcatacacgagtggtgttgccgcagttgtaccttacctccactccggttcagaggggaagatggatgctggtatggcatggagattaggcccgtcaaagagaaggaagagaacctggttaagagcatggtgtctgccggttccggcgaagtagactcatttagtcttgggctgttgtgtatcagcatcatgattgaggaagtgatgcgctcgcgatggtcccggaaaatgctcatgactggaacactggctgtcttctttctactgatcatgggccagctcacctggaatgacctgattcgtctttgcataatggtgggggccaacgcatctgatagaatgggaatgggcacaacttacttggctctgatggccaccttcaagatgaggcctatgtttgcagttggtttactcttccgccggctgacgagcagagaggtgcttctgctaacaatcgggctctcactggtcgccagtgtggagttgccaaattccctggaagagttaggagacggcctcgctatgggcattatgatcctgaaacttctgaccgattttcaatcttatcagttgtgggcgactctcctgagcctaaccttcattaagacaactttttccctgcattacgcctggaaaaccatggcaatggttctttcaatcgtgagcctcttccccctgtgtttgagtacgacatctcagaagaccacttggctgccggtcttactcgggtccctgggatgcaagcctcttacaatgtttctgatagctgaaaacaaaatctggggtaggcgaagctggccattgaacgagggcattatggccgtagggatcgtgtcgattctcctgtcatctctactgaagaatgacgttccccttgccggacctctcatcgctggcggtatgctgatggcatgttatgtgataagtgggtccagcgccgatttgtctttagaaaaagcggctgaggtcagctgggaggaagaggccgaacactccggagcatcacataacattctggtggaggtacagggcgacggcaccatgaagatcaaagatgaagaacgcgacgatactctcacaatcctgcttaaggccaccctgttggctgtgagtggggtctaccccctaagcattccagcaacgctgttcgtttggtatttctggcagaaaaagaagcagcggtctggagtgctctgggacactccttcacccccagaggtgggtagagccgtcctggatgacggcatatacaggatcatgcagcgtgggcttttaggacgcagccaggtgggcgttggtgtatttcaagaaaatgtgttccacaccatgtggcatgtcacaagaggggcggtgctgatgtaccagggaaaaagactcgagccgagttgggctagcgttaagaaagatttgatttcctatggcggcgggtggaggctgcagggatcttggaacaccggtgaagaggtgcaggtcatcgccgtggagcctggcaagaatcccaaaaacgtacaaacagcaccagggacttttaagacccccgaaggagaggtcggcgccattgctctcgacttcaagcctggtacgtcggggagcccaatcgtgaatcgagaaggaaaaatagttggcctgtacggcaacggggtggtcacaacttcaggaacctatgtgtccgccatcgcacaggctaaggccagtcaggagggtccccttcctgaaattgaggacgaggtttttcggaaacgcaatctgacaatcatggatttgcacccgggctctgggaagaccagaaggtacctaccagcgattgtgcgggaagccatcaaacgaaagctgagaactctcatattagcacccacccgcgtcgtggctagcgagatggccgaagctctgaagggaatgcctattaggtatcaaacaacggcagtaaaatccgagcacactggcaaggaaatcgtggaccttatgtgccatgccaccttcacaatgcgtctgctctcaccagttcgggtccccaactacaatatgatcattatggatgaggcccactttaccgacccttctagcatcgctgcgagaggttatataagtactagggtggggatgggagaggcagccgctattttcatgacagccaccccgcccggctccgtggaagcatttccacagagcaacgccgtcatccaggatgaggaacgcgacattcctgagcgatcttggaactcaggctacgaatggatcacggatttccccgggaaaactgtatggtttgtgccatccataaagagtggaaacgacattgctaattgtttgaggaaaaacggtaagcgggttatccagctgagcaggaagacattcgataccgagtaccagaaaaccaagaacaatgactgggattatgtggtcactacagacatctcggagatgggcgcgaacttccgcgccgaccgtgtgattgatcctagacggtgcctcaaacccgttatcctgaaggacgggccagaaagggtgattcttgcaggaccgatgcctgtcaccgtggcttctgccgcacagcgccgaggcagaataggtcggaatcataacaaagagggggatcagtacatctatatgggccagcccctaaataacgacgaagatcacgcccattggacagaggctaagatgctgttggacaatattaacactccagagggaatcatccccgccttatttgaacctgagagggaaaagtccgcggcaattgatggcgagtaccgcctgagaggggaagccaggaaaacgttcgtagagctcatgcggcgtggagacctgccagtgtggcttagctataaggttgcttcagagggttttcaatacagtgatcgccgatggtgcttcgacggcgaaagaaataaccaggtcctggaggaaaatatggatgtggagatatggaccaaagaaggggagaggaagaaactccggccccgctggttggacgccagaacatattctgatcctctggctctaagggagtttaaggagttcgcagccggacggcgatccgtgagcggcgacctgatcctcgagattggtaaacttccgcagcacctgactcagagagctcaaaacgccttagacaatttggtcatgctgcacaactcagaacaagggggccgcgcatacaggcatgcgatggaggaactcccagataccatcgagacactgatgcttctggccctcattgctgttttgaccggaggcgtgactctgtttttcttaagtgggcggggactaggtaagacgagcatcggcctgctctgtgtaatggcctcctctgtgcttctgtggatggcaagcgtcgagccccactggatagctgcctccatcattttggaatttttcctgatggtgctcctgatccctgagcccgaccgtcagagaaccccacaggataatcaacttgcatacgttgtgattgggctcctgtttatgatcttgacagtcgccgctaacgaaatgggactgttagagactaccaagaaagacctaggcataggtcatgtagcggtggagaaccaccaccatgccgcaatgctggatgttgacctccaccctgcttcagcctggacactttatgccgtggcaaccactattatcacacccatgatgaggcatacgattgaaaataccactgctaacatctctctgacagccatagcgaatcaggctgccatcttgatggggctggataagggctggccaattagtaaaatggacatcggagtccctctcctggcacttggctgctacagccaggtgaacccgttaaccctgaccgccgctgtcctcatgttggtggcacactatgccattatcgggcccggactgcaagcgaaggctacacgcgaggcccagaaacggactgcagccggcataatgaagaatccaacggttgatggtattgtggctatcgacctagatcctgtagtgtacgacgccaagttcgaaaaacagctggggcagatcatgctccttattctgtgtaccagccaaatcttgctgatgcgaacaacttgggcactctgcgagtccataaccctggctacaggacccttaaccactctttgggaaggctctccaggtaagttttggaacacgacaattgccgtctcaatggcgaatatcttcagaggcagctatctggccggggcaggactcgctttctccctaatgaaaagtctgggcgggggaaggcgcggcaccggtgcccagggggagactttgggagagaagtggaaacggcagctgaaccagctctctaagagcgaatttaatatttacaagagatcaggcatcatggaggttgatcgttccgaagcaaaagagggtcttaagaggggcgaaaccacaaaacatgctgtgagtcgggggactgccaagctgcgctggttcgtcgagcgaaacttggtgaaacctgagggaaaggtaatagacctgggctgtgggagaggaggctggagctattactgcgccggtctcaagaaagtgaccgaagttaaggggtacacaaaaggaggccccggccacgaggaaccgatcccaatggcgacgtatgggtggaatttagtgaagctgcactctggaaaagacgtctttttcattcctcccgagaagtgtgatacccttctgtgcgacatcggtgaatcctcaccaaaccccactattgaggagggcaggacactacgggtgctcaaaatggtcgaaccttggctgcgcgggaatcaattttgtatcaagattttgaacccgtacatgcccagcgtggttgagaccctggaacagatgcagagaaagcatggaggcatgctcgtaaggaatccactttcgcgaaactctactcacgagatgtattgggtgagttgcggtacagggaatatcgtctccgctgtgaacatgaccagccggatgctgttaaaccgtttcacgatggcacatagaaaacctacctacgagcgcgatgttgacctgggagccggcacaaggcacgtggctgtcgaacccgaggtggccaatttggatataattggccagcggatcgaaaacatcaagcacgagcataaatcaacttggcactatgacgaagataatccttacaagacctgggcatatcatgggtcctacgaggtaaaaccatctggaagcgccagttccatggtgaacggtgttgtcaagctcctgacaaagccctgggacgtgattcctatggtgactcaaatagctatgaccgatacaaccccatttggccagcagagagtcttcaaagagaaggttgacactcgcacgcccaaagcgaagagggggacaatccaaattatggaagtgaccgccaaatggctatggggatttcttagccgaaataagaagccgcggatctgtactagagaggagttcaccaggaaagtacgctctaacgcagctattggcgccgtgtttgtcgatgagaatcagtggaactcagcaaaggaagccgtggaggacgagcgtttctgggacctggttcaccgggaaagagagctccataaacagggtaagtgcgctacatgcgtgtacaatatgatggggaaaagggaaaagaagctgggagagtttggcaaagccaagggcagtcgcgcgatctggtatatgtggttgggggcacgattcctggagttcgaggccctcggatttatgaacgaggatcactggttctcccgggaaaatagcctttctggtgtcgagggcgaagggctgcacaaattaggatacatactgagagacatctcgaagattcctggcggtaacatgtatgctgatgacacggccgggtgggataccaggatcactgaggacgatttgcagaatgaggcacgcattacagacatcatggaaccagagcatgctctcctggccaaatcaatatttaagctaacctaccaaaacaaagtggtaagagttcagcggcccgctaagaatggaactgtgatggatgtcattagcaggcgtgaccagcgaggctccggccaggtggggacatatggacttaacaccttcacaaacatggaagcccaactgatccgccagatggagagtgaaggtatcttttctcctagcgagctcgagactccaaatctggcagaaagagtgttggattggttagagaagtacggcgtcgaacggctgaaaaggatggcgatttccggggacgattgtgttgtgaagcccatagacgaccgcttcgccaccgctctcacggcccttaacgatatgggaaaagtaagaaaggacatcccgcagtgggagccttcaaaaggctggaatgattggcagcaagtgcccttttgcagtcaccatttccaccagctgattatgaaggacggtcgggaaatcgtcgtgccatgtaggaaccaggatgagctagttgggcgagcacgtgtgtctcagggagctggctggagcctgagagagaccgcctgcctcggcaagtcctatgcacaaatgtggcagttgatgtactttcaccgccgggacctgaggcttgccgcgaatgctatttgttcagccgtccctgtggattggatccccacaagcagaactacctggtctatacatgcacaccatcagtggatgacaactgaagacatgctgtccgtatggaaccgcgtttggatcgaggaaaatccatggatggaggataaaacccacattagtagctggggagacgtgccctacctcggaaagcgggaagatcaatggtgcggttcgttaatcggcctgacggccagggctacatgggccaccaacattcaggtcgcaatcaatcaggtgcgaagattgattgggaacgagaattatctggactacatgacttccatgaaacggttcaagaacgagtctgaccctgaaggagctctctggtga

SEQ ID NO: 14108 - RNA, 9879 nt, synthetic construct
  misc_feature 1..9879: note = derived and/or modified CDS sequence (opt3) from DENV-1__KU094071__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacaaaggcggagccggacgatgtggactgttggtgcaatgctaccgatacttgggtaacatatgggacctgtagtcaaacgggagaacaccgccgagacaaacgtagcgtggccctggcaccccatgtcggcttgggtctcgagactagagccgagacctggatgtcctctgaaggggcttggaagcagatccagaaggtggagacatgggcactgaggcaccctggattcactgttattgccctgtttctcgctcatgccatcggcacctcgattacacagaaaggcatcatattcatcttactgatgcttgtgaccccatcaatggcgatgcggtgcgtcgggattggaaaccgcgattttgtggaaggtttgagcggcgggacgtgggtagacgttgtgctggagcacggaagttgtgtcactacaatggcaaaggataaacccaccctagacatcgagctcctgaagactgaagtgacaaatcctgccgtgcttagaaaactgtgcattgaggctaagatctccaacaccacgaccgattctaggtgtccaacacaaggcgaagccactttggtcgaggaacaggacgcaaatttcgtttgccggcgcacctttgtggatcgaggttgggggaacggatgtggcctcttcggcaaggggagcctgataacatgcgctaaatttaagtgcgtaactaaattagagggaaagattgtgcagtacgagaatctgaaatattccgtcatcgtgaccgttcacacaggtgaccagcatcaagtgggcaacgaaaccactgagcacgggacgattgccacaatcaccccccaggcgcctacttcagaaatccagctcaccgactacggagcccttacactggattgtagtccaagaaccggcttggacttcaatgagatggtcctactgactatgaagaggaaaagctggctcgtgcataagcagtggtttctggatcttccgctgccctggacatctggtgcatccacgcctcaagaaacctggaaccgggaggacttgctcgtaactttcaagacagctcacgccaaaaagcaggaggttgtggtcctggggtcacaggaaggcgctatgcacaccgccttaacaggagcaactgagattcaaaccagcggcacgaccaaaatatttgccgggcatctgaagtgccgtctaaaaatggataagctcacactgaagggaatgagttatgtgatgtgtactggttctttcaaacttgaaaaggaggtcgctgaaacccagcacggcacagtgttggttcaggtgaaatacgaggggactgacgcgccatgcaagatccccttctccacccaggatgagaaaggagtaacgcaaaatggccgcctgattacagcaaaccctatcgtcaccgacaaggaaaagccagtgaatatagaggccgaacccccgtttggtgagagctatattgttgtgggggctggcgagaaagccctcaagctgtcgtggttcaaaaagggatcttccatcggcaaaatgcttgaagcaactgccagaggggctaggcggatggccatcctgggagatacagcatgggactttggttcaattggcggggtcttcaccagtgtgggaaagttggtacatcagatctttggcactgcgtacggtgtgctcttcagcggggtttcctggaccatgaagattggcataggaatcctgttaacatggctgggcctaaactctcgaagcgcttcactcagtatgacgtgtattgccgtcgggatggtgaccctgtaccttggagtgatggtccaggcagattccggctgcgttatcaattggaaaggtcgcgagttgaagtgtgggagcggaatctttgtgactaacgaagtgcacacatggaccgagcagtataaattcagagccgactctcctaagaggctgtcagctgccattggcaaagcatgggaagagggtgtatgcggcatacggagtgctacacgcctcgagaacatcatgtggaagcaaattagcaatgaactgaaccatatcttactggagaatgacatgaaatttactgtcgtggttggggatgtgtccggaattcttacccagggcagaaagatgatcgggccccagccaatggaacacaagtactcttggaaatcgtggggaaaggccaaaataatcggcgcggacgtccagaacacgacattcattatcgatggtcctaatacccccgagtgtccagacgatcaaagggcctggaacatttgggaagtggaggactatgggtttggaatcttcactaccaatatatggttgaagctccgtgatagctacacacaggtttgcgacccccggctgatgtccgctgcaattaaagattcaaaggccgtgcacgctgacatgggctattggatcgagagtgaaaagaacgagacttggcgactagccagagcatcttttattgaagtaaaaacctgtgtctggcctaagagccatacactgtggtccaatggtgtgctcgagtcagaaatgatcataccaaaaatctacggcgggccgattagccagcacaactataggcccggatactctacgcagaccgcgggcccttggcatctggggaagcttgagttggatttcgacctgtgcgagggaactacagtggtcgttgatgaacactgcggcaatcgcggtccatccttacggaccactacagtgaccgggaaaatcattcacgagtggtgttgcagaagttgtacgctcccccctctgaggttcaagggagaagacggctgctggtacggtatggagatccgcccagtaaaggacaaagaggaaaaccttgtgaagagcctggtctctgccggctccggggaggtggattcatttagtttgggactcctgtgtgttagcataatgattgaagaggtgatgcgatcgcggtggtcccgtaaaatgctaatgactggcaccctggctgtcttcctcctgcttatcatggggcaattgacatggaatgacctgatcagattatgcattatggtgggagccaacgcatctgataggatgggcatgggtaccacttatctcgctctgatcgccacatttaagatgcgccccatgttcgcagttgggcttctgtttcggagactaaccagcagggaagtgctcctgttgacaattggactgtcattagtcgccagtgtagagctcccgaattccctggaggaacttggcgacggcctggctatggggataatgatcttgaaactcctgactgatttccagtctcatcagctatgggcggccctgcttagcctcacctttattaagacgacattctccctgcactacgcatggaagaccatggctatggtgttgtcaactgttagcctgtttcctttatgtctcagtaccacatctcgaaaaactacctggctgccagtgcttctgggatccttgggttgcaagcccctcacgatgttcctgatcgccgagaacaaaatttggggccgcaagagctggcctctaaacgaagggatcatggccgtcggaatagtgtcgatcctgctttcatctctcctgaaaaatgacgtacccttggctggcccattaattgcaggtgggatgctgatcgcctgttatgtgattagtggatccagcgcggatctctctctggagaaggctgccgaagtcagctgggaggaggaagcagagcattccggcgcctcacacaacatccttgttgaagtgcaagacgatggcacaatgaaaataaaggacgaggaacgggatgacaccctgactattttgctaaaggctacactgctcgcagtgagtggggtctaccctatcagcatccccgccaccctgtttgtgtggtatttcagacagaaaaagaaacagaggtctggagttctttgggatactccatccccgcctgaggtagagcgtgcggtgttagacgacggtatttaccgcatactgcagcggggcctcttggggagatcacaagtcggagtgggcgtttttcaggaaggtgtgttccatacaatgtggcacgtcaccaggggggctgtgctgatgtatcagggaaagcgactcgagcccagttgggccagcgtaaaaaaggatctgatctcctacggcggcgggtggcggttccagggatcttggaatacgggtgaagaggtccaagtgattgcagttgagccaggcaagaaccccaaaaatgtgcagactgcccctgggacctttaagacaccagaaggagaggtcggcgtgatcgctcttgacttcaaacccggtacctcggggagccctattgttaaccgcgaaggaaagatcgtgggcctgtacggcaatggggtcgtgacaacttcaggaacctatgtatccgccatagcacaggctaaagccagtcaggagggtccgttgccagaaatcgaggatgaggtgtttagaaagaggaacctaacgattatggacctgcaccccggctctgggaagacacggcgatacctccctgcgatcgttagagaagccattaaacgcaagttaaggactctgatccttgcaccaacccgtgtcgtggctagcgagatggccgaagctctgaaaggaatgcccatacggtatcaaacaaccgcagtgaagtccgagcatactggcagagaaattgtcgatctcatgtgccacgccaccttcacaatgaggttgctgtcacctgtacgcgtgccgaattacaacatgatcatcatggacgaggcccattttacggatcccgcttctattgcggcacgaggttatatcagcactagagttgggatgggagaggccgctgccatattcatgaccgcaacaccacctggcagtgtggaagcctttccccagtccaatgctgtcattcaggacgaggaacgggatatcccagagaggagctggaactctggctacgactggattaccgatttccctgggaaaactgtgtggtttgttccctcaatcaagtccggaaatgacatagcgaactgtctccgcaagaatggtaaacgtgtgattcaactgagtagaaagacattcgacaccgaatatcagaaaacgaagaacaacgattgggactacgtcgtgactacagatatcagcgagatgggcgccaattttcgggcagacagggtaatcgatccacgccgatgctcgaaaccggtgattcttaaggacgggcctgagagagttatcctagctggacccatgccagtcaccgtggcctctgcagcccagcggaggggccgcattggtagaaaccagaataaggaaggggatcaatacatatatatgggccagcccctgaacaatgacgaggatcacgctcattggaccgaagccaaaatgttgttagacaacatcaatactcctgagggaattatcccagcgctgttcgagcccgaaaggggcaagtccgcagccatcgatggggagtaccggctccgtggagaagctcgcaaaacattcgtggagctgatgcgaagaggtgaccttcctgtctggctgagctataaggttgcctcagaaggctttcagtacagtgataggaaatggtgcttcgacggggagcggaacaatcaggtgctcgaggaaaacatggacgtagagatttggaccaaggaaggagagcgcaaaaagttgagaccgaggtggctggatgctcggacatattctgacccacaagcactacgagaatttaaggagttcgccgctggcagacgctccgtgagcggtgatctgatactcgagatcgggaaacttccccagcacctgactcagagggcccagaatgcattagacaacttggtcatgctgcacaattcagaacaaggcggaaaggcgtaccggcatgccatggaggaactccctgatacgattgagaccctgatgcttctggctctcatcgccgtgttgacaggcggggttactctgtttttcttaagtggacgtggtctaggcaaaaccagcattgggctgctctgtgtgatggcatcctctgtccttctgtgggtagctagcgtggaaccccactggatcgccgcatccataatcttggagtttttcctgatggttctcctgattccagagcctgacagacagaggacaccccaggataaccagcttgcctatgtggtcatcggactcctgtttatgattttgaccgtggctgcgaatgaaatgggcctgttagagactacgaagaaagacctaggtatcgggcatgtcgccgtggaaaaccaccaccatgcaaccatgctggatgttgacctccgcccagcttcagcctggacactttacgccgtggcaactaccataattacacctatgatgcggcacaccatcgagaacactacagctaatatttctctgacggccatcgcgaaccaagctgccatattgatgggcctggataagggatggccgatcagtaagatggacattggcgtacccctcctggcacttgggtgctactcgcaggtgaatccacctaccttaatcgccgctgtcctgatgctcgttgcacattatgccattatcggacccggcttgcaggcgaaagctactcgagaggcccaaaagagaacagcagccggtataatgaaaaacccaaccgtggatgggattgtcgctatcgacctggaccctgtggtatacgatgccaagttcgaaaaacagctaggacagatcatgctgctcattctttgtaccagccagatcctgtccatgaggacaacttgggcattgtgcgagtctataacgctggctaccggccccctcacaactctgtgggaaggttcaccgggcaagttttggaataccacaattgccgtgagcatggcgaacatcttccgcgggtcctatttagccggagcaggccttgcttttccactgatgaagagtctcgggggaggccggagaggtaccggggcccaaggagagactctaggcgaaaaatggaagcgtcagctgaatcagttgtctaaaagcgagttcaacacgtacaagaggtcaggtattatggaggttgaccggtccgaagcaaaagagggcctgaagcgcggggaaacaaccaagcacgctgtgagtcgaggaactgccaaactcagatggttcgtcgagaggaatcttgtgaagcctgaaggcaaagtcatcgatctggggtgtggacggggcggttggagctattactgcgccgggttgaagaaagtgaccgaggttaagggatatacaaaaggcggccccgggcatgaggaaccaatacccatggcgacttacggatggaacctggtaaagctccactctggtaaggacgtgtttttcacccctccggagaaatgtgatacattactgtgcgacatcggcgaatcctcacccaatccaacgattgaggaagggcgcacccttagagtcctgaagatggtggagccttggctaaggggaaaccagttttgtatcaaaattctcaatccctacatgcctagcgttgtggagactctggaacaaatgcagcgaaagcacggcggtatgttggtccggaacccactgtcgcgtaattctacacatgagatgtattgggtgagttgcgggaccggaaacatcgtatccgctgtgaatatgactagcagaatgctccttaaccgcttcacaatggcacacaggaaacccacctacgaacgggatgttgacctgggcgccggcacgagacatgtcgctgtggagcctgaggtggccaacttagatattatcgggcagcgcatagaaaatattaagaacgagcacaagtcaacctggcactatgacgaagataatccatacaaaacatgggcatatcatggatcctacgaggtcaagccctctggtagcgccagttccatggttaacggcgtggtaaggctgttgactaaaccgtgggacgtgatccctatggtcacccagatcgctatgacagacactaccccatttgggcaacagcgagtgttcaaggaaaaagttgatacacggacccccaaggcgaagagaggaactgcccagattatggaggtgacggcaaggtggctctggggctttctgagccgcaataaaaagcctcgtatatgtacacgggaggaattcaccagaaaagtcaggtctaacgctgccatcggtgcagtgtttgtagacgagaatcaatggaactcagccaaggaagctgttgaggatgaacgcttctgggacctagtgcaccgagagcgggagcttcataaacaggggaagtgcgccacttgcgtctataatatgatgggaaagagagaaaaaaagctgggcgagtttggcaaagcgaaggggagtagggcaatttggtacatgtggctcggagcccgcttcctggaatttgaggctttgggtttcatgaacgaagatcactggttctccagagagaatagcctgtctggcgtggagggggaaggactccataaacttggctacatcctgcgggacatttcgaagatcccaggtgggaacatgtatgccgatgacaccgcaggatgggatacaaggataacggaggacgatttacagaatgaagctaaaatcaccgacattatggagcccgagcacgccctgttggctacttcaatctttaagctcacataccagaacaaggtggtccgtgttcaacgaccggccaaaaatggcaccgtgatggatgtaattagccgcagagaccagcggggctccgggcaggtgggaacttatggtctgaacacattcaccaacatggaagtccagctaatcaggcaaatggagagtgaaggcatattttctcctagcgagcttgaaacacccaatctggcagagcgcgtgctcgactggctggagaagcacggggttgaaagattgaaacggatggcgatttccggagatgactgtgtggtcaagccaactgatgacaggttcgccaccgctttaacggccctgaacgatatgggcaaagtgcgaaaggacatccctcagtgggagccctcaaagggttggaatgattggcagcaggtaccattttgcagtcatcacttccatcaactcatcatgaaagacgggcgtgaaattgttgtgccctgtagaaaccaggatgagcttgtcggacgcgcacgggtgtctcagggcgctggctggagcctgagggaaaccgcctgcctagggaagtcctacgcacagatgtggcaactgatgtattttcacagacgcgacctccggttggccgcgaatgctatatgttcagccgttcctatcgattgggtgccaacaagcaggactacctggtctattcacgcacatcaccagtggatgacaactgaggacatgctgtccgtctggaaccgagtgtggatcgaggaaaatccgtggatggaggacaaaacccatgtaagtagctgggaagatgtgccctaccttggaaagagagaggaccagtggtgcggttcgctgattggcctcacggcccgggctacatgggccaccaacatccaagtcgcaataaatcaggttaggcgcttaatcgggaacgaaaattatctggattacatgacttccatgaaacgtttcaaggacgagtctgatttggagggagctctgtggtga

SEQ ID NO: 14109 - RNA, 9879 nt, synthetic construct
  misc_feature 1..9879: note = derived and/or modified CDS sequence (opt3) from DENV-1__HQ624983__SS-prME
  source 1..9879: mol_type = other RNA
agcgtgaccatgctgctcatgcttgtccccaccgcactggctttccacttgactacgagaggaggggaacctcatatgatcgtttccaagcaggaaaggggaaaatctttactgtttaagacctcagccggtgtgaacatgtgcacactgattgccatggacctcggcgagttctgtgaagatactatgacctacaaatgcccacggataagtgaagcggaaccggacgatgtagactgttggtgcaatgctacagatacctgggtgacttatgggacatgtagccaaaccggagagcaccgccgagacaagcgttccgtcgccctggcaccccatgtgggccttggtctggagacgagaactgaaacctggatgtcttcggagggggcctggaaacagatccagagggttgaaacatgggctttgcggcaccctggatttactgtgattgcactcttcctggcccatgctatcggcacctcaattacacagaagggcatcatatttatcctgctcatgttagtcaccccaagcatggccatgcgctgcgtggggattggaagtagagatttcgttgagggtctgtccggcgcgacgtgggttgacgtggtccttgagcacgggtcttgtgtgactacaatggcaaaggataaacccaccttggacatcgaactgctaaagactgaggtgacaaaccctgccgtcctcaggaaactgtgcattgaagctaagatcagcaataccacgaccgattcccggtgtccaacacaaggagaggccactcttgttgaagaacaagacgcaaactttgtgtgccgccgaaccttcgtagatagaggctggggtaatgggtgtggactgtttggcaaaggctcattgataacatgcgctaagttcaagtgcgtgactaaactcgaggggaagattgtccagtacgaaaacctgaaatatagtgtgatcgttaccgtgcacacaggagaccagcatcaagtcggtaatgagagcaccgaacacggcactacggccacaattacaccccaggcgccttctactgagatccagttaaccgactacggggccctgacactcgattgttccccaaggaccggacttgactttaacgaaatggtgctgttgactatgaaggagaaatcatggctagtacataagcagtggttcctggatctcccgctgccctggacaagcggcgcaagtacgtctcaagagacctggaatcggcaggaccttctggttacttttaaaacagctcacgccaagaagcaggaagtggtcgtgttgggttcccaagagggggctatgcacaccgccctcacaggcgcaactgaaatccagaccagcggaacgaccacaattttcgccggccatctgaaatgccgtttaaagatggataaactgactctaaaggggatgtcgtatgtcatgtgtaccggatctttcaaactcgagaaggaagtggctgagacacagcacggtactgttctggtgcagataaagtacgagggcaccgacgcgccttgcaaaatcccattttccacgcaagatgaaaagggggtaacacagaacggacgccttattaccgcaaatcccatcgtcactgacaaagagaagcctgtgaacatagaagccgagccacccttcggcgagtcatatattgttatcggtgctggggaaaaagccttgaagctgagttggtttaagaaaggcagctccatcggaaagatgttcgaggcaacagccagaggcgctaggcggatggccattctcggggataccgcatgggactttggatctatcggtggcgtgttcactagcgtcgggaaactggtgcatcagatttttggaaccgcgtacggcgtacttttctcaggtgtgagttggacaatgaagatagggatcggcgttctgttgacgtggctcggactaaattcccgaagcacctctttatcaatgacttgtattgctgtcggcctggtgacactatacctcggggtgatggtccaggccgatagtggatgcgttatcaactggaaaggccgcgaactgaagtgtggtagcgggatctttgtgaccaatgaggtgcacacatggactgaacaatataagttccaggcagactccccgaaaagactttctgccgctattggaaaggcctgggaggagggcgtatgcggtataaggtcggcaacccggttggaaaacatcatgtggaaacagattagcaacgagctgaatcatatcctcctggaaaacgacatgaagtttacggtcgtggttggcgatgtggctgggattttagcccagggcaagaagatgatccgccctcaacccatggagtacaaatattcctggaagtcatggggcaaggcgaaaataatcggggccgacgtccagaatacaaccttcattatcgatggaccaaacactcctgaatgtcccgacgatcagagagcttggaatatttgggaggtggaggactacggctttggtatcttcaccacaaacatatggctgaaacttagggatagttatactcaggtttgcgaccaccgtttgatgtctgcagccattaaagatagcaaggctgtgcacgccgacatggggtactggatcgaatccgagaaaaatgaaacctggaagctcgcacgggcgtcattcattgaggtaaagacatgtatctggccaaaaagccatacgctgtggtctaacggagtcctagaatccgagatgataatccccaagatttatggcggtcctatcagtcaacacaattaccgaccaggctactttacccagactgccgggccgtggcatctgggaaaactcgagctggatttcgacctttgcgaaggcacaaccgtggtggtcgatgagcactgcgggaacagaggacccagcttgaggactacaaccgttacgggcaagattatccacgaatggtgttgccgctcttgtactctgcctccattacggtttaaaggtgaggacgggtgctggtatggaatggagataagacccgtgaaggaaaaggaggaaaatctcgtaaaatccatggtgtcagctggcagtggtgaggtcgacagcttctcgctgggccttctgtgtatttccatcatgatcgaagaggtgatgaggtctcgctggagccgaaagatgttgatgaccgggacactcgccgtatttttcctgctaattatgggacagctgacctggaacgatctcatccggctgtgcattatggtgggcgcaaatgcttcagaccgtatggggatgggaatgacttaccttgccttgatggcaacatttaaaatgagacctatgttcgccgtcggcctgttatttaggcgcctcaccagtcgggaggtgctgcttctgacaataggtctatccctcgttgcttctgtggaactgccaaacagcttggaggaactgggggatggattagcgatgggcatcatgattctcaagctgcttactgacttccaatcccatcagctgtgggccaccttgctctcactgacgtttatcaaaacaaccttcagcctacactatgcatggaagactatggctatggtcctgagtattgtatctctttttcccctctgtctgtccaccacaagccagaagactacctggttgccggtgctgttaggctcgctcgggtgcaaacctctgacgatgttccttatcgccgagaataagatatggggaagaaaatcatggccactgaacgaaggtatcatggccgttggcattgtgtctatcttgctcagttccctgctaaagaacgatgtccccctggctgggcctcttattgcaggaggcatgctcatcgcctgttacgtgataagcggttctagcgcggacctgtccttggagaaagctgccgaggtatcatgggaagaggaagcagagcatagtggggccagccacaatattttagtggaagtccaggatgacggaacaatgaagatcaaagatgaggagagggacgataccctgactatcctcctgaaggctacacttctggcagtttctggcgtgtatcccttgtccattccagccaccctattcgtgtggtacttttggcaaaagaaaaagcagcgatcaggcgtcctgtgggacactcctagtcccccagaagtggagcgcgcggttctcgatgacgggatatatcggatcatgcagagaggactgcttggtaggagccaggtaggcgtgggggtcttccaagaaaacgtgtttcatacaatgtggcacgttacccgtggagctgtgttaatgtaccagggcaaacgcctggagccgtcctgggcctctgtcaagaaagacctcatttcgtacggtgggggatggcggttgcagggcagctggaatacgggcgaggaagtgcaggtaatcgcagtcgagcctgggaagaaccccaagaatgtgcaaactgccccaggaaccttcaaaacatcagaaggtgaggttggcgctattgccctggattttaagcccgggacctccggaagtcctatcgtgaacagagaaggcaaaatagtcggtctctatgggaatggagtggttacaacttctggcacctacgtgagcgcaatcgctcaggccaaggcgtcccaggagggcccactgcccgagattgaagacgaggtcttcaggaaacgaaaccttacgatcatggatctgcaccctgggtcaggaaagacacggcgctatttgccggccattgtgagagaagcaatcaagaggaaactacggactctgatactcgctccaacccgagtagtggcctctgagatggctgaagcattaaagggtatgcccattagataccaaacaaccgccgttaaaagcgagcatactggcaaggagatcgtcgacctgatgtgccacgccacctttacaatgcgccttctgagtcctgtgagggtgccaaattataacatgatcattatggatgaagctcatttcacggacccctccagcatcgcggcacgtgggtacatatctactcgggtcggaatgggcgaggccgctgccatttttatgaccgcaacacctccgggttcagtagaagccttcccccagtccaatgctgtgatccaggatgaggaaagagacattccagagaggagttggaacagcgggtatgagtggatcaccgattttcctggaaaaactgtttggttcgtgccctcgataaagtctggcaatgacattgcgaactgtctccgcaagaatggcaaacgagtcatccagttgtccagaaagacattcgataccgaataccagaagacgaagaacaacgactgggactacgtggttactacagatatcagcgagatgggggccaattttcgggcagacagggtgattgatccacgccgttgcctgaaacctgtcatcctcaaggacggacccgaaagagtgattctggctggtccaatgccggtaaccgtggcctcagcagcccagcggaggggccgcatagggcgaaaccacaataaggagggagatcagtatatctacatgggccagcctcttaacaatgacgaggatcatgctcactggaccgaagccaaaatgctactggacaacattaatactcccgagggtatcatcccagcgttgttcgaacccgagagagaaaagagtgcagccattgatggggagtatcggttaaggggcgaggctcgcaaaacatttgttgaactgatgagaaggggagacctccctgtctggctgtcttacaaggtggcctccgagggcttccaatatagcgatcggcgttggtgctttgacggggaacgcaacaatcaggtgcttgaggaaaacatggatgtcgagatatggaccaaagagggagaacgaaagaaactgagaccaaggtggctcgacgctcggacatactcagaccccttggcactgcgcgagttcaaggaatttgccgctggtagaaggagtgttagcggcgatctaatcctggagattgggaagctccctcagcaccttactcagcgggcccaaaatgcactggacaacttagtgatgttgcataattccgaacagggaggccgagcgtatagacacgccatggaggagctgccggatacgatcgaaaccctcatgctgcttgctctgattgccgtactcacaggtggggtgactttgttctttctgtctggccgcggattaggcaaaaccagcatcgggctactgtgtgtcatggcatcctcagtgctcctttggatggcttctgttgagccacattggatagccgcaagtatcattctggagttctttttgatggtgctgctcatccccgagcctgacaggcagcggacaccccaggataaccaactggcctacgtcgtaattggacttctcttcatgatcctgaccgtggctgcgaatgagatgggtttgctggaaactacgaagaaagacttaggcatagggcacgttgccgtggagaaccaccatcacgcagctatgctagatgtcgacctgcatccagcctcggcctggaccctctacgcagtggctacaactattatcacccctatgatgcgtcacacaattgaaaacaccactgccaatatcagccttacagcgatagctaaccaggccgcaatcctgatgggattggataagggctggcccatttccaaaatggacatcggtgtcccactgctcgccctggggtgctattctcaggtgaatcctcttacgttaaccgctgcagttctgatgctcgtggcccattacgcgattatcggcccgggattgcaagctaaggccactagagaggcacagaagaggacagccgctggcataatgaaaaaccccaccgtagatgggattgtggccatcgacctggatccagtcgtttatgacgcaaagtttgaaaaacagctaggacagatcatgctgctcattctttgtacctcacaaatcctgttgatgcgcacaacttgggctctgtgcgagagcataacgctcgccaccggccctctgacaactttatgggagggttcccccgggaagttctggaataccacaattgcggtgagtatggccaacatcttccggggatcttaccttgcaggcgctggtctggcctttagcctcatgaaatcactaggcgggggacgaagaggcaccggggcacagggagaaactctgggcgagaagtggaagaggcagttgaatcacctgtccaaaagtgagttcaacacgtataagcgcagcggtattatggaggtcgaccggtctgaagctaaagaggggctcaagagaggagagacaaccaaacacgccgtgtcccgtggcactgccaaacttaggtggtttgtagaacggaatctggtgaagccagagggtaaagttatcgatttgggctgtgggcgcggaggctggtcatactattgcgcggggctgaagaaagtgaccgaagtcaagggatacacaaaaggcggtcctgggcatgaggaacccataccgatggctacttacggatggaacctcgtgaagttacacagcggcaaagacgtcttctttgtgccacctgagaagtgtgataccctgctttgcgacatcggcgagtcgtctcccaatccaacaattgaagaggggcgaacgctgagagttctaaagatggtagaaccctggctcaggggaaaccagttctgtatcaaaattctgaatccttatatgccgagtgtggtcgagaccttggagcaaatgcagcggaagcatggtggcatgctggtgcgcaaccccctctccagaaatagcactcacgaaatgtactgggtttcatgcgggacaggaaacatcgtgtccgcagtcaatatgacctctaggatgcttctgaaccgatttactatggcccaccggaaaccaacatatgagcgtgatgtggacttaggcgctggtaccagacatgtagccgtggaacctgaggttgcaaacctggatattatcgggcagcgcatagaaaatattaagcacgagcataaaagcacgtggcactacgacgaggataacccctataagacctgggcctaccatggaagttatgaagtcaagccttccggcagcgcttcttcaatggtgaatggcgtggtcaaattgctcacaaagccatgggacgttatccccatggtgactcagatcgcgatgaccgatacaactcctttcgggcaacagagggtatttaaagagaaggtggacacccggacaccaaaagccaagagaggaaccgcacagattatggaagtcactgctaagtggctgtggggtttcctaagtcgcaacaaaaagcccaggatatgtacgcgagaggaatttacacggaaagtgagatccaatgccgcaatcggcgccgttttcgtggacgagaaccaatggaatagcgctaaggaggccgtcgaagatgagaggttttgggaccttgtgcaccgcgaacgtgagctgcacaaacaggggaagtgcgcgacctgcgtatacaacatgatgggaaagcgggagaaaaagctcggcgagttcggtaaagcaaaggggtctagagccatttggtacatgtggctgggagctaggttcttggagtttgaagccctgggcttcatgaatgaggatcattggttttcgcgcgaaaactcactcagcggcgttgagggggagggacttcacaaactgggttatatcttacgagacatttccaagatcagtggcgggaatatgtacgcagatgacactgctggatgggatacccggataacagaagacgatctgcagaacgaggccaaaatcacggacattatggaaccggagcatgctttgctcgccaattctatcttcaagctgacctatcagaacaaggtggtcagagtgcaaaggcctgccaaaaatggcactgtgatggatgtcattagccgcagagaccagcggggttccgggcaggttggaacatacggcctaaacacctttactaacatggaagcgcagcttatcaggcaaatggagtcagagggcatattcagtccatctgaactggagacacccaatctcgccgaacgtgtgctggattggttggagaagtatggggtagaacgattaaaacgcatggctattagcggagacgactgtgtggtcaagcctatcgatgacagatttgccaccgcactgacagctctcaacgatatgggtaaagtgcggaaggacatcccacagtgggagccctccaagggctggaatgattggcagcaggttccgttctgctcacaccactttcatcaacttattatgaaagacgggagggagatagtggtcccttgtcgcaaccaggatgaactggtgggcagagcacgggtaagccagggagcaggttggtctctaagggagactgcctgcctggggaagtcctacgcgcagatgtggcaactcatgtatttccaccgacgtgacttgagactggctgccaatgcaatctgtagtgccgttcccgtggattgggtcccaaccagccgcacgacctggtcgattcatgctcaccatcagtggatgacagccgaagacatgctttccgtgtggaaccgggtttggatcgaggaaaatccttggatggaggataaaactcacatttcttcatgggaggacgtgccctacctgggaaagagggaagaccagtggtgcggcagcctcatcggcttaaccgcaagagctacatgggccactaacatacaagtcgcgatcaatcaggtgcgccggctgattgggaacgagaattacttggattatatgaccagtatgaaaaggtttaagaacgaatccgacccagagggagctctgtggtga

SEQ ID NO: 14110 - RNA, 9879 nt, synthetic construct
  misc_feature 1..9879: note = derived and/or modified CDS sequence (opt3) from DENV-1__FJ384655__SS-prME
  source 1..9879: mol_type = other RNA
agcgtgaccatgctgctcatgcttctgcccacagcattggctttccacttaactacgcggggcggggagcctcatatgatcgtctccaagcaggaaaggggaaagtctctgctatttaagacctcagccggtgttaacatgtgcacactcattgcaatggacctgggcgagctttgtgaagatactatgacctacaagtgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaagacagaggtgaccaaccctgccgtgcttagaaagctgtgcattgaagctaagatctccaatacgaccacagactctaggtgtccaactcaaggagaggccaccttggtcgaagaacaggatgcaaacttcgtttgccggcgcacatttgtggaccgaggctggggtaatgggtgtggactcttcggcaagggcagcctgttaacttgcgctaagtttaagtgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagagaaaagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcggaaaggcttgggaggagggcgtctgcggtatcagaagcgccaccaggctcgaaaatattatgtggaagcagatatccaacgagctgaatcatatcttactggaaaacgacatgaaattcactgtggttgtgggcgacgcaaatgggattcttgctcagggaaagaaaatgatccggcctcaacccatggagcacaagtactcttggaagtcgtggggcaaagccaagattatcggggcggatatacagaacaccacatttatcattgacggaccagatactcctgaatgtcccgacgagcagcgcgcctggaatatctgggaggtcgaagattatggcttcggtatttttaccacaaacatctggttgaaactcagagacagctacacgcagatgtgcgatcacaggctgatgtccgctgcaataaaggactcaaaagccgtgcatgctgatatggggtattggattgagagtgaaaagaatgagacctggaagctagcccgtgcatctttcatcgaagttaaaacttgtatttggccaaagagccacacactgtggtccaacggagtgctcgagtcagagatgatcatacccaaaatctacggcggtcctattagccaacataattatcggccaggctacttcacccagactgcggggccgtggcacctgggaaaacttgaattggactttgatctgtgcgagggcacaaccgtagtcgtggacgaacactgcgggaaccgaggaccctctttaagaacgactaccgtgacaggcaaaatcattcatgagtggtgttgcaggtcctgtaccctccctccactgcgcttccggggtgaggatgggtgctggtacggaatggaaatcagacccgtcaaggagaaggaagagaatcttgttaggagtatggtgagcgccggctctggtgaagtagactccttttcactgggcatattgtgtgtgagtattatgatcgaggaggtcatgcgcagccgatggtcgcggaaaatgctcatgactgggacactggctgtgttcctactgctcatcatgggacagctgacctggaacgaccttattcgtttgtgcatcatggttggcgccaatgcatccgataagatggggatgggaacaacttatctggctttaatggccacctttaaaatgagacctatgttcgcagtgggcctcctgtttaggcgccttgcctctcgggaagtcctgctactcacgattggtctgagcttggtggcttcagttgagctgccaaacagtttagaagaactcggggacggactggcgatgggcataatgatgcttaagctgttgacagagttccaaccccaccatctctggaccactctgctatccctgacctttatcaaaacaactctttctctcgattacgcctggaagaccacggcaatggtgctgagcattgtctccttgttcccgctgtgtttatcaacaaccagccagaagactacatggctccctgtactgcttggcagttttgggtgcaaaccactgaccatgttcttgatcactgagaacaagatttggggaagaaaatcttggcccctcaatgagggtatcatggctataggcatcgtgtccattctgctaagctcgctgcttaagaacgacgttcctctcgccgggcccctgatcgccggaggcatgttgattgcttgttatgtgatctcaggttctagtgcagatttatccctggaaaaagccgcggaggtcagctgggaagaggaagctgagcactctgggacaagccataatatactcgtggaggtacaggacgatggagccatgaagattaaagacgaagagagggatgacaccctgacgatccttctgaaggcaactttgctagccgtgtccggcgtctacccaatgtcaatccctgctaccctgtttgtttggtatttctggcagaagaaaaagcaacgaagtggcgtgctctgggatacacccagcccaccggaagtggagggggcagtcctggacgatggaatttaccgcatacttcagcggggtttactgggcagatctcaggtgggggttggagtattccaggacggcgtgtttcacaccatgtggcacgtcacaaggggtgccgtgctcatgtatcaagggaaacgtttggagccttcctgggcgtcagttaagaaagacctgatcagttacggaggcggctggcgcttccaggggagctggaacactggagaagaggtgcaggtcattgctgtggaacccggtaagaatccaaagaacgtacagaccacgcccggcacatttaaaactcctgagggggaagtcggagccatcgcactcgatttcaagccaggcacctccggttctcccattgtgtcgcgggaggggaaaatcgttggactgtacggcaatggcgtggtcacaaccagcgggacttatgtgtcagccatagctcaagccaaggcatcccaggagggacctcttccggaaatcgaggacgaagtttttaaaaagagaaacctgaccattatggatttgcatccaggtagtggcaagacaaggcgatacctacccgctatcgtgcgggaggccattaaacgcaagctgagaacgctcatcttagcgcctactagggtcgtggcctctgaaatggcagaggctctgaaagggatgccaatacggtatcagaccacagccgtaaagagcgagcacaccggacgagaaattgtggaccttatgtgccatgctactttcacaatgagactgctctcccccgttcgcgtccctaattacaacatgatcatcatggatgaggcacactttaccgacccggcctcaattgccgctaggggctatatctctacgcgtgtgggtatgggggaagcggcagccatattcatgactgctacacccccaggaagcgtggaggcctttcctcaaagtaatgcagtcattcaggatgaggaacgggacatccccgagagatcctggaacagcggctacgattggattaccgacttcccaggcaaaaccgtatggtttgtgccttctatcaagtcagggaatgatatagccaactgtttgaggaagaatggaaaacgcgttattcagctgtcccgaaagactttcgacacagaatatcagaaaaccaagaacaacgactgggattacgtggtcacaactgacatcagtgagatgggtgctaatttcagagcggatcgggtgatcgaccccaggcgctgcctcaaaccagttattctgaaggatggcccggaacgtgtgatccttgccgggcctatgcccgtcacggtggcaagcgctgcccaaagacggggaaggattggccgcaaccagaataaggagggtgaccagtacgtatatatggggcagccactaaacaatgatgaggaccatgcacactggaccgaagccaaaatgctgttggataacataaatacacccgagggcatcattcctgctttatttgaaccagagcgagaaaagtcggccgcgatcgacggaggctacagactgagaggggaagcaaggaaaactttcgtggagctcatgcgcagaggagatctgcccgtttggctttcttataaggtcgcctccgaaggttttcaatacagcgacaggcggtggtgcttcgatggcgagcgtaacaatcaggtgctggaagagaacatggacgtggaaatctggaccaaagagggggagcgcaagaaactccgacctagatggttggacgctaggacatattcagatccgctggccctacgggaatttaaggagttcgctgcaggacgcagaagtgtctctggcgacctgattctcgaaataggtaaacttccacagcacctgaccttaagggcccagaatgctttggataacctggttatgctccataattccgagcaagggggcaaagcctaccggcacgcaatggaggagctgcccgacactatcgagacgcttatgctgctcgcgttgattgccgtgctgaccggaggcgtaacattatttttcctaagcgggaagggactgggtaaaacttcaatcggcctcctttgtgtgaccgctagtagcgccctgttgtggatggcatccgtcgaacctcattggattgctgcctctatcatactggagtttttcctcatggtgctgcttatccccgaaccagatcgacagagaacacctcaggacaaccagctcgcatatgttgtgattgggctgttgtttatgatcctgaccgtcgccgctaatgagatgggattactagagactacaaagaaagatctgggcattggtcacgtagcggccgaaaaccaccaacatgcaacgatgctcgacgtggatcttcgccccgctagcgcctggaccctgtacgccgttgcaactacagtgatcaccccaatgatgaggcacaccatagagaacacaactgctaatatttccttgacggccatcgcgaaccaggctgccattctgatggggctcgacaagggctggcctatctcaaagatggatataggagtcccgctgcttgcattaggctgctactctcaggtgaatcccctgaccctcacagccgctgtcttgatgctggtggcacattatgccatcattgggccaggactacaagcgaaagctactcgggaagcccagaagcgtaccgcagccggcatcatgaaaaaccctacagttgacggtattgtggctatcgatctggaccccgtagtgtacgacgccaagttcgagaaacagctcgggcagataatgcttctgattttgtgtaccagtcaaatcctgctcatgagaactacgtgggcactgtgcgaatcgatcacattagctaccggaccacttactaccctgtgggagggcagccctggtaagttttggaatacaactattgccgtctccatggcgaacatcttcaggggctcttatctcgccggggcaggactagctttctcactgatgaaatccttgggcgggggacgccggggcaccggtgcccagggggagacactgggagaaaaatggaagcgacagctcaatcagcttagcaaaagtgagtttaacacgtacaagagatctggcataatggaagttgataggagcgaggcaaaagaaggtctgaagcgcggcgagaccactaagcacgctgtgtcacgggggacagccaaattgagatggttcgtcgagcgtaatctggtgaagcccgaaggaaaagtaattgacctcggctgtgggaggggaggctggtcctattactgcgccggtttaaagaaagtgaccgaggttaaggggtatactaaaggaggcccgggccatgaggagccagtgcctatggcgacatacgggtggaacctggtcaaacttcacagtggaaaggatgtgtttttcatgcccccagaaaaatgtgacaccctgctatgcgatatcggtgagagctctcccaatcctacgattgaggaaggccggaccctccgcgtcctgaagatggtggagccgtggttgcgagggaaccaattttgtatcaaaatactgaatccctacatgccatccgttgtagaaacactcgagcagatgcagagaaagcacggaggcatgcttgtgaggaaccctctgtcacggaatagcactcatgagatgtattgggtctcgtgcggtaccgggaacatcgtgtctgctgttaatatgacaagtcgcatgttactgaacagattcactatggcacacaggaaacccacctacgaacgagacgtggatttgggagccggcacacggcatgtcgctgtggagcctgaagtagccaacctcgacattatcggccagcgtattgagaatatcaagaacgaacacaagtccacctggcactatgatgaggacaatccatacaaaacttgggcatatcatgggagctacgaggtgaagccctcaggatccgcctctagcatggttaacggtgtcgtgagactgctaacgaaaccttgggatgtgattccaatggtcacacaaatcgctatgaccgacactaccccctttggccagcagcgcgttttcaaggaaaaagtggacacaaggacgccgcgggcgaagagagggaccgcccaaataatggaggtaactgcaaagtggctttggggatttctgagtcgcaataaaaagcctaggatttgtacacgagaagagttcacccggaaagtgagatccaacgctgccatcggcgcagtctttgtggatgaaaatcagtggaacagcgccaaggaggctgttgaggacgaaaggttctgggatctcgtgcaccgcgagcgtgaactgcataaacagggtaagtgcgccacttgcgtctataatatgatggggaagcgggagaaaaagttgggagaatttggcaaagcgaagggctctagagcaatctggtacatgtggctgggggccaggttcctcgagttcgaggctcttggatttatgaacgaagaccactggttctcacgcgagaatagtctgtccggtgtggaaggcgaggggttacataaactgggatacattttgcgagatataagcaagatcccaggcggtaacatgtatgccgacgatacagcagggtgggacacccggattacagaggatgacctccagaatgaagctaaaatcactgatattatggagcccgaacacgccctgctagctacctctatctttaaacttacgtaccaaaacaaggtagttagagtgcagaggcctgccaaaaatggaaccgtcatggacgtgatatcgcgcagagatcagcggggctcaggccaggtggggacatatggactgaacactttcaccaacatggaggtccaactcatcaggcagatggaaagcgagggtatttttctgccatccgagttggaaacacccaatttagcagagcgtgttctggactggctcgaaaagcacggcgcggagcgacttaaacgcatggccatcagtggggacgattgtgtggtaaagccgattgacgatagattcgctactgccctgatcgcactaaacgacatgggaaaagtgcggaaggatatacctcagtgggaaccctctaagggctggaatgactggcagcaagtcccattttgcagccatcacttccatcagctgattatgaaagatggtagggagatcgtggttccttgtcgcaaccaggacgagctcgtggggagagctcgggtctcccagggagccggctggtcattgagggaaaccgcatgcctgggcaagagttacgcccaaatgtggcagcttatgtattttcaccgacgtgatctgagactcgcggctaatgccatctgttctgcagtgcccgtagactgggttccaacgagccgcacaacctggtccattcacgcccatcaccagtggatgactacagaggatatgttatcagtgtggaaccgggtctggatagaagagaatccctggatggaagacaaaacccatgtgagctcttgggaggaggttccttacctggggaagagggaagaccaatggtgcggatccttgatcggtctgactgctagagccacctgggcaacaaacattcaggtggctatcaatcaggtccgccggctcattggcaacgagaattatcttgattacatgacgagtatgaaaaggttcaagaacgaaagcgacccagagggggccctgtggtga

SEQ ID NO: 14111 - RNA, 9879 nt, synthetic construct
  misc_feature 1..9879: note = derived and/or modified CDS sequence (opt3) from DENV-1__KC759167__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcggtgacccagaagggcattatcttcatactcttaatgctggtcacgccatcaatggccatgcgctgcgtggggatcggaagcagagattttgtagagggtcttagtggcgcgacttgggttgacgtggtcttggagcacgggtcctgtgtgacaaccatggcaaaggataaacccactctggacattgaactactcaagacagaggtgaccaaccctgccatcctgaggaaactttgcattgaagctaagatctctaatacgaccacagatagccggtgtccaactcaaggagaggcccccgaagtcgaggagcaggacgcaaacttcgtttgccgccgaacctttgtggatagaggctggggtaatgggtgtggactgttcggcaaaggctccttgataacatgcgctaagtttaagtgcgtaactaaactcgaagggaagattgtgcagtacgagaacctgaaatattcagtcatcgtgaccgttcacacaggagaccagcatcaagtgggtaatgaaagtaccgagcacggcactacggccacaattacccctcaggcgccaactaccgaaatccagttaacagactacggggccctgaccctcgattgtagcccgaggactggacttgacttcaacgagatggtcctgttgacaatgaaggagaaatcttggctagtgcataagcagtggtttctggatctccccctgccttggacgtccggcgcatcaaccagccaagaaacttggaatcggcaggaccttctggtaacattcaaaaccgctcacgccaagaagcaggaggttgtggtcttgggtagtcaagaaggggctatgcacacagccctcactggcgcaaccgagatccagacgtctggaaccacaactatttttgccggccatctgaaatgccgtttaaagatggataaactgaccctaaaggggatgtcctatgtgatgtgtacaggaagcttcaaactcgaaaaggaggtcgctgagactcagcacggtaccgtgctggttcagataaagtacgaaggcacggacgcgccatgcaaaatccccttctcgacacaagatgagaagggggtgacccagaacggacgccttattactgcaaatcctatcgtaacagacaaagaaaagccagtcaacatagaggccaaacccccgtttggcgagtcttgtattgtgatcggtgctggggaaaaggccttgaagctgtcctggttcaaaaagggctcaagtatcggaaaaatgtttgaggcaaccgccagaggcgctaggcggatggccattctcggggatactgcatgggacttcggaagcatcggtggcgtttttacctccgtggggaagctggtccatcagattttcggaacagcgtatggcgtgcttttttctggtgtaagctggacgatgaaaatagggatcggcgtgctgttgacctggctcggactgaattcacgaagtacttccttaagcatgacatgcattgctgttggcctggtcaccctatacctcggggtgatggtgcaggccgattctggatgtgtcatcaactggaagggccgcgaactgaagtgcggttcagggatcttcgttacaaatgaggtgcacacttggaccgaacaatacaaatttcaggcagacagtcctaagagacttagcgccgctattggaaaagcctgggaggagggcgtgtgtggtataaggtccgcaacgcggttggaaaacatcatgtggaagcagatttctaacgagctgaatcatatcctcctggaaaacgacatgaaattcacagtagtcgtgggcgatgttgctgggattttagcccagggaaagaaaatgatccgcccccaaccaatggagtataagtactcgtggaagagctggggcaaagcgaagataatcggggccgacgtgcagaataccacttttattatcgatggacctaacacccccgaatgcccagacgatcagagagcttggaatatttgggaggtcgaggactatggcttcggtatctttacaactaacatatggctgaaacttagggattcctacacccaggtgtgtgaccaccgtttgatgtcagcagccattaaggatagtaaagctgttcacgccgacatggggtattggatcgaatctgagaagaatgaaacatggaagctcgcacgggcgagcttcattgaggtgaaaacgtgcatctggcccaagtcccataccctgtggtcaaacggagtactagaaagcgagatgataatccctaaaatttacggcggtccaatctctcaacacaattatcgaccgggctacttcactcagacagccgggccctggcatctgggaaagctcgagctggattttgacctttgcgaaggcaccactgtcgtggtggatgagcactgtgggaacagaggaccttccttgaggacaaccacggtcactggcaaaattatccacgaatggtgctgtcgcagttgcaccccaccccctctgcggttcagaggtgaggacgggtgttggtacggaatggagataaggccagttaaggaaaaggaggaaaatttagtgaaaagcatggtatctgctggctccggtgaggtggactcatttagtctcggcctgctttgcattagcatcatgatcgaagaggtcatgcgctcgcgatggtcccggaagatgctgatgacaggggccttggcagtgttcctcctgctaattatgggacagctgacctggaacgatctcatccgtctgtgtattatggttggcgctaatgcctctgacagaatggggatgggaactacatatcttgcattgatggccacctttaaaatgaggcccatgttcgctgtgggcctgttatttcgcaagctcacaagccgggaggtcctgcttctgactataggtctatcactcgtggcgagtgttgaactgccgaactccttggaggaactgggggatggattagccatgggcatcatgattctcaaactgcttaccgacttccaatctcatcagctgtgggcaacgttgctcagcctgacatttatcaagaccactttctccctacactacgcttggaagaccatggccatggtgctgtcaattgtcagcctttttcctctctgcctgagtacaacttctcagaaaaccacgtggttgccagtactgttaggctccctcgggtgtaagcccctgacaatgttccttatcgccgagaataaaatatggggaagaaggagctggcctctgaacgaaggtatcatggctgtgggcattgtttcgatcttgctctcatctctgctaaagaacgatgtgcccctggcagggccacttattgccggaggcatgctcatcgcgtgctatgtcataagtggttccagcgctgacctgtctttggagaaagccgcagaggtgagctgggaagaggaagccgagcattccggggcttcacacaatattttagtagaagtgcaggatgacggaaccatgaagatcaaagatgaggagcgagacgatactctgacaatcctcctgaaggcaacccttctggccgtcagtggcgtttaccctttgagcattcccgcgactctatttgtgtggtatttctggcgcaagaaaaagcaacggtctggcgtgctgtgggacacaccatccccgcctgaagtcgagagagctgtgctcgatgacgggatatacaggatcatgcagcgtggactgcttggtcgctcacaggttggcgtaggggtgttccaggaaaacgtctttcataccatgtggcacgtgacgcggggagccgttttaatgtatcaaggcaaaagactggagcccagttgggcaagcgtgaagaaagacctcatttcctacggtgggggatggaggttgcagggctcttggaatactggcgagggggtccaggtgatcgccgtagaaccaggaaagaaccccaagaatgtccagaccgctcctggtacattcaaaaccccagagggcgaagtgggggccattgcactggattttaagcccggaacatcgggcagccctatcgttaaccgagagggtaaaatagtggggctctacggaaatggcgtcgtgactacctcaggcacgtatgtttccgctatcgcccaagcgaaggccagtcaggaagggccgctgccagagattgaggacgaagtgttccggaaacgcaaccttacaatcatggatctgcaccccggatctggtaagactagaaggtacttgcctgcaattgtccgggaggctatcaagcgaaaactaagaaccctgatactcgccccaacacgcgtggtagctagcgaaatggcagaggccttaaagggcatgcccattaggtatcagaccactgccgtgaaatccgaatacaccgggaaggagatcgttgacctgatgtgtcatgctacatttacgatgcgtcttctgtcacctgtccgggtgccgaattataacatgatcattatggatgaggcgcacttcactgacccctctagcatcgcagccagaggatacataagtaccagggtgggcatgggtgaagctgccgcaatttttatgacagccaccccacctgggtccgtcgaggctttcccccaaagcaatgcggtaatccaggatgaagagcgcgacattccagaacgatcttggaactcaggatatgagtggatcactgattttcctggcaaaacagtgtggttcgttccctccataaagagtggcaatgacattgccaactgcctcagaaagaatgggaaacgggtgatccagttgagcaggaagacctttgatacggagtaccagaaaactaagaacaacgactgggactacgtcgtgacaaccgatatctcggaaatgggagcaaatttccgcgctgaccgtgttattgatccaagacggtgcctgaaaccggtgatcctcaaggacggtcctgagagggtcattctggccggccccatgccagtgaccgtagcatctgccgctcaacgccgagggagaataggacggaaccataataaggaaggcgatcagtatatctacatgggtcagccccttaacaatgacgaggatcacgcccattggactgaggcgaaaatgctactggacaacattaatacacctgaagggatcatcccagcattgttcgagcccgaaagggagaagtccgccgctattgatggcgaatatcgcttaagaggagaggccaggaaaacctacgtggagctgatgcggcgtggcgacctccctgtttggctgagctataaggtcgcttcagaagggtttcagtacagtgatcgccgatggtatttcgacggagagagaaacaatcaagtgcttgaagagaacatggatgtggaaatatggacaaaagagggtgagaggaagaaactgcggccgcgctggctcgacgcaagaacttactctgacccattggccctgagggaatttaaggagttcgctgccggccggcgatccgtcagcggggatctaatcctggaaattggaaagctcccccagcaccttacgcagagagcacagaatgcgctggacaacttagttatgttgcacaattcagagcaaggcggtcgcgcctacaggcatgctatggaagagctgcctgataccatcgagacactcatgctgcttgccctgattgcagtgctcactgggggcgtaaccttgtttttcctgagtggacggggcttagggaaaacaagcatcggactactgtgtgtgatggcttcctctgtcctcctttggatggccagcgtggaaccccactggatagcagcctccatcattctggagtttttcttgatggttctgctcatcccagaacctgaccgtcagagaaccccccaggataaccagctggcttatgtggtcattggtcttctctttatgatcctgactgtagcggccaatgagatgggcttgctggagacgaccaagaaagacttagggataggacatgtggcagttggcaaccaccaccatgctgccatgctagatgtggacctgcacccagcctcagcatggacactctacgctgtcgccactaccattatcacacctatgatgaggcataccattgaaaacactacagcgaatatctctcttacggctatagccaaccaagcagccatcctgatgggtttggataaggggtggccgattagtaaaatggacatcggcgtgcccctgctcgctctgggatgctattcgcaggtcaatccacttaccttaactgcagccgtgctgatgctcgttgcgcactacgctattatcggccctgggttgcaggccaaggcaacacgcgaggcccaaaagcggaccgctgccggaataatgaaaaaccccaccgtggatggcattgtagcaatcgacctggatccagtggtctatgacgctaagttcgaaaaacagctaggtcagatcatgctgctcattctttgtacaagccagatcctgttgatgcgaactacgtgggccctgtgcgagtccataaccctcgcgacagggcctctgactaccttatgggaaggatctcccggcaagttttggaatacaaccattgccgtttcaatggcaaacatcttcagaggtagctaccttgctggcgccgggctggcattttccctcatgaaaagtctaggaggcgggaggcgcggaactggcgctcaaggtgagacgctgggggagaagtggaagcggcagttgaatcagctgtctaaactcgaattcaacagctataagagatcaggaattatggaggtggaccgttccgaagccaaagagggccttaagaggggtgaaacaaccaaacatgccgtcagtcggggcactgcgaagctgcgctggttcgtggagcgaaatttggtaaagccggaggggaaagtgatcgatctgggatgtggcagagggggatggagctactactgcgctggcctcaagaaagttaccgaagtgaagggttatacaaaagggggaccaggccacgaggaacctatacccatggcaacttacggctggaacttagtcaagctgcactctgggaaagacgtgtttttcatcccacccgagaagtgtgatacccttctgtgcgacattggagaatcctcacctaatccgacaatcgaggagggtaggacgctacgggtcctcaagatggtggaaccctggctgcgcggcaaccagttttgtattaaaatcttgaatccatatatgcctagcgttgtagagaccctggaacaaatgcagagaaagcatgggggaatgctcgtgaggaaccccctttcgcgaaattctactcacgagatgtactgggtcagttgcggcacaggtaacattgtgtccgccgttaatatgaccagccggatgctgttaaaccgtttcactatggctcatagaaaacctacatatgagcgcgatgtggacctgggggccggaaccaggcacgtcgcagtggaaccagaggtagccaacttggatatcataggccagcggattgaaaatatcaagcacgagcataaatcaacgtggcactacgacgaagataacccctataagacctgggcttaccatggctcctacgaggtgaagccttctgggagcagttccagcatggttaatggagtcgtgaaactcctgacaaagccatgggacgtgatccccatggtcactcagattgcgatgaccgatacaactccgtttggtcaacagagagttttcaaagagaaggtggacacccgcacacctaaagccaagaggggcaccgcacagataatggaagtaactgctaagtggctatgggggtttctttctcgaaacaaaaagccacggatctgtacgagagaggaattcacaaggaaagtgcgctcaaatgccgcaattggagccgtctttgtggacgagaaccaatggaatagtgctaaggaagccgttgaggatgagcgtttctgggacctggtgcaccgggaaagagagctccataaacagggcaagtgcgcgacctgcgtctataacatgatgggtaagagggaaaaaaagctgggggagtttggaaaagcaaagggctcccgcgccatctggtacatgtggttgggcgctcgattcctggaatttgaggccctcgggttcatgaatgaggatcactggttcagccgggaaaactctctttcgggagtggagggtgaaggcctgcacaaattagggtatattctgagagacatctcaaagatacccggaggcaatatgtacgcagatgacactgctggttgggataccaggatcacagaggacgatttgcagaacgaggcccgcattacggacatcatggaacctgagcatgctctcctggccaaaagcatttttaagctaacctatcagaataaggtagttagagtgcaacggccagcaaaaaacgggactgtcatggatgtgatctccaggcgtgaccagcgaggaagtggccaggtgggcacatacgggcttaataccttcactaacatggaagcgcagctgatacgccaaatggagtctgaagagatttttagcccctccgagctcgaaacaccgaacctggccgagagagtcttggattggttagaaaagtatggaatcgagcggctgaaaaggatggctatctcaggtgacgactgtgttgtgaagcctattgataatcgcttcgccaccgcactcacagctcttaacgacatgggcaaagtaagaaaggatataccccagtgggaaccaagtaaggggtggaatgactggcagcaggtgcctctgtgctctcaccattttcaccaactaatcatgaaagatggacgggagattgtcgtgccctgtaggaaccaggacgagctggttggccgagcccgtgtgagccagggtgcagggtggtccctcagagaaactgcctgcttgggaaagtcatacgcgcagatgtggcaactgatgtacttccaccgccgggatcttaggctggctgccaatgcaatctgtagcgccgtcccagtggactggattcccacctctagaacgacctggtccatccatgctcaccatcagtggatgacaactgaggatatgctcagtgtatggaaccgcgtttggatagaagagaatccttggatggaagacaaaacccacatcagctcgtggggcgatgtgccatatttaggcaagcgggaggaccagtggtgcgggtccctgattggattgacagccagggcaacttgggctaccaacatccaagtcgccattaatcaggtgcgaagactgatcggtaacgagaattacctcgactatatgacgtctatgaaacggtttaagaacgaatcagatccggagggcgcgctttggtga

SEQ ID NO: 14112 - RNA, 9879 nt, synthetic construct
  misc_feature 1..9879: note = derived and/or modified CDS sequence (opt3) from DENV-1__JQ048541__SS-prME
  source 1..9879: mol_type = other RNA
tccgtgaccatgctgctcatgcttatgcccacagcactggctttccacttgactacgagaggaggggaacctcatatgatcgtctccaagcaggaaaggggaaaatctttactgtttaagacctcagccggtgttaatatgtgcacactaattgcaatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggagcttcaaactggagaaggaagtcgctgagacccagcacggtacggtgcttgttcagataaagtacgagggcacagacgcgccttgcaaaatcccattcttgacccaagatgaaaagggggtgactcagaacggacgcctgattacagcaaatcccatcgtaaccgacaaagagaagcctgtcaacatagaagccgagccaccctttggcgagtcgtatattgtgatcggtgctggggaaaaagccctcaagctgtcttggttcaagaaaggctcctcaatcggaaagatgtttgaggcaactgccagaggcgctaggcggatggccattcttggggataccgcatgggacttcggaagtatcggtggcgtttttacaagcgtggggaaactggtccatcagattttcggaacggcgtacggcgtgttgttttccggtgtatcttggaccatgaagatagggatcggcgtgctcctgacttggttaggactgaatagccgatcaacaagtctatccatgacctgtattgctgttggcctcgtcacactgtaccttggggtgatggtgcaggccgatagcggatgcgtcatcaactggaaaggccgcgaattgaagtgtggttctgggatcttcgttactaatgaggtgcacacctggacggaacaatataagtttcaggcagactcaccgaaaagactgagtgccgctattggaaaggcctgggaggagggcgtgtgcggtataaggagcgcaacacggctcgaaaacatcatgtggaaacagatttccaacgagctgaatcatatcttactggaaaacgacatgaagttcaccgtagtcgtgggcgatgttgctgggattcttgcccagggcaagaagatgatccgccctcaacccatggagcacaaatactcttggaagtcgtggggcaaggcgaaaataatcggggccgacgtgcagaatactacctttattatcgatggaccaaacacacctgaatgtcccgacgatcagagagcttggaatatttgggaggtcgaggactatggcttcggtatctttactaccaacatatggttgaagctcagggatagctacacacaggtgtgcgaccaccgtctgatgtccgcagccattaaagattcaaaggctgttcatgccgacatggggtattggatcgaaagtgagaaaaatgaaacgtggaagctagcacgggcgtctttcattgaggtgaagacctgtatctggccaaaaagccacactctgtggtccaacggagtactcgaatcagagatgataatccccaagatttacggcggtcctatcagccaacataaactgcgaccaggctatttcacacagaccgccgggccgtggcaccttggaaagttggagctggattttgacttatgcgaaggcactacagtcgtggtggatgagcactgcgggaatagaggaccctctctcaggaccacgactgtcaccggcaaaattatccatgaatggtgttgccgctcctgtacactgcctccacttcggttcagaggtgaggacgggtgctggtacggaatggagataaggcccgttaaggaaaaggaggaaaacctggtgaaaagtatggtaagcgctggctctggtgaggtggactccttttcattgggcctcctgtgtattagtatcatgatcgaagaggtcatgcgcagccgatggtcgcggaagatgctaatgaccgggactctggccgtgttctttctcctgattatgggacagcttacatggaatgatttgatccgttcctgcattatggttggcgcaaacgcttctgacagaatggggatgggaaccacatacctggccttaatggcaactttcaaaatgaggcctatgtttgccgtgggcctcctgttccgccggcttaccagcagagaggtcctgctactcacgataggtctgtcattggtggctagtgttgaactgccaaattccttagaggaactcggggatggactggcgatgggcatcatgattcttaagctgttgacagactttcaatctcaccagctctgggccaccctgctaagcctgactttcatcaaaaccacattttcccttcattatgcatggaagactatggctatggtgctctcaattgtcagcctgttccccttgtgtctgagtaccacgtctcagaagacaacctggttaccggtactcctgggctcccttgggtgcaaacctctgactatgtttttgatcgccgagaacaagatatggggaaggaaaagctggccactcaatgaaggtatcatggccgtgggcattgtttcgatcctgctatcatctctgcttaagaacgatgtgcccctcgctgggcctctgattgcaggaggcatgttgatcgcctgttacgtcataagtggttccagcgcggacttatctctggagaaagctgccgaggtgagctgggaagaggaagcagagcactccggggcctcacataacattctcgtagaagtgcaggatgacggaacaatgaagatcaaagatgaggagcgagacgataccctgactatccttctgaaggctacattgctagcagtcagtggcgtttatcccctgagcattccagccaccctcttcgtgtggtacttctggcaaaagaaaaagcagcgctctggcgtgctgtgggacacgccttcacccccagaagtcgagcgggcggtgcttgatgacgggatatatagaatcatgcagaggggattactgggtcgtagccaggttggcgtaggggtgtttcaagaaaatgtcttccacactatgtggcacgtgacccgcggagctgttctcatgtaccagggcaaacggttggagccgagttgggccagcgtgaagaaagacctgatttcctatggtgggggatggagactccagggctcttggaacacaggcgaggaagtccaggtgatcgcagtagagcctgggaagaatcccaagaacgtccaaaccgccccaggaacatttaaaactcccgaaggtgaggtgggcgctattgccctggatttcaagcctgggacctcgggaagcccaatcgttaatagggaaggcaaaatagtgggtctttacgggaacggagtcgtgacgacatcaggcacttacgtttccgcaatcgctcaggccaaggcgagtcaggagggccccctgcctgagattgaagacgaggtgtttcgaaaacggaatttgaccatcatggatctacatccggggtctggaaagacacgcagatatctgccagccattgtcagggaagcaatcaagcggaaactccgaaccttaatactggctcccactagagtggtagccagcgagatggctgaagcacttaagggtatgcctattcgctaccaaaccacagccgtgaaatccgagcacacgggcaaggagatcgttgacctgatgtgccatgccactttcaccatgaggctcttgtcaccagtccgtgtgcccaactataatatgatcattatggatgaagctcactttacagacccttctagcatcgcggcacgggggtacataagtaccagagtgggaatgggcgaggccgctgccattttcatgactgcaacaccgcccggttccgtcgaagcctttccacagagcaacgctgtaatccaggatgaggaaagggacattcctgagcgctcttggaactcagggtatgagtggatcaccgatttccccggaaaaacggtgtggtttgttccatccataaagagtggcaacgacattgcgaattgtctgcgaaagaacggcaaaagagtgatccagctcagccggaagactttcgatacagaataccagaagaccaagaataacgactgggactatgtcgtgaccactgatatctcggagatgggggccaacttcagggcagaccgcgttattgatcctcgtagatgcctgaaacccgtgatccttaaggacggaccagaacgggtcattctagctggtccgatgcctgtgacagtagcctctgcagcccagaggcgcggccgaatagggagaaatcataacaaggagggagatcagtacatctacatgggccagcccctgaataacgacgaggatcacgctcactggaccgaagccaaaatgttgttagacaatattaacacaccagagggtatcatccccgcgctgtttgaacctgagcgggaaaagtccgcagccattgatggggagtataggctccgcggcgaggctagaaaaactttcgtggaactgatgaggcggggagaccttccagtttggctgagctacaaggtcgcctcagagggctttcaatatagtgatcgtcgctggtgcttcgacggggaacgaaataaccaggtgctcgaggaaaatatggatgtggagatatggacgaaagagggagaaagaaagaaattgaggccccggtggctggacgctcgcacctactctgaccctctagcactgagagagtttaaggagttcgccgctggtaggcggtccgtcagcggcgatctcatccttgagattgggaagctgccgcagcatttaacacagcgagcccaaaacgcattggacaatctggttatgctccacaactcagaacagggaggcagagcgtatcgccatgccatggaggagctgccagatactatcgaaacccttatgctgctcgctttgattgccgtgctgacaggtggggtaaccttatttttcctaagtggcaggggactgggcaaaactagcatcgggctcctttgtgtgatggcatcctctgtcctgttgtggatggctagcgtggagccccactggatagccgcatccatcattctggaatttttcctcatggttctgcttatccctgagcccgaccggcagcgtacgccacaggataatcaactcgcctacgtggtcattggactgttgtttatgatcctgaccgtagctgcgaacgagatgggtttactagaaacaactaagaaagacctgggcatagggcacgtggccgttgagaatcatcaccatgcaaccatgctcgatgtggaccttcaccctgcttcagcctggacactgtatgccgtcgcaaccactattatcacacccatgatgagacatacgattgaaaacaccactgctaacatctctttgacagccatagcgaatcaggctgccatcctgatgggactcgataagggctggccaattagtaaaatggacatcggtgtgcctctgcttgcattagggtgctactcgcaggtcaacccgctgaccctcaccgccgctgtgttgatgctggttgcacactacgccattatcggccccggactacaagcgaaggctacaagggaggcccagaagcgcactgcagccggcataatgaaaaatccaacggtggatgggattgtagctatcgacctggatcctgtggtctatgacgccaagttcgaaaaacagctcggacagatcatgcttctgattttgtgtaccagccaaatcctgctcatgcggacaacttgggcactgtgcgagtccataaccttagctacaggcccccttaccactctgtgggagggttctccagggaagttttggaacacgacaattgccgtttcaatggcgaatatcttccgaggaagctacctcgccggcgcaggtctagctttctccctgatgaaaagtttgggcgggggaagaaggggcaccggggcccagggagaaactctgggcgagaagtggaagcgccagctcaaccagctttctaaaagcgaatttaatacctataagcggtcaggtattatggaggtggacagatccgaagcaaaagaggggctgaagcgtggagagacaactaaacacgctgtcagtaggggcaccgccaagttgcggtggttcgtggaacgcaacctggtaaagcctgagggtaaagtgatcgatctcggctgtgggcgaggaggctggagctactattgcgccgggttaaagaaagttacagaagtgaagggatacacgaaaggcggtcccgggcatgaggaaccgataccaatggcgacctatggatggaatctggtcaaactttactctggcaaagacgtgtttttcatgcctcccgagaagtgtgatactctgctatgcgacatcggcgagtcctcaccaaaccccacaattgaagaggggagaaccctcagggtcctgaagatggtggaaccttggttgcggggaaatcaattttgtatcaaagttctgaacccgtacatgcccagcgtagtggagactctcgagcagatgcagcgcaagcacggtggcatgcttgtcagaaatccactgtcgaggaactctacacatgaaatgtattgggtgagttgcgggaccggaaatattgtttccgctgtgaacatgacgagccgaatgttactgaatcggttcaccatggcacaccgtaaacctacatacgagagagatgtcgacttgggcgccggtactcgccacgtggctgtagaacccgaggtggccaacctcgatatcattgggcagaggatcgaaaacataaagcatgagcacaaatcaacctggcattatgacgaggataatccttacaagacatgggcatatcacggatcctacgaagttaagccatctggcagcgccagttccatggtcaacggcgtggtgaaactgctaactaagccctgggacgtcattcctatggttacccaaatcgctatgacagataccactccatttgggcagcagcgggtgttcaaagagaaggtagacacgagaacacccaaagcgaagcgcggaaccgcccaaatcatggaagtgactgcaaggtggctttggggttttctgagccgaaataagaaaccgcggatttgtaccagagaggagttcacaaggaaggtccgctctaacgctgccataggcgcagtgtttatcgacgagaatcagtggaactcagccaaagaggctgttgaagatgagcgtttctgggacctcgtgcatcgggaaagagagctgcacaagcaggggaaatgcgccacgtgcgtctataatatgatgggaaagagggaaaagaaattgggcgagtttggtaaggcgaaagggagtcgcgcaatttggtacatgtggctgggagcccgattcctcgagttcgaagctcttggctttatgaacgaggatcactggttctcccgggaaaatagcctgtctggcgtggagggggagggattacataagctgggttacatcttgagagacatttcgaaaatccctggcgggaacatgtatgccgatgacaccgcaggatgggatactaggataacagaagacgatctccagaatgaggctaagatcaccgacattatggaaccagagcacgccctgctagctaaagccatctttaaacttacttaccaaaacaaggtagttcgcgtgcagagacccgccaaaaatggcacagtcatggatgtgatttcacggagggaccagcgtggtagcggacaggtgggaacctatggcctgaacacattcactaatatggaagcgcaactcatccgacagatggagtccgagggcatatttagtccttctgaactggagaccccaaacttggccgaacgcgtcttagattggctggagaagtacggggttgaaagactcaaacggatggctattagcggagacgactgtgtggtaaagcccatcgatgacaggttcgccacggcacttaccgctctgaacgatatgggtaaagtgcgcaaggacatcccgcagtgggagccttccaagggctggaatgattggcagcaagtccccttttgctcacatcacttccaccagctaattatgaaagacgggagagagatagtggttccatgtcggaaccaggatgaactggtgggaagggcccgagtcagtcagggcgcaggttgggggctccgtgagacagcctgcttgggaaagtcttatgcgcaaatgtggcagctgatgtactttcatagacgcgaccttcggctggctgccaatgcaatctgtagcgccgtgcctgtagattgggttcccacttccaggaccacatggtcaattcacgctcatcaccagtggatgactaccgaagacatgctcagcgtgtggaacagagtctggatcgaggaaaatccatggatggaggataaaacgcatatttcttcctgggaggacgtgccctatttaggcaagcgcgaagaccaatggtgcggcagtctgatcgggttgacagcccgggcaacctgggctactaacatacaggttgccatcaatcaggtgaggcgactgattggaaacgagaattacctcgattacatgacaagcatgaaaagattcaagaacgaatcggaccctgagggtgcgctttggtga

SEQ ID NO: 14113 - RNA, 9879 nt, synthetic construct
  misc_feature 1..9879: note = derived and/or modified CDS sequence (opt3) from DENV-1__JN697056__SS-prME
  source 1..9879: mol_type = other RNA
agcgtgaccatgctgctcatgcttctgcccaccgccttgactttccacttaacgacccgaggaggggagcctcatatgatcgtctccaagcaggaaaggggaaaatctctgttgtttaagacgtcagctggtgttaatatgtgcactctcattgcaatggacctgggcgagctttgtgatgacaccatgacatacaaatgcccacggataaccgaaactgagccggatgacgtggattgttggtgcaatgccacagaaacctgggtaacgtatgggacttgtagtcaaaccggagagcaccgccgagacaagcgtagcgtggcgctggctccccatatcggcttgggtctcgagacaagaactgaaacctggatgtcctctgagggggcctggaggcagattcagaaagtcgaaacatgggcactgcggcaccctggattcaccgtgatcgccctgtttctcgctcatgcaattggcacgtcgatcactcagaagggcataatcttcattttactgatgcttgttacaccatcaatggccatgcgctgcgtggggatcggaaacagagattttgtcgagggtttgagcggcgctacctgggtggacgtagttctggagcacgggagttgtgtgactacaatggccaaggataaacccaccctagacattgaactcctgaagacggaggtcaccaatcctgcggtgcttaggaaactgtgcatcgaagcaaagatatccaacacaactaccgattctcggtgtccaacacaaggagaggccactttggtggaagaacaggacaccaatttcgtctgccgccgaacatttgttgatagaggctggggtaacgggtgtggactcttcggcaaaggcagcctgattacctgcgctaagtttaagtgcgtgactaaattagaggggaagatcgtacagtacgaaaatctgaaatattccgtgattgtcacggtgcacacaggagaccagcatcaagttggtaacgagaccactgaacacggcaccatcgccacaatcacaccccaggcacctacttcagagattcagctcacagactacggggctcttacgctggattgtagtccaaggaccggattggacttcaatgaaatggtgctactgactatgaaggagaaaagctggctcgtccataagcagtggtttctggatcttccgctgccctggacatctggcgcctccacctcacaagagacatggaaccggcaggacttgctcgtgactttcaaaaccgcgcacgccaagaagcaggaagtagttgtgctgggtagccaagagggggcaatgcacacggctttaaccggcgccacagaaatacagacaagtggaaccacaactatctttgctggccatctgaaatgccgtctaaagatggataaactcaccctgaaggggatttcttatgtcatgtgtacgggacctttcaaacttgagaaggaagtggccgagacacagcacggtaccgtcttggtgcaggttaagtacgagggcactgacgcaccatgcaaaatccccttctccagccaagatgaaaagggggtgacacagaatggacgcctggtaaccgccaaccctatagtcactgacaaagagaagccagtgaatattgaagctgagcccccgtttggcgagtcgtatatcgttgtgggtgcgggggaaaaagcactcaagctgtcttggttcaagaaaggctcctcaatcggaaagatgtttgaggccaccgctagaggcgccaggcggatggcaattcttggggatacagcctgggacttcggaagtatcggtggcgtctttacgagcgtggggaaactggtacatcagattttcggaaccgcttacggcgtgttgttttccggtgtttcttggactatgaagatagggatcggcattctcctgacatggttaggactgaacagccgatcaaccagtctatccatgacatgtatcgccgtcggcatgatcactctctacctgggggtgatggtgcaggcagatagcggatgcgtcattaattggaaaggccgcgaacttaagtgtggttctgggatattcgttaccaacgaggtgcacacgtggacagaacaatataagtttcaggcggactcacctaaaagattgagtgctgccatcggaaaggcatgggaggagggcgtgtgcggtattaggagcgccacccggctggaaaacatcatgtggaaacagatttccaatgagctcaaccatatcctgttagaaaatgacatgaagttcactgtagtcgtgggcgatgtttctgggatactggctcagggcaagaaatcgatccgcccccaaccaatggagcacaaatacagctggaagtcctggggcaaggccaaaattatcggggcagacgtgcagaacaccacatttattatcgatggacctaatactcccgaatgtccagacgatcagagagcttggaacatatgggaggtcgaggactatggcttcggtatttttaccacaaatatctggcttaagttgagggattcatacacacaggtgtgcgaccaccgtctcatgagtgccgcgattaaagattctaaggccgttcatgctgacatggggtattggatcgaaagcgagaaaaacgaaacctggaagctggcacgggcctccttcatagaggtgaagacttgtatctggcccaaatcacacacactatggagcaatggagtactggaatctgagatgattatccctaagatttacggcggtccaatctcccaacataactatcgaccgggctacttcacccagactgctgggccctggcacctcggaaaactggagcttgattttgacttgtgcgaaggcacaaccgtcgtggtggatgagcactgcgggaatagaggacctagtctgaggacgactaccgtcacaggcaagataattcatgaatggtgttgccgcagctgtaccttaccacccctccggttcaaaggtgaggacgggtgctggtacggaatggagatcagacctgttaaggaaaaggaggaaaacctggtgaaatctatggtatccgccggctcaggtgaggtggacagttttagccttggcctgttgtgtatctcgattatgatcgaagaggtcatgaggtcccgctggtctaagaaaatgctcatgactgggacactggcagtgttcctactgctcaccatgggacagctgacatggaatgatcttattcgattgtgcataatggttggcgcgaacgccagcgacaatatggggatgggaactacctatctggctttaatggccacgtttcggatgcgtccaatgttcgcagtgggcctcctgtttagaaggcttacatcacgcgaggtcctgctactcaccgtgggtctgagtttggttgcttccgtggaactgcccaactctttagaggaactcggggatggactggccatgggcatcatgattcttaagctgttgactgacttccaaagccaccagctctgggcaaccctgctatccctgacatttgtcaaaactaccttctcacttcattacgcctggaagacgatggctatgatcctcagcattgtaagtctgttgccgctgtgtttatctacaacctcccagaagactacatggctccctgtgctgcttggcagcctggggtgcaaaccattgaccatgtttctcatcactgagaacaagatatggggacggaaatcgtggcccctgaatgaaggtatcatggcggttggcattgtgtcaatcctactgtctagtcttctcaagaacgatgtccctctggccgggcccttgattgcaggaggcatgttaatcgcttgttatgtgatatccggtagctctgccgacctgagcctcgagaaagccgctgaggtatcctgggaagaggaagcagagcactcaggggccagtcataatattctggtggaaatccaggatgacggaacaatgaagatcaaagatgaggagagagacgataccattacgatacttctgaaggcgactttgctagctatcagcggcgtctacccaatgtctattcctgccaccctgttcgtttggtatttttggcaaaagaggaaacagcgatccggcgtgctctgggacacaccctcaccaccggaagtggagcgcgcagtcctggatgacgggatctaccggattcttcagagaggattactgggtaggagtcaggtgggcgttggggtattccaagaaggagtgttccacaccatgtggcacgtcacacgtggcgccgtgctcatgtatcagggtaagcgcttggagcctagctgggcttccgttaaaaaggacctgatctcttacgggggaggctggcggtttcagggctcgtggaacactggggaggaagtgcaggtcatagcagtggagcccggcaaaaatccaaagaacgtacaaaccgcccccggtacgttcaagacaagcgaaggcgaggtcggggcgatcgctctcgattttaaacctggaacttcaggctccccaattgtgaatagagaaggtaagatcgttgggctgtacggaaacggcgtggtcaccacaagtggcacctatgtgtctgccattgcacaggccaaagctagccaggaggggccccttcctgagatcgaagacgaggttttcaggaagcgaaatctgactataatggatttgcatccgggatccggtaaaacccggcgctacctaccagccattgtgagagaagcaatcaagaggaagctgcggacactcgtcttagctcccacgcgagtggtagcctcagagatggcggaagccctgaaaggcatgcctatcagatatcaaactaccgcagtgaagtctgagcacacagggcgcgagattgttgaccttatgtgccatgctacctttactatgaggctgctcagcccagtccgtgtgcccaactacaatatgatcataatggatgaagcccacttcacagaccctgctagtattgcagcccggggatatatctccaccagagtgggcatgggtgaggccgctgcgatttttatgacggcaactccgcccgggagcgtcgaagccttcccacagtctaacgctgtaatcttggatgaggaaaaagacatacctgagaggtcatggaactccggatacgattggattacagactttcccggcaagaccgtgtggttcgttccaagtatcaaaagcggcaacgatatcgccaattgtctgcgcaagaacgggaagcgagtgattcagctctcgagaaaaacctttgacactgagtatcagaagactaaaaataatgactgggattacgtcgtgaccacagacatctctgaaatgggagcaaacttccgggccgatagggttattgaccctcgccgttgcctgaagcccgtgatacttaaagatggtccagagagagtcatcctagctggcccgatgcctgtgactgtagcgtccgccgcacaacggagggggcgcattggacgaaatcagaacaaggaaggcgaccagtacatctatatgggtcagcccctgaataacgatgaggaccatgctcactggacggaggccaagatgttgttagataatatcaacaccccagaagggattatacccgcactgttcgagcctgaaagagagaaaagcgccgctatcgacggcgaataccggctcaggggagaggcccgcaagacatttgtggagctgatgagaaggggcgatcttccagtttggctgtcatataaagtcgcgagtgaagggttccaatactctgaccggcgttggtgctttgatggagagcgcaataaccaggtgctcgaagagaatatggacgtggaaatttggactaaggagggtgagagaaagaagttgagacccaggtggctggacgcacggacctattccgatcctctagccctgcgcgagttcaaagagtttgctgccggcagaaggagcgtctcaggggacctcatccttgaaattggaaagctgccgcagcacttaacacagcgggctcaaaacgcattggataatctggttatgctccataacagtgagcagggcggtaaggcctaccgacacgctatggaagaactgccagacaccatcgagactcttatgctgctcgccttgatagcagtgctgaccgggggagtaacgttattctttctaagcggaagaggcctggggaaaacatccatcggactcctttgtgtgatgtctagctccgcgctgttgtggatggcctcagtcgaaccccattggattgctgcctctatcattctggagttctttctcatggtgctgcttatccctgaacccgatcgccagaggactccacaggacaatcaactcgcatatgttgtgataggtctgttgttcatgattctgaccgtcgctgccaacgagatgggcttactagagacaaccaagaaagatctggggatcggacacgcagccgctgaaaaccaccatcacgcggccatgctcgacgtagatcttcatcctgcaagtgcttggactctgtacgccgtggccacaacgattatcacccccatgatgcggcacactatagagaatacaaccgcaaacatctcgttgaccgctattgccaatcaggcggctatcctgatgggcctcgacaagggttggccaattagcaaaatggatatcggggttcctctgcttgccttaggctgctactcccaggtgaacccgctgacactcactgcagccgtcttgatgctggtggctcattatgcaataattggacccggcctacaagccaaggcgacgcgtgaagctcagaagagaaccgccgcagggatcatgaaaaatccaacagtcgacggaatcgtggccattgatctggaccctgttgtgtacgacgctaagtttgagaaacagctcggccagatcatgcttctgatattgtgtacttctcaaattctgctcatgaggaccacatgggccctgtgcgaatcaatcaccttagcaactggtccccttacgacactgtgggaggggagcccaggaaagttctggaacaccactattgctgtatccatggccaatatctttcgcggcagttatctcgcgggtgccggcctagcattctctctgatgaaaagcctagggggaggccggcgagggaccggagctcagggcgagacactgggtgaaaagtggaagagacagctcaaccagctttcaaaatccgagttcaatatatacaagaggagtgggatcgtggaagtcgatcgcagcgaggccaaagaaggactgaagcggggcgagactaccaaacacgcagtttctagaggtacagctaagttgcgttggtttgtggagaggaacctggtcaagcctgaaggcaaagtgattgacctcgggtgtggacggggcgggtggtcctattactgcgccggattaaagaaagtaacggaggtgaagggctataccaaaggtgggcccggacacgaggaaccgatcccaatggccacttacggctggaatctggttaaactttactcaggcaaagatgtgttctttattcctcccgaaaagtgtgacacactgctatgcgatatcggggagagctcgccaaaccccaccattgaggaaggacgcactctccgagtcctgaagatggtggagccttggttgagaggtaatcaattctgtatcaaaatactgaacccgtatatgccctctgtcgtggaaacactcgagcagatgcagaggaagcatggcgggatgcttgttcggaatccactgagtcgcaactccacccacgagatgtactgggtaagctgcggaacgggcaatattgtgtcagcggtcaacatgacctccagaatgttactgaacaggtttacaatggctcatcgaaaacctacttatgaacgggacgtggatttgggtgcagggacccgtcacgttgccgtggagcccgaagtcgctaatctcgacatcatcggacagagaattgagaacataaagaatgaacacaaatctacatggcattacgatgaggacaacccttataagacttgggcctaccacggcagctatgaggtgaagccaagtggctccgcaagctctatggtaaatggggtggttcgcctgctaaccaaaccctgggatgtcatccctatggtgacacaaattgccatgaccgacactacgccattcggacagcagagggtgtttaaggaaaaagtcgacacacggacccccaaggctaaaagaggtactgcgcaaatcatggaggttaccgccaagtggctttggggcttcctgtcacgcaacaagaaaccgaggatttgtacacgagaagagtttacgcggaaggtgagaagtaatgcagctatcggggccgtattcgtggatgaaaaccagtggaactccgcaaaagaggccgtcgaggacgaaaggttttgggatctcgtgcgccgtgagcgggaactgcataagcagggaaaatgcgctacctgcgtttacaacatgatgggcaagagagagaagaaattgggtgagttcgggaaggccaaaggaagcagggcgatatggtacatgtggctgggcgcacgctttctcgagttcgaggcccttggcttcatgaatgaagaccactggttttctcgagagaactcgctgtcaggggtggaaggagagggtttacataagctgggctatatcttgcgggatattagcaaaatccctgggggaaatatgtacgctgacgatactgccggctgggacacaagaattaccgaggatgacctccagaacgaagcaaagatcactgatataatggagccagaacacgctctgctagccacatccattttcaaacttacctatcaaaataaggtcgtgagggtacagcgccccgctaagaacggtacagttatggacgtgatcagtagacgggatcagagggggtctggacaggtcggcacttacggcctgaacacctttacgaatatgggggcccaactcatccgtcagatggagagcgaaggaattttcctgccttccgagttggagaccccaaacttagcaggtcgagtgctggactggctcgaaaaacacggcatagagcgccttagacggatggcgatctcaggggacgattgtgtggtcaagcccattgacgataggtttgccacagctctgactgccctaaatgacatgggaaaagttcgcaaggatatcccgcagtgggaacctagtaaaggctggaacgactggcagcaagtgcccttctgctctcatcactttcatcagctgattatgaaggatggtagagagatcgtagtgccatgtcggaatcaggacgaactcgtcgggagggcacgagtgagccagggagctggctggtccttgcgtgagaccgcctgcctgggcaagtcatatgcacaaatgtggcagcttatgtacttccacagacgcgatctgcggctcgccgcgaacgctatatgtagcgccgttcctgtggactgggtccccacatctaggactacctggtccatccacgcacatcaccagtggatgacgacagaggatatgttaagtgtgtggaatagagtatggattgaagagaacccatggatggaagacaaaacccatgttagctcgtgggaggacgtgccctatctggggaagcgcgaagatcaatggtgcggatccttgatcggtctgactgcccgggctacatgggccaccaatattcaggtcgcaatcaaccaggtgaggcgactcattggcaatgagaactaccttgactacatgacttctatgaaaagatttaagaatgagtcagatcctgaaggggctctgtggtga

SEQ ID NO: 14114 - RNA, 9879 nt, synthetic construct
  misc_feature 1..9879: note = derived and/or modified CDS sequence (opt3) from DENV-1__JN697057__SS-prME
  source 1..9879: mol_type = other RNA
agcgtgacaatgctgctaatgcttatgcccacagcactggctttccacttgactacgaggggaggggagcctcatatgatcgtctccaagcaggaaaggggaaaatctttactgtttaagacatcagccggtgttaacatttgcacacttatagccatggacctcggcgagctgtgtgaagatactatgacctacaaatgcccacggatcacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagattcagagggtggaaacttgggctctccggcaccctggattcaccgttatcgcactgtttctggcccatgctattggcacatcgatcacccagaagggcataatcttcattctcttaatgctggtgacgccatcaatggccatgcgctgcgtcgggatcggaagcagagattttgtggagggtcttagtggcgcgacttgggtagacgttgtgttggagcacgggtcctgtgtcacaaccatggcaaaggataaacccactctggacattgaactgctcaagacagaggtgaccaaccctgccgtgctgaggaaactttgcatcgaagctaagatatctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcattacttgcgctaagtttaagtgcgtaaccaaactggaggggaagatcgtgcagtacgaaaacttaaaatattcagtcattgtgacagttcacaccggagaccagcatcaagtgggtaatgagagtactgaacacggcacgacagccaccatcactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaattcagacctctggaacaactaccatatttgccggccatttaaaatgccgtctgaagatggataaactaacactcaaggggatgtcctatgtgatgtgtactggtagcttcaaactggagaaggaagtcgctgagacccagcacggaacggtgcttgttcagatcaagtacgagggcacagacgcgccttgcaaaattccattctcgacccaagatgaaaagggggtgactcagaacggacgcttgatcacagcaaatcccatagtaaccgacaaagagaagcctgtcaacattgaagccgagccaccctttggcgagtcttatatcgtgatcggtgctggggaaaaagccctgaaggtttcctggttcaagaaaggctcaagtattggaaagatgtttgaggcaactgccagaggcgctaggcggatggccatcctcggggataccgcatgggacttcggaagcattggtggcgtgtttacatccgtcgggaaactggtgcatcagatattcggaacggcgtacggcgtactattttctggtgtgagctggaccatgaagatcgggattggcgttctgttgacttggctcggactaaattcacgaagtacatccttaagcatgacctgtatcgctgtcggcctggtgacactatacctcggggtgatggtccaggccgattctggatgcgttatcaactggaaaggccgcgaactgaagtgtggttcagggattttcgtgactaatgaggtgcacacctggacggaacaatataagtttcaggcagacagtccgaaaagacttagcgccgctataggaaaggcctgggaggagggcgtatgcggtatcaggtccgcaacacggttggaaaacattatgtggaaacagatctctaacgagctgaatcatattctcctggaaaacgacatgaagttcaccgtcgtggttggcgatgtggctgggatcttagcccagggcaagaagatgatacgccctcaacccatggagcacaaatactcgtggaaaagctggggcaaggcgaagatcattggggccgacgtccagaatactacctttatcattgatggaccaaacacacctgaatgtcccgacgatcagagagcttggaatatctgggaggtggaggactatggcttcggtatatttactaccaacatttggctgaaacttagggattcctacacacaggtttgcgaccaccgtttgatgtcagcagccatcaaagatagtaaggctgtgcatgccgacatggggtattggattgaatctgagaaaaatgaaacgtggaagctcgcacgggcgagcttcatcgaggtaaagacctgtatatggccaaaatcccacactctgtggtcaaacggagtcctagaaagcgagatgatcattcccaagatctacggcggtcctatttctcaacataattatcgaccaggctacttcacacagaccgccgggccgtggcacctgggaaaactcgagctggattttgacctttgcgaaggcactacagtggtggtcgatgagcactgcgggaacagaggaccctccttgaggaccacgactgttaccggcaagatcatacatgaatggtgttgccgcagttgtacactgcctccattacggttcagaggtgaggacgggtgctggtacggaatggagattaggcccgtgaaagaaaaggaggaaaatctcgtaaagagcatggtgtctgctggctccggtgaggtcgactcatttagtctgggccttctgtgtatcagcatcatgattgaagaggtgatgcgctcgcgatggtcccggaaaatgttgatgaccgggactctcgccgttttctttctgctaatcatgggacagctgacatggaacgatctcattcgtctgtgcataatggtgggcgcaaatgcttctgacagaatggggatgggaaccacatatcttgccttgatggcaactttcaagatgaggcctatgtttgccgtcggcctgttattccgccggctcaccagcagagaggtgctgcttctgacgatcggtctatcactcgttgctagtgtggaactgccaaactccttggaggaactgggggatggattagcgatgggcattatgatcctcaaactgcttacagactttcaatctcaccagctgtgggtcaccttgctcagcctgactttcattaagaccgccttttccctacattacgcatggaaaacaatggctatggtactgtcaatcgtgagccttttccccctctgtctgagtactacctctcagaagacgacatggttgccggttctgttaggctccctcgggtgcaagcctctgaccatgtttcttatagccgagaataaaatctggggaaggaagtcctggccactgaacgaaggtattatggccgtgggcatcgtctcgattttgctctcatctctgctcaaaaatgatgtgcccctggctgggcctcttatcgcaggaggcatgctcatagcctgttatgtaattagtggttccagcgcggacctgtctttggagaaggctgccgaggtgagctgggaagaggaagcagagcactccggggcctcacataatatcttagtcgaagttcaggatgacggaactatgaaaatcaaggatgaggagcgagacgatacactgaccattctcctgaaagctactcttctggcagtgagtggcgtgtaccccttgagcataccagccacactattcgtctggtatttctggcaaaagaagaaacagcgctctggcgtgctgtgggacaccccttcacccccagaagttgagcgggcggtactcgatgacgggatctacagaattatgcagaggggactgcttggtcgtagccaggtgggcgtcggggtgtttcaagaaaacgttttccacacgatgtggcacgtgactcgcggagctgtcttaatgtatcagggcaagcggctggagccgagttgggccagcgtgaaaaaggacctcatctcctacggtgggggatggagattgcagggctcttggaataccggcgaggaagtacaggtcattgcagtggagcctgggaaaaaccccaagaatgttcaaacagccccaggaacctttaagacacccgaaggtgaggtgggcgctatcgccctggatttcaaacctgggacttcgggaagcccaatagtcaacagggaacgaaagatcgtgggcctctacggtaatggggttgtgaccacgtcaggaacatatgtctccgcaattgctcaggccaaagcgagtcaggagggccccctgcctgagatcgaagacgaggtgtttcggaagcgcaaccttactattatggatctgcatccgggctctgggaaaaccagaaggtacttgccagccatcgtacgggaagcaataaagcgaaagctaagaacactgattctcgctcccacccgcgtggttgccagcgagatggctgaagcattaaaaggaatgcctatcaggtatcaaactaccgccgtcaagtccgagcacacaggtaaagagatcgtggacctgatgtgccatgccacgttcactatgcgtcttctgtcaccagtgcgggtccccaattacaacatgattatcatggatgaagctcactttaccgacccttctagcatagcggcaagaggctatattagtacaagggtagggatgggagaggccgctgccatcttcatgaccgcaactccgcccggctccgtggaagcctttccacagagcaatgctgttattcaggatgaggaacgcgacatccctgagcgatcttggaactcaggttacgagtggataacagatttccccgggaagaccgtgtggtttgtcccatccattaaaagtggaaatgacatcgcgaactgtctcagaaagaatggcaagcgggtgatccagttgagcaggaaaacgttcgatactgaatatcaaaagaccaaaaacaacgactgggactacgttgtgaccaccgatatttcggagatgggcgccaatttccgcgcagaccgtgtcatcgatcctagacggtgcctgaagcccgtgattctcaaagacgggccagaaagggtaatactggctggaccgatgcctgtgactgttgcctctgcagcccagcgccgaggtagaatcggccggaaccataataaggagggggatcagtacatttatatgggacagccccttaacaatgacgaggatcacgctcactggacagaagccaagatgctactggacaacatcaataccccagagggcatcattcccgcgttgtttgaacctgagagggaaaaatccgcagccatagatggtgagtaccgcttaagaggggaggctaggaagacattcgtcgaactgatgcggcgtggcgacctcccagtgtggctgagctataaagtggcctcagagggatttcaatacagtgatcgccgatggtgcttcgacggcgaaagaaacaatcaggtccttgaggaaaacatggatgttgagatctggactaaggagggggaaaggaaaaagctgcggccccgctggctcgacgctagaacgtattctgaccctttggcactgagggagtttaaagagttcgccgctggacggcgatccgtgagcggtgatctaattctggagatcggcaagctcccgcagcatcttacccagagagcccaaaatgcactggacaacttagtaatgttgcacaattcagaacaagggggacgcgcgtacaggcatgccatggaggagctgccagatacaattgaaactctcatgctgcttgctctgatcgccgtgctcaccggcggtgtcacattgtttttcctgagtgggcggggcttaggaaagaccagcataggcctactgtgtgtgatggcatcctctgttctcctttggatggctagcgtggagccccactggatcgccgcatccattatcctggaatttttcttgatggtcctgctcattcctgagcccgaccgtcagagaactccacaggataaccaactggcctatgtagtgatcgggcttctctttatgatactgacggttgctgcgaatgagatgggattgctggaaaccaccaaaaaggacttaggtattggccacgtggccgtcgagaaccatcaccatgcagctatgctagatgtggacctgcaccctgcctcagcctggactctctacgcagtcgctaccacaatcattacccccatgatgaggcatactatcgaaaacacaacggccaatatatctcttaccgcgatcgctaaccaggccgcaattctgatggggttggataaaggatggccaatcagtaagatggacattggcgtgcctctgctcgccctgggttgctactcgcaggttaatccgcttactttaacagctgcagtgctgatgctcgccgcgcactatgctatcatagggcccggcttgcaagccaaagcaacccgcgaggcccagaagcggaccgctgccggaattatgaagaacccaacagtagatggcatcgtggcaatcgacctggatcctgtcgtttacgacgctaaattcgaaaagcagctagggcagattatgctgctcatcctttgtactagccaaatactgttgatgcgaacgacctgggccctgtgcgagtccattacactcgcgactggacccctgaccacattatgggagggctctccaggtaaattttggaataccactatcgccgtgtcaatggcaaacattttcagagggagctatcttgctggagccggcctggcattctccctcatgaagagtctaggtggcgggaggcgcggaacgggcgctcagggggaaacactgggagagaaatggaagcggcagttgaatcagctgtctaagagcgaatttaacacctacaaaagatcaggcatcatggaggtcgaccgttccgaagccaaggagggtctcaaaagaggggaaactaccaagcacgccgtgagtcggggaacagcgaaacttcgctggttcgtagaacgaaatctggtgaagcctgagggcaaggttgtggatttgggttgtggcagagggggatggagctattactgcgctggcctgaaaaaggtcactgaagtgaaagggtataccaagggaggccccggtcatgaggaaccgataccaatggcaacatacgggtggaacctcgtcaaattacactctggaaaggacgtgtttttcatccctcccgagaaatgtgatacgctgctttgcgacattggcgagtcctcaccaaatcccaccatcgaagagggcaggactctgcgggttctaaagatggtagaaccttggctccgcgggaaccaattttgtattaagatcctgaatccgtacatgcccagcgtggtcgagacattggagcagatgcagagaaaacatggaggtatgctggtgaggaacccactctcgcgaaattctacccacgaaatgtattgggttagttgcggcactgggaacattgtgtccgccgtcaatatgacaagccggatgcttctgaaccgtttcaccatggctcacagaaagcctacgtacgagcgcgatgtggacttaggagccggcaccaggcatgtagcagtggaacccgaggttgccaacctggatatcataggtcagcggattgaaaatatcaaacacgagcataagtcaacatggcactatgacgaggataacccttacaaaacttgggcttatcatgggtcctacgaagtcaagccatctggaagcgcgagttccatggtgaatggcgtggtcaagttgctcaccaaaccctgggacgttatccctatggtgacacaaattgccatgactgataccacaccatttggccagcagagagtattcaaggagaaagtggacacccgcactcccaaggcaaaaagggggacggctcaaataatggaagtcacagcccgatggctgtggggatttctaagccggaacaagaagccgagaatctgtaccagggaggagttcactcgcaaagtgcgttctaatgcagccattggtgctgtttttgtggacgagaaccagtggaactcagccaaggaggcggtcgaagatgagcggttctgggaccttgtgcacagagaaagggagctgcacaaacagggcaagtgcgcaacctgcgtatataacatgatggggaaacgcgaaaagaagctcggagagtttggcaaagccaagggtagtcgagctatctggtacatgtggctgggggcccggttcttggagttcgaagcactgggatttatgaatgaggatcattggttctccagagaaaacagcctctctggcgttgagggcgaggggcttcacaaactgggatacattttaagggacatctcgaagatacctggtggcaatatgtatgctgatgacacagccgggtgggatacgcgcatcaccgaagacgatctgcagaacgaggctaaaattactgacatcatggaaccaaagcatgccttgctcgcaaaagcgatttttaagctgacataccaaaataaggtggtcagagtgcagcggcccgccaaaaacggaaccgtgatggatgtcatctcaaggcgtgaccagcgaggcagcggtcaggttgggacttatggactaaatacattcaccaacatggaggctcaacttatacgccagatggaatccgagggcatttttagtccttctgagctggaaacaccaaacctcgccgagagagtgctggattggttggaaaagtacggcgtagagcggttaaaaaggatggcaatcagcggggacgactgtgtggtcaagcccatcgatgaccgcttcgctactgccctgaccgcactcaatgatatgggaaaagtgagaaaggacattccgcagtgggaaccttccaagggttggaacgattggcagcaagttcccttttgctcacaccacttccatcagcttataatgaaagacggccgggagatcgtggtcccatgtaggaatcaggatgagctggtggggcgagcccgtgtaagtcagggagcgggctggtctctaagagaaacggcttgcctgggtaagagctatgcccaaatgtggcagctcatgtactttcaccgccgggacttgaggctggcagccaacgctatttgttccgccgttcctgtggattgggtccccacctcaagaacaacttggagcatccatgcacaccatcagtggatgaccacagaggacatgctttctgtgtggaatcgcgtttggattgaagagaacccatggatggaagataaaactcacatctccagttgggaggacgtgccctatctggggaagcgggaggaccaatggtgcggaagcctcataggcttaaccgctagggccacgtgggcgacaaatatccaggtcgctattaaccaggtgcgaagactgatcggcaatgaaaactacttggattacatgacctcgatgaaacggttcaagaatgagtccgaccctgaaggggccctgtggtga

SEQ ID NO: 14115 - RNA, 9879 nt, synthetic construct
  misc_feature 1..9879: note = derived and/or modified CDS sequence (opt3) from DENV-1__HQ624984__SS-prME
  source 1..9879: mol_type = other RNA
agcgtgaccatgctgctcatgcttatgcccactgccctggctttccacttgactacgcggggaggggagcctcatatgatcgtctccaagcaggaaagaggaaaatctttactgtttaagacctcagcgggtgttaatatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagtcggcctggaaacagatccagagggtggaaacttgggctctccggcaccctgggttcaccgttattgcactgtttctggcccatgctatcggaacatcaattacccagaagggcatcatattcatcctcttaatgctggtgacgccaagcatggccatgcgctgcgtcggcattgggagtagagattttgtggagggactttccggtgcgacttgggtagacgttgtgttggagcacggctcttgtgtcacaaccatggcaaaggataaacccactctggacatcgaactactcaagacagaggtgaccaaccctgccattctgaggaaactttgcatcgaagctaagataagcaatacgaccacagattcccggtgtccaactcaaggggaggccaccctggtggaagaacaagacgcaaacttcgtctgccgccgaacatttgttgatagaggatggggcaatggttgtgggttgttcggaaaaggctcactcattacttgcgctaagtttaagtgcgtgaccaaactggagggcaagatcgtacagtacgaaaacttaaaatatagtgtgattgtcacagtgcacaccggggaccagcatcaagttggaaatgagagcactgaacacggtacgacagccaccatcactccccaggcgcctaccacagagatccagctgaccgactacggcgccctcactcttgattgttctccaaggacagggctggacttcaacgaaatggtgttgctaacgatgaaggagaaatcctggctggtccataagcagtggtttctcgatctgccgcttccctggacctcaggagcaagcacaagtcaagagacatggaatcggcaggacctgttggtgaccttcaaaacagctcacgccaagaagcaggaagtagttgtgctcggctctcaagagggtgctatgcacactgccctgaccggggcaacggaaattcagacctccggcacaactaccatatttgccggacatttaaaatgccgtctgaagatggataaactaacactcaagggcatgagctatgtcatgtgtactgggtcgttcaaactggagaaggaagtggctgagacccagcacggaacggtccttgtgcagatcaagtacgagggtacagacgcgccttgcaaaattccattctctacccaagatgaaaagggcgttactcagaacgggcgcttgatcacagcaaatcccatagtgaccgacaaagagaagcctgtaaacattgaagccgagccaccctttggagagtcctatatcgtcatcggcgctggtgaaaaagccctgaagctctcatggttcaagaaagggagtagcattggcaagatgtttgaggcaactgccagaggagctaggcggatggccatcctgggcgataccgcatgggacttcgggtccattggaggtgtgtttacatctgttggcaaacttgtgcatcagatattcgggacggcgtacggagtcctgtttagcggcgtgtcatggaccatgaagatcggtattggggtattgctcacttggctgggcttaaatagtcgatccacaagcctgtctatgacctgtatcgctgtgggcctagttacactctacctgggcgtcatggtgcaggccgattcagggtgcgtgatcaactggaaaggacgcgaacttaagtgtggcagtggtattttcgtcactaatgaggttcacacctggacggaacaatataagtttcaggcagacagcccgaaaagattgtccgccgctatagggaaggcctgggaggagggagtgtgcggcatcaggtctgcaacacggctggaaaacattatgtggaaacagatctcgaacgagctcaatcatattctgttagaaaacgacatgaagttcaccgtggtagtcggtgatgtggctggcatcctggcccaggggaaaaagatgatacgccctcaacccatggagtacaaatatagctggaagtcctggggaaaggcgaaaatcattggcgccgacgttcagaatactacctttatcattgatgggccaaacacacctgaatgtcccgacgatcagagagcttggaatatctgggaggtggaggactacggattcggcatatttactaccaacatttggcttaagttgagggattcatatacacaggtctgcgaccaccgtctcatgagtgcagccatcaaagattctaaggctgtgcacgccgacatgggttactggattgaaagcgagaaaaatgaaacgtggaagctggcacgggcgtccttcatcgaggttaagacctgtatatggccaaaatcacatactctatggagcaacggggtgctggaatctgagatgatcattcccaagatctatggaggccctatttcccaacacaattaccgaccaggttacttcacacagaccgccggcccgtggcatctcgggaaactggagcttgattttgacttgtgcgaaggaactacagtagtcgtggatgagcactgcggcaacagagggcccagtctgaggaccacgactgtgaccggaaagatcatacacgaatggtgttgccgcagctgtacattacctccactccggttcagaggcgaggacggttgctggtatgggatggagattaggcccgtcaaagaaaaggaggaaaatctggttaagtctatggtgtccgctggatcaggcgaggtagacagttttagccttggtctgttgtgtatctcgatcatgattgaagaggtgatgcgctcccgatggtctcggaaaatgctcatgaccggcactctggccgtcttcctactgctcatcatggggcagctgacatggaacgatcttattcgtttgtgcataatggtgggagcaaatgctagcgacagaatgggcatggggaccacatacctggccttaatggcaacttttaagatgaggcctatgttcgccgttggactcctgtttcgccggcttacctcaagagaggtgctgctactcacgatcggcctgagtttggtcgcttccgtggaactgccaaactctttagaggaactcggtgatgggctggcgatgggaattatgatccttaaactgttgacagacttccaaagccatcagctctgggccaccctgctatccctgacttttattaagaccacattctcacttcactatgcatggaaaactatggctatggttctcagcatcgtgagtctgtttcccttgtgtctgtctaccacgtcccagaagacaacctggttaccggtcctcctgggcagccttggctgcaagcctctgactatgttcttgatagccgagaataaaatctgggggaggcgatcgtggccactcaacgaaggaattatggccgtaggtatcgtgtcaattctgctatctagtctgcttaagaacgatgttcccctcgctggccctctgatcgcagggggaatgttgatagcctgttacgtgatttccggcagctctgcggacttaagcctggagaaagctgccgaggtctcctgggaagaggaagcagagcattcaggtgccagtcacaatatcctcgtggaagtacaggatgacgggacaatgaagatcaaagatgaggagcgcgacgataccctgactattcttctgaaggctacattgctagcagtgagcggagtctatcccctgtctataccagccaccctctttgtttggtacttctggcagaaaaagaagcagcggtccggcgtgctgtgggacacgccttcacccccagaagtggagagagcggtccttgatgacggcatctataggattatgcagcgtgggttactgggacgcagtcaggtgggtgttggcgtattccaagaaaacgtgtttcatactatgtggcacgtcaccagaggggctgtgctcatgtaccagggaaaaagattggagccgagctgggcctccgttaagaaagacctgatctcttacggcggtgggtggaggctccagggatcgtggaatacaggcgaggaagtgcaggtcattgcagtggagcctggcaagaaccccaaaaatgtacaaaccgccccagggacattcaagactagcgaaggagaggtcggtgctatcgccctggattttaagcccggcacctcagggtcccctatagtgaaccgagaaggaaaaatcgttggcctttatggtaatggggtggtcacgacaagtggaacttacgtgtctgcaattgctcaggccaaggcgagccaggagggcccactgcccgagatcgaagacgaggttttccggaaacgcaacttgaccattatggatctacaccctggctccgggaagacaagaaggtatctgccggccatcgtgcgggaagcaataaaacgaaagctcagaaccttaattctggctccaactcgcgtcgtggcctcagagatggctgaagcacttaagggaatgcccatcaggtaccaaaccacagccgtaaaatctgagcatacgggtaaggagatcgtggacctgatgtgccacgccacttttaccatgcgtctcttgagccctgttcgggtcccaaattataacatgattatcatggatgaagctcatttcacagaccccagttccatagcggcaagaggctacattagcaccagggtggggatgggagaggccgctgccatctttatgactgcaacacctccgggctctgtggaagccttcccccagtcaaatgctctgattcaggatgaggaacgcgacatcccagagcgatcctggaacagtggttatgagtggataaccgattttcctgggaaaacggtctggttcgtacccagcattaagtcgggaaatgacatcgcgaactgtctcaggaaaaatggcaagcgggtgatccagctgtctaggaagacttttgatacagaataccagaaaaccaagaacaacgactgggactacgttgtgaccactgatatttccgagatgggcgccaatttccgcgcagaccgtgtcatcgatccaagacggtgccttaaacctgtgattctaaaggacgggcccgaaagggttatactggctggaccaatgccggtgacagtcgccagcgcagcccagcgccgaggtagaatcggccggaaccacaataaagagggggatcagtatatttacatgggacagcctttgaacaatgacgaggatcatgctcactggaccgaagccaagatgttactggacaacatcaatacacccgagggcatcattccagcactcttcgaacccgagagggaaaagtcagcagccatagatggtgagtatcgcctgagaggggaggctaggaaaacttttgtggaacttatgcggcgtggcgacctgcctgtatggctcagttacaaggtggcctctgagggattccaatattccgatcgccgatggtgctttgacggcgaaagaaacaatcaggttttggaggaaaacatggatgtcgagatctggacgaaagagggggaaaggaagaaactgcggccacgctggctagacgctagaacctacagcgaccccctggcactcagggagttcaaggaatttgccgctggacggcgatcagtgagtggtgatcttattctggagatcggcaaattacctcagcacttgacacagagagcccaaaatgcactggacaacctcgtgatgctgcataatagcgaacaaggcgggcgcgcgtataggcacgccatggaggagcttccggatactattgaaaccctgatgctcttggctctgatcgccgtcttaacagggggtgttaccctattctttctgtccgggcggggcctcggaaagacttctataggccttctgtgtgtgatggcaagctccgtattgctgtggatggcttcagtggagccacattggatcgccgcatctattatcctcgagttctttctgatggtccttctcattcccgagcctgaccgtcagagaacgccccaggataaccaactggcctacgtggttatcgggttgctgttcatgatattaaccgtggctgcgaatgagatgggactactggaaacaactaagaaagacctcggtattggccacgtcgccgtagggaaccaccatcacgcagctatgcttgatgtggacctgcatccagccagtgcctggaccttgtacgcagttgctacaaccatcattactcctatgatgaggcacacaatcgagaacacgaccgccaatatatcgctgactgcgatcgctaaccaggccgcaattctcatgggactggataagggctggcccatcagcaaaatggacattggtgtgccacttttagccctggggtgctattcccaggtcaatcctctcacattgaccgctgcagtgctgatgctagtcgcccattacgcgatcataggcccgggactgcaagctaaggccacccgcgaagcacagaaacggacagccgctggcattatgaagaaccccactgtggatgggatcgttgccatcgacctcgatccagtggtatatgacgcaaagtttgagaaacagcttggacagattatgctgttgatcctgtgtacgtctcaaatactcctgatgcgaaccacatgggctttatgcgaatcaattactcttgccaccggccctctgacaaccctctgggagggtagccccgggaagttctggaatactacgatcgcggtgtccatggccaacatttttagaggaagttacctagcaggcgctggtctggccttctctttgatgaaaagcctgggcgggggaaggcgcggcacaggggcacagggagagaccctcggcgaaaagtggaaacggcagcttaatcagctgtcaaagtccgagttcaacacttataagagaagtggtatcaccgaagtcgaccgtagcgaggctaaagaagggttgaagaggggagagacaactaaacacgccgtttctcggggcaccgccaagctgcgctggtttgtggagcgaaatctcgtcaaaccagaaggtaaggtgatagatttaggctgtgggagaggaggctggtcctactattgcgcggggctgaagaaagtaacagaggtgaagggatacacgaaaggcggtcctgggcacgaagaacccatcccgatggctacctacggatggaaccttgttaagctgcattcaggcaaagacgtgttctttattccacctgaaaagtgtgatactctactctgcgacatcggcgagagctcgcccaatccaacaattgaggaagggaggaccctgcgggtcttgaaaatggtggagccctggctgcgcggaaaccaattctgtatcaagattctcaatccttatatgccgtctgtcgtggaaactcttgagcagatgcagagaaagcacggtggcatgctggttaggaaccccttaagtcgaaattccacacatgagatgtactgggtaagctgcgggaccggaaacatcgtgtcagcagtcaatatgacgtcccggatgctgttgaaccgttttaccatggcccacagaaaaccaacatatgaacgcgatgtggacctcggcgctggtactaggcacgttgccgtggagcctgaagtcgcaaacctggatataattgggcagcggatcgagaatatcaagcatgaacacaaatctacctggcattacgacgaggataacccctataagacatgggcctaccacggaagctatgaggtgaaacctagtggctccgctagctctatggtaaatggcgtggttaagctacttactaagccatgggacgtcattcccatggtgacccaaatagcgatgacagataccactcctttcgggcagcagagagtgtttaaagaaaaggtcgacacgcgcacaccaaaagccaagaggggaaccgcacaaatcatggaggttactgctaaatggctgtggggtttcctctcacgaaacaagaagccccggatttgtaccagagaagagtttacaaggaaagtgcgcagtaatgccgcaatcggcgccgtattcgtggacgaaaaccagtggaactccgctaaggaggccgtcgaggatgaacgtttttgggacctggtgcatcgggagagagaattgcacaaacaggggaagtgcgcgacgtgcgtttacaacatgatgggaaaaagggagaagaagctgggcgagttcggtaaagcaaaggggagccgcgccatttggtacatgtggctcggagctcgatttcttgagttcgaggccctgggcttcatgaatgaagatcactggttttctcgggagaactcgttatcaggcgtggaaggggagggactgcataaattgggttatatcctcagagacataagcaagatcccgggcgggaatatgtacgcagatgacaccgctggatgggatactaggattacagaggacgatctgcagaacgaagcccgcatcaccgacattatggagcctgaacacgctctacttgccaaatccatcttcaagctgacttatcaaaataaagtcgtgagagtacagcggccagcaaagaacggcacagttatggatgtgataagtaggcgtgaccagcgaggttctgggcaggtcggaacctacggcctcaatacatttactaacatggaggcgcaactgattcgccagatggaaagcgagggcatcttctccccctcagagttggaaacccctaacttagccgagagagtgctggattggctcgaaaagtatggggtggagcggcttaaaaggatggctatcagtggagacgactgtgtcgttaagccaattgatgaccgctttgccacggcactgaccgctctaaatgatatgggtaaagtgagaaaggacataccccagtgggaaccgtctaaaggctggaacgattggcagcaagtacctttctgcagccatcactttcaccagctgatcatgaaggacgggcgggagattgtggtcccctgtaggaatcaggatgagctcgtgggacgagcccgtgtttcccagggcgcaggttggtcattgagagaaacagcctgcctgggaaagagctacgcgcaaatgtggcagcttatgtatttccatcgccgggacctgaggctcgctgccaacgcaatctgttctgccgtgccagtcgattggattcctacttccagaaccacatggagtatccacgctcatcaccagtggatgactaccgaggacatgttaagcgtgtggaatcgcgtatggatagaagagaacccctggatggaagataaaacgcatatctcgtcctggggagacgttccatacctgggcaagcgggaggaccaatggtgcggctctttgattgggctgacagccagggcaacctgggctactaatatccaggtggccattaaccaggtccgaagactcatcggaaatgagaactaccttgattatatgacatcaatgaaacggtttaagaatgaaagcgaccccgagggtgcgctgtggtga

SEQ ID NO: 14116 - RNA, 9879 nt, synthetic construct
  misc_feature 1..9879: note = derived and/or modified CDS sequence (opt3) from DENV-1__HQ891314__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagagcaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcacggaaatggtcctactgaccatgaaggagaaatcttggctcgtgcataagcagtggtttctggatcttccgctgccctggacttccggcgcatcaacaagccaagagacctggaaccggcaggacttgctcgtaacattcaaaactgctcacgccaagaagcaggaagttgtggtcctgggtagtcaagagggggctatgcacaccgccttaacgggcgcaaccgaaatccagacatctggaactaccacaatctttgccggccatctgaaatgccgtctaaagatggataaactcactctgaaggggatgtcctatgtgatgtgtaccggaagcttcaaacttgagaaggaagtcgctgagacgcagcacggtacagtgttggttcagattaagtacgagggcaccgacgcgccttgcaaaataccattctcgactcaagatgaaaagggggtgacacagaatggacgcctgatcaccgcaaaccccattgtaactgacaaagagaagcctgtcaatatcgaagccgagccaccctttggcgagtcttatatagtgattggtgctggggaaaaagccctcaagctgtcctggttcaagaaaggctcaagtatcggaaagatgtttgaggcaaccgccagaggcgctaggcggatggccatccttggggatacagcatgggacttcggaagcattggtggcgtttttacgtccgtggggaaactggtccatcagatcttcggaaccgcgtacggcgtgttgttttctggtgtaagctggactatgaagattgggataggcgtgctcctgacatggttaggactgaactcacgaagtacctccctaagcatgacatgtatcgctgttggcctcgtcactctgtaccttggggtgatggtgcaggccgattctggatgcgtcattaattggaaaggccgcgaattgaagtgtggttcagggatcttcgttaccaacgaggtgcacacgtggacagaacaatataagtttcaggcagacagtccgaaaagactgagcgccgctatcggaaaggcctgggaggagggcgtgtgcggtattaggtccgcaacccggctcgaaaatataatgtggaaacagatctctaacgagctgaaccatattttactggaaaatgacatgaagttcactgtagtcgtgggcgatgttgctgggatccttgcccagggaaaaaagatgattcgccctcaacccatggagcacaaatactcgtggaagaactggggcaaggcgaaaatcataggggccgacgtgcagaatagcacctttatcattgatggaccaaacacacctgaatgttccgacgatcagagagcttggaatatctgggaggtcgaggactatggcttcggtatttttactaccaacatctggttgaagctcagggattcatacacacaggtgtgcgaccaccgtctgatgagtgcagccataaaagattctaaggctgttcatgccgacatggggtattggattgaaagcgagaaaaatgaaacgtggaagctagcacgggcgtccttcatcgaggtgaagacctgtatttggcccaaatcacacactctgtggagcaacggagtactcgaatctgagatgatcataccaaagatctacggcggtcccatttcccaacataattatcgacctggctacttcacacagaccgccgggccatggcacctgggaaaacttgagttggattttgacctgtgcgaaggcactacagtcgtggtggatgagcactgcgggaacagaggaccgagtttaaggaccacgactgtcaccggcaagatcattcatgaatggtgttgccgcagctgtacactcccccctctgcggttcagaggtgaggacgggtgctggtacggaatggagatcaggccagttaaagaaaaggaggaaaatcttgtgaagtctatggtatccgctggctcaggtgaggtggacagttttagcctgggcttgctctgtatatcgattatgatcgaagaggtcatgcgctcccgatggtctcggaaaatgctgatgaccgggactctagccgtgttctttctgctcatcatgggacagctgacatggaacgatcttattcgtttgtgcatcatggttggcgcaaatgctagcgacagaatggggatgggaaccacatatctggccttaatggcaactttcaagatgaggcccatgtttgccgtgggcctcctgttccgccggcttacctcaagagaggtcctgctactcacgattggtctgagtttggtggcttccgttgaactgcctaactctttagaggaactcggggatggactggcgatgggcataatgatccttaaactgttgacagactttcaaagccaccagctctgggccaccctgctatccatgactttcattaagaccacattttcactgcattacgcatggaaaactatggctatggtgcttagcatcgtcagtctcttcccactgtgtttgtctaccacgtcccagaagacaacctggctgcccgtattactcggcagcctggggtgcaagccgcttactatgtttctgattgccgagaataaaatctggggaaggaagtcgtggcctttgaacgaaggtataatggccgtgggcatcgtttcaattctcctgtctagtctactgaaaaacgatgtgccacttgctgggcccctcatcgcaggaggcatgctgattgcctgttatgtcatctccggtagctctgcggacttgagcttagagaaggctgccgaggtgtcctgggaagaggaagcagagcactcaggggccagtcataatatactggtagaagtgcaggatgacggaacaatgaaaattaaggatgaggagcgagacgataccctcactatcctgcttaaagctacactgttggcagtcagcggcgtttaccctctatctatccccgccaccctgttcgtgtggtatttctggcaaaagaagaaacagcgctccggcgtgctctgggacacgccatcacctcccaaggtcgaacgggcggtgctggatgacgggatttacagaataatgcagaggggacttttaggtcgtagtcaggttggcgtaggggtgtttcaagagaacgtcttccacactatgtggcacgtgacccgcggagctgttctgatgtatcagggcaaacggctcgaaccaagctgggcctccgtgaagaaagacttgatctcttacggtgggggatggagactgcagggctcgtggaatacaggcgaggaggtccaggtgattgcagtagaaccggggaagaaccctaagaatgtccaaaccgcccccggaacatttaaaactccagagggtgaagtgggcgctatcgccctcgatttcaagcccgggaccagcggatcacctattgttaacagggagggcaaaatcgtgggtctgtacgggaatggagtcgtgacgacatccggcacttatgttagtgcaatagctcaggccaaggcgtctcaggaaggcccacttcccgagatcgaggacgaagtgtttcgaaaacggaacctgaccattatggatttgcatcctgggagcggaaagacacgcagatacctaccggccatcgtcagggaggcaattaagcggaaaatgcgaaccctgatcctcgctccaactagagtggtagcctccgaaatggctgaggcattaaagggtatgcccatacgctatcaaaccacagccgtgaaatcagaacacacgggcaaggagattgttgacctgatgtgccatgccactttcaccatgaggcttctgtctcctgtccgtgtgccaaattacaacatgatcatcatggatgaggctcactttacagaccccagcagtattgcggcacgggggtatatctccaccagagtgggaatgggcgaagccgctgccatattcatgactgcaacacctccgggtagcgtcgaggcctttccccagtctaatgctgtaattcaggatgaagagagggacatcccagaacgctcatggaactccgggtacgagtggattaccgatttccctggaaaaacggtgtggtttgttcccagtatcaaggcgggcaatgacatagccaactgtctccgaaagaatggcaaaagagtgattcagttgagccggaagactttcgatacagagtatcaaaaaaccaagaacaacgactgggactacgtcgtgaccactgatatctcggaaatgggggcaaatttcagggctgaccgcgttatcgatccacgtagatgcctgaaacctgtgattctcaaggacggacccgagcgggtcatcctggccggtccaatgccggtgacagtagcatctgccgctcagaggcgcggccgaattgggagaaaccataataaggaaggagatcagtacatatatatgggccagcctcttaacaatgacgaggatcacgcccactggaccgaggcgaaaatgctactggacaacatcaatacacccgaaggtattatcccagcattgtttgagcccgaacgggagaagtccgccgctatcgatggggaatacaggttacgcggcgaggccagaaaaactttcgtggagctgatgaggcggggagacctccctgtttggctgagctataaggtcgcttcagaaggctttcaatacagtgatcgtcgctggtgcttcgacggggagcgaaacaatcaggtgcttgaagagaacatggatgtggaaatttggacgaaagagggagagagaaagaaactgaggccacggtggctcgacgcacgcacctattctgaccccttggccctgagagaatttaaggagttcgctgccggtaggcggtccgtcagcggcgatctaatactggaaatcgggaagctccctcagcatcttacacagcgagcacaaaatgcgctggacaacttagttatgttgcacaattcagagcagggaggcagagcctaccgccatgctatggaagagctgccggatactattgagaccctcatgctgcttgccctgatcgcagtgctcacaggtggggtaaccttgtttttcctgagtggcaaaggattaggcaagactagcattgggctactgtgtgtgatggcttcctctgccctcctttggatggcaagcgtcgaaccacactggatcgccgcttccataatcctggagtttttcttgatggtgctgctcattcccgaacctgacaggcagcggacgccccaggataaccaactggcgtatgttgtgatcggacttctctttatgattctgaccgtcgccgcaaatgagatgggtttgctggagacaactaaaaaggacttaggcatcgggcacgtagctgtggaaaaccatcaccatgccgccatgctagatgttgacctgcacccagcatcagcttggaccctctacgccgtggcgacaaccataattactcctatgatgcgtcatacaatcgagaacacgaccgctaatatttctcttactgccatcgcaaaccaggccgctatactgatgggattggataaaggctggcccatcagtaagatggacattggtgtcccactgctcgcactggggtgctactcgcaggtgaatcctcttacattaaccgccgcggtcctgatgctcgtggctcactatgccatcattggcccgggattgcaagcaaaggccaccagagaagctcagaaaaggacagccgcaggcatcatgaagaaccccactatagatgggattgttgctatcgacctggatccagtggtatacgacgccaaattcgagaagcagctaggacagatcatgctgctcattctttgtacgagccaaatcctgttgatgcgcaccacatgggcgctgtgcgaatccataactctcgccaccggccctctgacaaccttatgggagggttctcccgggaaattttggaatactacgattgcagtgtcaatggctaacatcttccggggaagctatcttgccggcgcaggtctggctttctccctcatgaagagtctaggcgggggacgaagaggcacaggggcccagggagagaccctgggcgaaaagtggaaaaggcagttgaatcagctgtctaagagcgagtttaacacttacaaacgctcaggtattatggaagtcgaccggtccgaggccaaggaagggctcaaaagaggagagaccacaaagcacgcggttagtcgtggcactgctaagcttaggtggttcgtggagcggaatctggtcaaaccagaaggtaaggtgatcgatttgggctgtgggcgcggaggctggagctattactgcgcagggctgaaaaaggtaaccgaggtgaaaggatatacaaagggcggtcctgggcatgaagagcccataccgatggccacgtacggatggaacctcgttaaattacactctggcaaggacgtgtttttcatcccacctgaaaagtgtgataccctgctttgcgacattggcgagtcctcacccaatccaactatcgaggaagggcgaacactgagagtcctaaaaatggtggagccctggctcaggggaaaccaattttgtattaagatcctgaatccttacatgccgagcgtcgtggaaaccttggagcagatgcagcggaaacatggtggcatgctggttcgcaaccccctctcgagaaattctactcacgagatgtattgggtaagttgcgggacaggaaacattgtgtccgctgtcaatatgaccagcaggatgcttctgaaccgattcacgatggcccaccggaagccaacctacgaacgtgatgtggacttaggcgcaggtacaagacatgttgccgtggagcctgaagtcgctaacctggatatcatagggcagcgcattgagaatatcaaacacgaacataagtcaacttggcactatgacgaggataacccctacaagacctgggcgtatcatggatcctacgaggtgaaaccttctggcagcgccagttccatggtaaatggcgtggttaagttgctcacaaaaccatgggacgtcatccccatggtgactcaaattgcaatgaccgatacaaccccttttgggcagcagagggtgttcaaggaaaaagtcgacactcggacgccaaaggctaagagaggaacagcccaaataatggaggttaccgcacgctggctgtggagctttctatctaggaacaaaaagccccgaatctgtactcgggaagagttcaccagaaaagtgaggtcaaatgccgctattggtgccgtatttgtggacgaaaaccagtggaatagtgcgaaggaggcagtcgaggatgaccgcttctgggatcttgtgcaccgtgaacgggagctgcacaaacagggcaagtgcgccacatgcgtttataacatgatggggaagagagaaaaaaagctcggagagtttggcaaagctaagggttccagggccatctggtacatgtggctgggggcacgcttcttggaattcgaggctctgggatttatgaatgaggaccattggttcagccgagaaaactctctctcgggcgtggagggcgaagggcttcacaaactgggatacattttacgggatatctcaaagataccgggtggcaatatgtatgccgacgatacggctgggtgggacaccagaatcactgaggatgacctgcagaacgaggccaaaattacagatatcatggaacctgagcatgcattgctcgcgaagagcatttttaagctgacctaccaaaataaagtcgtgagggtacagcgcccagccaagaacggaactgttatggacgtgatctccagacgggatcagaggggcagtggtcaggtcgggacatatggactaaataccttcacaaacatggaagctcaacttatacgtcagatggagtctgaagagatttttagccccaacgagctggaaactcctaatctcgccgagcgagtgctggactggttggaaaaatacggcgtggagcgcttaaagagaatggcaatctccggcgacgattgtgtcgttaaaccaatcgacgatcggttcgctaccgccctgacggcactcaacgacatggggaaggtgaggaaggatattccccagtgggaaccgtcaaaaggatggaatgactggcagcaagtacctttttgcagtcaccacttccatcagcttataatgaaggatggtcgcgagatcgtggtcccctgtagaaaccaggacgagctggtgggccgggccagggtttctcagggggcgggatggagcctacgagaaaccgcttgcctgggcaaatcctatgcccaaatgtggcagctcatgtactttcaccgtagagatttgcgcctggcagccaatgctatttgttcagccgtgccagtcgactgggtgcctacaagccggactacctggtctatccatgcacaccatcagtggatgacaactgaggatatgctttccgtatggaacagggtttggattgaagagaatccctggatggaagacaagaccagagtgagtagctgggaggacgtcccatatctgggtaaacgcgaggatcaatggtgcgggtcgctcatcggattaacggctcgggccacatgggcgaccaacatacaggtggctatcaatcaggttaggcgactgattggcaacgaaaattactccgactacatgacttctatgaagagattcaagaacgagtcagaacccgagggcgccttgtggtga

SEQ ID NO: 14117 - RNA, 9879 nt, synthetic construct
  misc_feature 1..9879: note = derived and/or modified CDS sequence (opt3) from DENV-1__HQ891315__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagagcaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggaagcttcaaacttgagaaggaagtcgctgagacccagcacggtacggtgttggttcagattaagtacgagggcacagacgcgccttgcaaaataccattctcgacccaagatgaaaagggggtgactcagaacggacgcctgatcacagcaaatcccattgtaaccgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaactgccagaggcgctaggcggatggccatccttggggataccgcatgggacttcggaagcattggtggcgtttttacatccgtggggaaactggtccatcagatcttcggaacggcgtacggcgtgttgttttctggtgtaagctggaccatgaagattgggataggcgtgctcctgacttggttaggactgaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacataatgtggaaacagatctctaacgagctgaatcatattttactggaaaacgacatgaagttcaccgtagtcgtgggcgatgttgctgggatccttgcccagggaaaaaagatgattcgccctcaacccatggagcacaaatactcgtggaagaattggggcaaggcgaaaatcataggggccgacgtgcagaacagcacttttatcattgatggaccaaatacccctgaatgttccgacgatcagagagcttggaacatctgggaggtcgaggactatggcttcggtatttttacaactaatatctggttgaagctcagggattcatacacccaggtgtgcgaccaccgtctgatgagtgcagccataaaagattctaaggctgttcatgccgacatggggtattggattgaaagcgagaaaaacgaaacatggaagctagcacgggcgtccttcatcgaggtgaagacgtgtatttggcccaaatcacacaccctgtggagcaatggagtactcgaatctgagatgatcataccaaagatctacggcggtcccatttcccaacataactatcgacctggctacttcactcagacagccgggccatggcacctgggaaaacttgagttggattttgacctgtgcgaaggcaccactgtcgtggtggatgagcactgcgggaatagaggaccgagtttaaggacaaccacggtcactggcaagatcattcatgaatggtgttgccgcagctgtaccctcccccctctgcggttcagaggtgaggacgggtgctggtacggaatggagatcaggccagttaaagaaaaggaggaaaaccttgtgaagtctatagtatccgctggctcaggtgaggtggacagttttagcctgggcttgctctgtatttcgatcatgatcgaagaggtcatgcgctcccgatggtctcggaaaatgctgatgacagggaccctagccgtgttctttctgctcattatgggacagctgacttggaatgatcttatccgtttgtgcattatggttggcgcaaacgctagcgacagaatggggatgggaacaacctatctggccttaatggcaacattcaagatgaggcccatgtttgccgtgggcctcctgttccgccggcttacttcaagagaggtcctgctactcaccataggtctgagtttggtggcttccgttgaactgcctaattctttagaggaactcggggatggactggcgatgggcatcatgattcttaaactgttgacggactttcaaagccaccagctctgggccacactgctatccatgaccttcatcaagactaccttttcactgcattacgcatggaaaacaatggctatggtgcttagcattgtcagtctcttcccactgtgtttgtctactacctcccagaagacgacatggctgcccgtattactcggcagcctggggtgcaagccgcttaccatgtttctgatcgccgagaacaaaatatggggaaggaagtcgtggcctttgaacgaaggtatcatggccgtgggcattgtttcaatcctcctgtctagtctactgaaaaatgatgtgccacttgctgggcccctcattgcaggaggcatgctgatcgcctgttatgtcatatccggtagctctgcggacttgagcttagagaaggctgccgaggtgtcctgggaagaggaagcagagcactcaggggccagtcataacattctggtagaagtgcaggatgacggaactatgaaaatcaaggatgaggagcgagacgatacactcaccatcctgcttaaagctactctgttggcagtcagcggcgtttaccctctatctattcccgccacactgttcgtgtggtatttctggcaaaagaagaaacagcgctccggcgtgctctgggacaccccatcacctcccaaggtcgaacgggcggtgctggatgacgggatatacagaatcatgcagaggggacttttaggtcgtagtcaggttggcgtaggggtgtttcaagagaatgtcttccacacgatgtggcacgtgactcgcggagctgttctgatgtatcagggcaaacggctcgaaccaagctgggcctccgtgaagaaagacttgatttcttacggtgggggatggagactgcagggctcgtggaacaccggcgaggaggtccaggtgatcgcagtagaaccggggaagaatcctaagaacgtccaaacagcccccggaacctttaaaacaccagagggtgaagtgggcgctattgccctcgatttcaagcccgggactagcggatcacctatcgttaatagggagggcaaaatagtgggtctgtacgggaacggagtcgtgaccacgtccggcacatatgttagtgcaatcgctcaggccaaggcgtctcaggaaggcccacttcccgagattgaggacgaagtgtttcgaaaacggaatctgactatcatggatttgcatcctgggagcggaaagacccgcagatacctaccggccattgtcagggaggcaatcaagcggaaaatgcgaacactgatactcgctccaaccagagtggtagcctccgaaatggctgaggcattaaagggtatgcccattcgctatcaaactaccgccgtgaaatcagaacacacaggcaaggagatcgttgacctgatgtgccatgccacgttcactatgaggcttctgtctcctgtccgtgtgccaaactacaatatgatcattatggatgaggctcactttaccgaccccagcagtatcgcggcacgggggtatatatccacaagagtgggaatgggcgaagccgctgccattttcatgaccgcaactcctccgggtagcgtcgaggcctttccccagtctaacgctgtaatccaggatgaagagagggacattccagaacgctcatggaattccgggtacgagtggatcacagatttccctggaaaaaccgtgtggtttgttcccagtataaaggcgggcaacgacattgccaattgtctccgaaagaacggcaaaagagtgatccagttgagccggaagacgttcgatactgagtatcaaaaaacaaagaacaatgactgggactacgtcgtgaccaccgatatctcggaaatgggggcaaacttcagggctgaccgcgttattgatccacgtagatgcctgaaacctgtgatcctcaaggacggacccgagcgggtcattctggccggtccaatgccggtgactgtagcatctgccgctcagaggcgcggccgaatagggagaaatcataacaaggaaggagatcagtacatctatatgggccagcctcttaataacgacgaggatcacgcccactggacagaggcgaaaatgctactggacaatattaacacccccgaaggtatcatcccagcattgtttgagcccgaacgggagaagtccgccgctattgatggggaatacaggttacgcggcgaggccagaaaaacattcgtggagctgatgaggcggggagacctccctgtttggctgagctataaggtcgcttcagaaggctttcaatacagtgatcgtcgctggtgcttcgacggggagcgaaataaccaggtgcttgaagagaatatggatgtggaaatatggactaaagagggagagagaaagaaactgaggccacggtggctcgacgcacgcacgtattctgaccccttggccctgagagaatttaaggagttcgctgccggtaggcggtccgtcagcggcgatctaatcctggaaattgggaagctccctcagcatcttacccagcgagcacaaaacgcgctggacaatttagttatgttgcacaactcagagcagggaggcagagcctaccgccatgctatggaagagctgccggatacaatcgagactctcatgctgcttgccctgattgcagtgctcaccggtggggtaacattgtttttcctgagtggcaaaggattaggcaagaccagcatcgggctactgtgtgtgatggcttcctctgccctcctttggatggcaagcgtcgaaccacactggatagccgcttccatcattctggagtttttcttgatggtgctgctcatccccgaacctgacaggcagcggactccccaggataatcaactggcgtatgttgtgattggacttctctttatgatcctgacggtcgccgcaaacgagatgggtttgctggagaccacaaaaaaggacttaggcatagggcacgtagctgtggaaaaccatcaccatgccgccatgctagatgttgacctgcacccagcatcagcttggactctctacgccgtggcgaccacaattatcacccctatgatgcgtcatactattgagaatacaacggctaacatctctcttaccgccatagcaaatcaggccgctatcctgatgggattggataaaggctggcccattagtaagatggacatcggtgtcccactgctcgcactggggtgctactcgcaggtgaaccctcttactttaacagccgcggtcctgatgctcgtggctcactatgccattatcggcccgggattgcaagcaaaggccaccagagaagctcagaaaaggaccgccgcaggcataatgaagaatcccacaattgatgggatcgttgctatcgacctggatccagtggtatacgacgccaaattcgagaagcagctaggacagattatgctgctcatcctttgtactagccaaatactgttgatgcgcacgacctgggcgctgtgcgaatccattacactcgccactggccctctgaccacattatgggagggttctcccgggaaattttggaacaccactatcgcagtgtcaatggctaatattttccggggaagctatcttgccggcgcaggtctggctttctccctcatgaagagtctaggcgggggacgaagaggcacgggggcccagggagagacactgggcgaaaagtggaaaaggcagttgaaccagctgtctaagagcgagtttaatacctacaaacgctcaggtatcatggaagtcgaccggtccgaggccaaggaagggctcaaaagaggagagactaccaagcacgcggttagtcgtggcacagctaagcttaggtggttcgtggagcggaacctggtcaaaccagaaggtaaggtgatagatttgggctgtgggcgcggaggctggagctattactgcgcagggctgaaaaaggtaactgaggtgaaaggatataccaagggcggtcctgggcatgaagagcccatcccgatggccacatacggatggaatctcgttaaattacactctggcaaggacgtgtttttcattccacctgaaaagtgtgatacgctgctttgcgacatcggcgagtcctcacccaacccaaccattgaggaagggcgaactctgagagtcctaaaaatggtggagccctggctcaggggaaatcaattttgtatcaagattctgaacccttacatgccgagcgtcgtggaaacattggagcagatgcagcggaaacatggtggcatgctggttcgcaatcccctctcgagaaactctacccacgagatgtattgggtaagttgcgggactggaaatatcgtgtccgctgtcaacatgacaagcaggatgcttctgaaccgattcaccatggcccaccggaagccaacgtacgaacgtgatgtggacttaggcgcaggtaccagacatgttgccgtggagcctgaagtcgctaatctggatataattgggcagcgcatcgagaacatcaaacacgaacataagtcaacatggcactatgacgaggataatccctacaagacttgggcgtatcatggatcctacgaggtgaaaccttctggcagcgccagttccatggtaaacggcgtggttaagttgctcaccaaaccatgggacgtcattcccatggtgacacaaatagcaatgactgataccacaccttttgggcagcagagggtgttcaaggaaaaagtcgacacccggactccaaaggctaagagaggaacggcccaaatcatggaggttacagcacgctggctgtggagctttctatctaggaataaaaagccccgaatttgtacccgggaagagttcactagaaaagtgaggtcaaacgccgctatcggtgccgtatttgtggacgaaaatcagtggaacagtgcgaaggaggcagtcgaggatgaccgcttctgggatcttgtgcaccgtgaacgggagctgcacaaacagggcaagtgcgccacctgcgtttataatatgatggggaagagagaaaaaaagctcggagagtttggcaaagctaagggttccagggccatttggtacatgtggctgggggcacgcttcttggaattcgaggctctgggatttatgaacgaggaccattggttcagccgagaaaattctctctcgggcgtggagggcgaagggcttcacaaactgggatacatcttacgggatatatcaaagatcccgggtggcaacatgtatgccgacgatacagctgggtgggacacgagaattaccgaggatgacctgcagaatgaggccaaaatcactgatattatggaacctgagcatgcattgctcgcgaagagcatctttaagctgacataccaaaacaaagtcgtgagggtacagcgcccagccaagaatggaaccgttatggacgtgatatccagacgggatcagaggggcagtggtcaggtcgggacttatggactaaacacattcaccaacatggaagctcaacttattcgtcagatggagtctgaagagatctttagccccaatgagctggaaacacctaacctcgccgagcgagtgctggactggttggaaaaatacggcgtggagcgcttaaagagaatggcaatctccggcgacgattgtgtcgttaaaccaattgacgatcggttcgctactgccctgaccgcactcaatgacatggggaaggtgaggaaggatataccccagtgggaaccgtcaaaaggatggaacgactggcagcaagtacctttttgcagtcaccacttccatcagcttatcatgaaggatggtcgcgagattgtggtcccctgtagaaatcaggacgagctggtgggccgggccagggtttctcagggggcgggatggagcctacgagaaacggcttgcctgggcaaatcctatgcccaaatgtggcagctcatgtactttcaccgtagagatttgcgcctggcagccaacgctatctgttcagccgtgccagtcgactgggtgcctaccagccggacaacttggtctattcatgcacaccatcagtggatgaccacagaggatatgctttccgtatggaatagggtttggatcgaagagaacccctggatggaagacaagactagagtgagtagctgggaggacgtcccatatctgggtaaacgcgaggatcaatggtgcgggtcgctcataggattaaccgctcgggccacgtgggcgacaaatatccaggtggctattaaccaggttaggcgactgatcggcaatgaaaactactccgactacatgacctctatgaagagattcaagaatgagtcagaacccgagggcgccttgtggtga

SEQ ID NO: 14118 - RNA, 9879 nt, synthetic construct
  misc_feature 1..9879: note = derived and/or modified CDS sequence (opt3) from DENV-1__HQ891316__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagagcaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggaagcttcaaacttgagaaggaagtcgctgagacccagcacggtacggtgttggttcagattaagtacgagggcacagacgcgccttgcaaaataccattctcgacccaagatgaaaagggggtgactcagaacggacgcctgatcacagcaaatcccattgtaaccgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaactgccagaggcgctaggcggatggccatccttggggataccgcatgggacttcggaagcattggtggcgtttttacatccgtggggaaactggtccatcagatcttcggaacggcgtacggcgtgttgttttctggtgtaagctggaccatgaagattgggataggcgtgctcctgacttggttaggactgaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacataatgtggaaacagatctctaacgagctgaatcatattttactggaaaacgacatgaagttcaccgtagtcgtgggcgatgttgctgggatccttgcccagggaaaaaagatgattcgccctcaacccatggagcacaaatactcgtggaagaattggggcaaggcgaaaatcataggggccgacgtgcagaacagcacttttatcattgatggaccaaatacccctgaatgttccgacgatcagagagcttggaacatctgggaggtcgaggactatggcttcggtatttttacaactaatatctggttgaagctcagggattcatacacccaggtgtgcgaccaccgtctgatgagtgcagccataaaagattctaaggctgttcatgccgacatggggtattggattgaaagcgagaaaaacgaaacatggaagctagcacgggcgtccttcatcgaggtgaagacgtgtatttggcccaaatcacacaccctgtggagcaatggagtactcgaatctgagatgatcataccaaagatctacggcggtcccatttcccaacataactatcgacctggctacttcactcagacagccgggccatggcacctgggaaaacttgagttggattttgacctgtgcgaaggcaccactgtcgtggtggatgagcactgcgggaatagaggaccgagtttaaggacaaccacggtcactggcaagatcattcatgaatggtgttgccgcagctgtaccctcccccctctgcggttcagaggtgaggacgggtgctggtacggaatggagatcaggccagttaaagaaaaggaggaaaaccttgtgaagtctatggtatccgctggctcaggtgaggtggacagttttagcctgggcttgctctgtatatcgattatgatcgaagaggtcatgcgctcccgatggtctcggaaaatgctgatgacagggaccctagccgtgttctttctgctcatcatgggacagctgacttggaatgatcttattcgtttgtgcatcatggttggcgcaaacgctagcgacagaatggggatgggaacaacctatctggccttaatggcaacattcaagatgaggcccatgtttgccgtgggcctcctgttccgccggcttacttcaagagaggtcctgctactcaccattggtctgagtttggtggcttccgttgaactgcctaattctttagaggaactcggggatggactggcgatgggcataatgatccttaaactgttgacggactttcaaagccaccagctctgggccacactgctatccatgaccttcattaagactaccttttcactgcattacgcatggaaaacaatggctatggtgcttagcatcgtcagtctcttcccactgtgtttgtctactacctcccagaagacgacatggctgcccgtattactcggcagcctggggtgcaagccgcttaccatgtttctgattgccgagaacaaaatctggggaaggaagtcgtggcctttgaacgaaggtataatggccgtgggcatcgtttcaattctcctgtctagtctactgaaaaatgatgtgccacttgctgggcccctcatcgcaggaggcatgctgattgcctgttatgtcatctccggtagctctgcggacttgagcttagagaaggctgccgaggtgtcctgggaagaggaagcagagcactcaggggccagtcataacatactggtagaagtgcaggatgacggaactatgaaaattaaggatgaggagcgagacgatacactcaccatcctgcttaaagctactctgttggcagtcagcggcgtttaccctctatctatccccgccacactgttcgtgtggtatttctggcaaaagaagaaacagcgctccggcgtgctctgggacaccccatcacctcccaaggtcgaacgggcggtgctggatgacgggatttacagaataatgcagaggggacttttaggtcgtagtcaggttggcgtaggggtgtttcaagagaatgtcttccacacgatgtggcacgtgactcgcggagctgttctgatgtatcagggcaaacggctcgaaccaagctgggcctccgtgaagaaagacttgatctcttacggtgggggatggagactgcagggctcgtggaacaccggcgaggaggtccaggtgattgcagtagaaccggggaagaatcctaagaacgtccaaacagcccccggaacctttaaaacaccagagggtgaagtgggcgctatcgccctcgatttcaagcccgggactagcggatcacctattgttaatagggagggcaaaatcgtgggtctgtacgggaacggagtcgtgaccacgtccggcacatatgttagtgcaatagctcaggccaaggcgtctcaggaaggcccacttcccgagatcgaggacgaagtgtttcgaaaacggaatctgactattatggatttgcatcctgggagcggaaagacccgcagatacctaccggccatcgtcagggaggcaattaagcggaaaatgcgaacactgatcctcgctccaaccagagtggtagcctccgaaatggctgaggcattaaagggtatgcccatacgctatcaaactaccgccgtgaaatcagaacacacaggcaaggagattgttgacctgatgtgccatgccacgttcactatgaggcttctgtctcctgtccgtgtgccaaactacaatatgatcatcatggatgaggctcactttaccgaccccagcagtattgcggcacgggggtatatctccacaagagtgggaatgggcgaagccgctgccatattcatgaccgcaactcctccgggtagcgtcgaggcctttccccagtctaacgctgtaattcaggatgaagagagggacatcccagaacgctcatggaattccgggtacgagtggattacagatttccctggaaaaaccgtgtggtttgttcccagtatcaaggcgggcaacgacatagccaattgtctccgaaagaacggcaaaagagtgattcagttgagccggaagacgttcgatactgagtatcaaaaaacaaagaacaatgactgggactacgtcgtgaccaccgatatctcggaaatgggggcaaacttcagggctgaccgcgttatcgatccacgtagatgcctgaaacctgtgattctcaaggacggacccgagcgggtcatcctggccggtccaatgccggtgactgtagcatctgccgctcagaggcgcggccgaattgggagaaatcataacaaggaaggagatcagtacatatatatgggccagcctcttaataacgacgaggatcacgcccactggacagaggcgaaaatgctactggacaatatcaacacccccgaaggtattatcccagcattgtttgagcccgaacgggagaagtccgccgctatcgatggggaatacaggttacgcggcgaggccagaaaaacattcgtggagctgatgaggcggggagacctccctgtttggctgagctataaggtcgcttcagaaggctttcaatacagtgatcgtcgctggtgcttcgacggggagcgaaataaccaggtgcttgaagagaatatggatgtggaaatttggactaaagagggagagagaaagaaactgaggccacggtggctcgacgcacgcacgtattctgaccccttggccctgagagaatttaaggagttcgctgccggtaggcggtccgtcagcggcgatctaatactggaaatcgggaagctccctcagcatcttacccagcgagcacaaaacgcgctggacaatttagttatgttgcacaactcagagcagggaggcagagcctaccgccatgctatggaagagctgccggatacaattgagactctcatgctgcttgccctgatcgcagtgctcaccggtggggtaacattgtttttcctgagtggcaaaggattaggcaagaccagcattgggctactgtgtgtgatggcttcctctgccctcctttggatggcaagcgtcgaaccacactggatcgccgcttccataatcctggagtttttcttgatggtgctgctcattcccgaacctgacaggcagcggactccccaggataatcaactggcgtatgttgtgatcggacttctctttatgattctgacggtcgccgcaaacgagatgggtttgctggagaccacaaaaaaggacttaggcatcgggcacgtagctgtggaaaaccatcaccatgccgccatgctagatgttgacctgcacccagcatcagcttggactctctacgccgtggcgaccacaataattacccctatgatgcgtcatactatcgagaatacaacggctaacatttctcttaccgccatcgcaaatcaggccgctatactgatgggattggataaaggctggcccatcagtaagatggacattggtgtcccactgctcgcactggggtgctactcgcaggtgaaccctcttactttaacagccgcggtcctgatgctcgtggctcactatgccatcattggcccgggattgcaagcaaaggccaccagagaagctcagaaaaggaccgccgcaggcatcatgaagaatcccacaatagatgggattgttgctatcgacctggatccagtggtatacgacgccaaattcgagaagcagctaggacagatcatgctgctcattctttgtactagccaaatcctgttgatgcgcacgacctgggcgctgtgcgaatccataacactcgccactggccctctgaccacattatgggagggttctcccgggaaattttggaacaccactattgcagtgtcaatggctaatatcttccggggaagctatcttgccggcgcaggtctggctttctccctcatgaagagtctaggcgggggacgaagaggcacgggggcccagggagagacactgggcgaaaagtggaaaaggcagttgaaccagctgtctaagagcgagtttaatacctacaaacgctcaggtattatggaagtcgaccggtccgaggccaaggaagggctcaaaagaggagagactaccaagcacgcggttagtcgtggcacagctaagcttaggtggttcgtggagcggaacctggtcaaaccagaaggtaaggtgatcgatttgggctgtgggcgcggaggctggagctattactgcgcagggctgaaaaaggtaactgaggtgaaaggatataccaagggcggtcctgggcatgaagagcccataccgatggccacatacggatggaatctcgttaaattacactctggcaaggacgtgtttttcatcccacctgaaaagtgtgatacgctgctttgcgacattggcgagtcctcacccaacccaaccatcgaggaagggcgaactctgagagtcctaaaaatggtggagccctggctcaggggaaatcaattttgtattaagatcctgaacccttacatgccgagcgtcgtggaaacattggagcagatgcagcggaaacatggtggcatgctggttcgcaatcccctctcgagaaactctacccacgagatgtattgggtaagttgcgggactggaaatattgtgtccgctgtcaacatgacaagcaggatgcttctgaaccgattcaccatggcccaccggaagccaacgtacgaacgtgatgtggacttaggcgcaggtaccagacatgttgccgtggagcctgaagtcgctaatctggatatcatagggcagcgcattgagaacatcaaacacgaacataagtcaacatggcactatgacgaggataatccctacaagacttgggcgtatcatggatcctacgaggtgaaaccttctggcagcgccagttccatggtaaacggcgtggttaagttgctcaccaaaccatgggacgtcatccccatggtgacacaaattgcaatgactgataccacaccttttgggcagcagagggtgttcaaggaaaaagtcgacacccggactccaaaggctaagagaggaacggcccaaataatggaggttacagcacgctggctgtggagctttctatctaggaataaaaagccccgaatctgtacccgggaagagttcactagaaaagtgaggtcaaacgccgctattggtgccgtatttgtggacgaaaatcagtggaacagtgcgaaggaggcagtcgaggatgaccgcttctgggatcttgtgcaccgtgaacgggagctgcacaaacagggcaagtgcgccacctgcgtttataatatgatggggaagagagaaaaaaagctcggagagtttggcaaagctaagggttccagggccatctggtacatgtggctgggggcacgcttcttggaattcgaggctctgggatttatgaacgaggaccattggttcagccgagaaaattctctctcgggcgtggagggcgaagggcttcacaaactgggatacattttacgggatatctcaaagataccgggtggcaacatgtatgccgacgatacagctgggtgggacacgagaatcaccgaggatgacctgcagaatgaggccaaaattactgatatcatggaacctgagcatgcattgctcgcgaagagcatttttaagctgacataccaaaacaaagtcgtgagggtacagcgcccagccaagaatggaaccgttatggacgtgatctccagacgggatcagaggggcagtggtcaggtcgggacttatggactaaacacattcaccaacatggaagctcaacttatacgtcagatggagtctgaagagatttttagccccaatgagctggaaacacctaacctcgccgagcgagtgctggactggttggaaaaatacggcgtggagcgcttaaagagaatggcaatctccggcgacgattgtgtcgttaaaccaatcgacgatcggttcgctactgccctgaccgcactcaatgacatggggaaggtgaggaaggatattccccagtgggaaccgtcaaaaggatggaacgactggcagcaagtacctttttgcagtcaccacttccatcagcttataatgaaggatggtcgcgagatcgtggtcccctgtagaaatcaggacgagctggtgggccgggccagggtttctcagggggcgggatggagcctacgagaaacggcttgcctgggcaaatcctatgcccaaatgtggcagctcatgtactttcaccgtagagatttgcgcctggcagccaacgctatttgttcagccgtgccagtcgactgggtgcctaccagccggacaacttggtctatccatgcacaccatcagtggatgaccacagaggatatgctttccgtatggaatagggtttggattgaagagaacccctggatggaagacaagactagagtgagtagctgggaggacgtcccatatctgggtaaacgcgaggatcaatggtgcgggtcgctcatcggattaaccgctcgggccacgtgggcgacaaatatacaggtggctatcaaccaggttaggcgactgattggcaatgaaaactactccgactacatgacctctatgaagagattcaagaatgagtcagaacccgagggcgccttgtggtga

SEQ ID NO: 14119 - RNA, 9879 nt, synthetic construct
  misc_feature 1..9879: note = derived and/or modified CDS sequence (opt3) from DENV-1__JN054256__SS-prME
  source 1..9879: mol_type = other RNA
agcgtgaccatgctgctcatgcttatgcccacagccctggctttccacttgactacgagagagggcgaacctcatatgatcgtctccaagcaggagagggggaaatctttactgtttaagacctcagcaggagttaacatgtgcacactaattgccatggacctcggtgaactgtgtgaggatactatgacctacaaatgcccacggataacagaagcggagccggacgatgtggactgttggtgcaatgctaccgatacttgggtaacatatggcacctgtagtcaaacgggggagcaccgccgagacaagcgtagcgtggcccttgcaccccatgtcggactgggcttggaaactagaaccgagacatggatgtcctctgaaggtgcctggaaacagatccagagggtggagacttgggctctccggcaccctgggttcaccgttattgcactgtttctggcccatgctatcggaacatcgattacccagaagggcatcatattcatcctcttaatgctggtgacgccatcaatggccatgcgctgcgtcggcattgggagcagagattttgtggagggacttagtggtgcgacttgggtagacgttgtgttggaacacggctcctgtgtcacaaccatggcaaaggataaacccactctggacatcgagctactcaagacagaagtgaccaaccctgccgtgctgaggaaactttgcattgaggctaagatctctaatacgaccacagatagccggtgtccaactcaaggggaagccaccctggtcgaggagcaggacgcaaacttcgtttgccgccgaacatttgtggatagaggatggggcaatggttgtgggttgttcggaaaaggctccctcctgacttgcgctaagtttaagtgcgtaaccaaattagaaggcaagatagtgcagtacgagaacctgaaatattcagtcattgtgacagttcacaccggggaccagcatcaagtgggaaatgaaagtactgagcacggtacgacagccaccatcactccccaggcgcctaccacagaaattcagctcaccgactacggcgcccttactctggattgtagcccaaggacagggttggacttcacggagatggtcctactgaccatgaaggagaaatcttggctcgtgcataagcagtggtttctggatcttccgctgccctggacttccggagcatcaacaagccaagaaacctggaaccggcaggacttgctcgtaacattcaaaactgctcacgccaagaagcaggaggttgtggtcctgggcagtcaagaaggtgctatgcacaccgccttaacgggggcaaccgagatccagacatctggcactaccacaatctttgccggacatctgaaatgccgtctaaagatggataaactcactctgaagggcatgtcctatgtgatgtgtaccgggagcttcaaacttgaaaaggaggtcgctgagacgcagcacggaacagtgttggttcagattaagtacgaaggtaccgacgcgccttgcaaaataccattctcgactcaagatgagaagggcgtgacacagaatgggcgcctgatcaccgcaaaccccattgtaactgacaaagaaaagcctgtcaatatcgaggccgagccaccctttggagaatcttatatagtgattggcgctggtgagaaagccctcaagctgtcctggttcaagaaagggtcaagtatcggcaagatgtttgaagcaaccgccagaggagctaggcggatggccatccttggcgatacagcatgggacttcgggagcattggaggtgtttttacgtccgtgggcaaactggtccatcagatcttcgggaccgcgtacggagtgttgttttctggcgtaagctggactatgaagattggtataggggtgctcctgacatggttaggcctgaactcacgaagtacctccctaagcatgacatgtatcgctgttggactcgtcactctgtaccttggcgtgatggtgcaggccgattctgggtgcgtcattaattggaaaggacgcgagttgaagtgtggctcaggtatcttcgttaccaacgaagtgcacacgtggacagagcaatataagtttcaggcagacagtccgaaaagactgagcgccgctatcgggaaggcctgggaggaaggagtgtgcggcattaggtccgcaacccggctcgagaatataatgtggaaacagatctctaacgaactgaaccatattttactggagaatgacatgaagcttactgtagtcgtgggtgatgttgctggcatcttggcccaggggaaaaagatgattcgccctcaacccatggaacacaaatactcgtggaagaactggggaaaggcgaaaatcataggcgccgacgtgcagaatagcaccttcatcattgatgggccaaacacacctgagtgttccgacgatcagagagcttggaatatctgggaggtcgaagactatggatttggcattttcactaccaacatctggctcaagctgagggattcatacacacaggtgtgcgaccaccgtctaatgagtgcagccataaaagattctaaggctgttcatgccgacatgggttattggattgagagcgaaaaaaatgagacgtggaagctggcacgggcgtcctttatcgaagtgaagacctgtatttggcccaaatcacacactctctggagcaacggggtactggagtctgagatgatcataccaaagatctacggaggccccatttcccaacataattatcgacctggttacttcacacagaccgccggcccatggcaccttgggaaattggaactggatttcgacttatgcgagggaactacagtcgtggtggatgaacactgcggcaacagagggccgagtctcaggaccacgactgtcaccggaaagatcattcatgagtggtgttgccgcagctgtacactgccccctcttcggtttagaggcgaggacggttgctggtacgggatggaaatcaggccagttaaagagaaggaagagaatctggtgaagtctatggtatccgctggatcaggcgaagtggacagtttcagcttgggtctcctgtgtatatcgattatgatcgaggaggtcatgcgctcccgatggtctcggaaaatgctaatgaccggcactctggccgtgtttttcctcctgatcatggggcagcttacatggaacgatttgattcgtctgtgcatcatggttggagcaaatgctagcgacagaatgggcatggggaccacatatttagccctcatggcaacttttaagatgaggcccatgttcgccgtgggactgctttttcgccggctgacctcaagagaagtcctactcctgacgattggcttgagtctggtggcttccgttgagttacctaactctctcgaagagctgggtgatgggcttgcgatgggaataatgatcctgaaattgctcattgacttccaaagccaccagctgtgggccacactactgtccatgacctttatcaagactaccttctcacttcattacgcatggaaaacaatggctatggtgctcagcattgtcagtctgtttccattgtgtctgtctactacctcccagaagacgacatggttacccgtactcctgggcagccttggctgcaagccgctgaccatgttcttgatcgccgaaaataaaatatgggggaggaagtcgtggcctctcaacgagggaatcatggccgtgggtattgtttcaatcctgctatctagtctgcttaaaaacgatgtgccactcgctggccccctgattgcagggggaatgttgatcgcctgttatgtcatatccggcagctctgcggacttaagcctggagaaggctgccgaagtgtcctgggaggaagaggcagaacactcaggtgccagtcataatattctcgtagaggtgcaggatgacgggactatgaaaatcaaggatgaggaacgagacgatacactgaccatccttctgaaagctactttgctagcagtcagcggagtttaccctctgtctattcccgccacactctttgtgtggtatttctggcaaaagaagaaacagcgctccggcgtgctgtgggacaccccatcacctcccaaggtcgagcgggcggtgcttgatgacggcatatacagaatcatgcagagggggttactgggacgtagtcaggttggtgtaggcgtgttccaagaaaacgtctttcacacgatgtggcacgtgactcgcggggctgttctcatgtatcagggaaaacggttggagccaagctgggcctccgtgaagaaagacctgatttcttacggcggtgggtggagactccagggatcgtggaataccggcgaggaagtccaggtgatcgcagtagagccgggcaagaaccctaagaatgtccaaacagcccccgggaccttcaaaacaccagaaggagaggtgggtgctattgccctggattttaagcccggcactagcgggtcacctatcgttaacagggaaggaaaaatagtgggcctttacggtaatggggtcgtgaccacgtccggaacatatgttagtgcaatcgctcaggccaaggcgtctcaggagggcccactgcccgagattgaagacgaggtgttccgaaaacggaacttgactatcatggatctacatcctggcagcgggaagacccgcagatacctgccggccattgtcagggaagcaatcaagcggaaaatgcgaacactcatattagctccaaccagagtggtagcctccgagatggctgaagcactgaagggaatgcccattcgctatcaaactaccgccgtgaaatcagagcacacaggtaaggagatcgttgaccttatgtgccatgccacgtttactatgaggctgctctctcctgtccgtgtgccaaattacaacatgatcattatggatgaagctcacttcaccgaccccagcagtatcgcggcacggggctatatatccacaagagtggggatgggagaggccgctgccatttttatgaccgcaactcctccgggcagcgtcgaagccttcccccagtctaatgctgtaatccaggatgaggaaagggacattccagagcgctcatggaactccggttacgagtggatcacagattttcctgggaaaaccgtgtggttcgttcccagtataaaggcgggaaatgacattgccaactgtttgcgaaagaatggcaaaagagtgatccagctgagccggaagacgtttgatactgaatatcaaaaaacaaagaacaacgactgggactacgtcgtgaccaccgatatctcggagatgggcgcaaatttcagggctgaccgcgttattgatccacgtagatgcctcaaacctgtgatcctgaaggacgggcccgaacgggtcattcttgccggaccaatgccggtgactgtagcatctgccgctcagaggcgcggtcgaataggcagaaaccataataaggagggggatcagtacatctatatgggacagcctctaaacaatgacgaggatcacgcccactggacagaagcgaaaatgctgttggacaacattaatacccccgagggcatcatcccagcattattcgaacccgagcgggaaaagtccgccgctattgatggtgagtacaggctgcgcggggaggccagaaaaacatttgtggaactcatgaggcggggcgacctgcctgtttggcttagctataaggtcgcttcagagggattccaatacagtgatcgtcgctggtgctttgacggcgaacgaaacaatcaggtgctggaggaaaacatggatgtggagatatggactaaagagggggaaagaaagaaactcaggccacggtggttggacgcacgcacgtattctgaccccctggccctaagagagttcaaggaatttgctgccggaaggcggtccgtcagcggtgatctgatcctcgagattggcaagcttcctcagcatctgacccagcgagcacaaaatgcgttagacaacttggttatgctgcacaattcagaacaggggggaagagcctaccgccatgctatggaggagctcccggatacaatcgaaactctgatgcttctggccctcattgcagtgttgaccggcggtgtaacactgttctttttaagtgggaaaggcctaggaaagaccagcatcggcctgctctgtgtgatggcttcctctgcccttctgtggatggcaagcgtcgagccacactggatagccgcttccatcattttggaattctttctgatggtgctcctgatccccgagcctgacaggcagcggactccccaggataaccaacttgcgtatgttgtgattgggctcctgttcatgatcttgacggtcgccgcaaatgagatgggactgttagaaaccacaaaaaaggacctaggtataggccacgtagctgtggagaaccatcaccatgccgccatgctggatgttgacctccacccagcatcagcttggactctttacgccgtggcgaccacaattatcacccctatgatgcgtcatactattgaaaacacaacggctaatatctctctgaccgccatagcaaaccaggccgctatcttgatggggctggataaaggatggcccattagtaagatggacatcggcgtcccactcctggcacttggttgctactcgcaggtgaatcctttaactctgacagccgcggtcctcatgttggtggctcactatgccattatcgggccgggcctgcaagcaaaggccaccagagaggctcagaaaaggaccgccgcaggaataatgaagaaccccacaattgatggcatcgttgctatcgacctagatccagtggtatacgacgccaaatttgaaaagcagctggggcagattatgctccttatcctgtgtactagccaaatattgctgatgcgcacgacctgggcgctctgcgagtccattacactggccactggacctttaaccacactttgggagggctctcccggtaaattctggaataccactatcgcagtgtcaatggctaacatttttcgggggagctatctggccggagcaggcctcgctttctccctaatgaagagtctgggtggcgggcgaagaggaacgggcgcccagggggaaacattgggagagaagtggaaaaggcagctgaatcagctctctaagagcgaattcaacacctacaaacgctcaggcatcatggaggtcgaccggtccgaagccaaggagggtcttaaaagaggggagactaccaagcacgcggttagtcgtggaacagctaagctgaggtggtttgtggaacggaatttggtcaaaccagagggcaaggtgatagatctgggttgtggccgcgggggatggagctattactgcgcaggcctcaaaaaggtaactgaagtgaaagggtataccaagggaggccctggtcatgaggaacccatcccgatggccacatacgggtggaacttagttaaactgcactctggaaaggacgtgttctttattccacctgagaagtgtgatacgcttctgtgcgacatcggcgagtcctcacccaatccaaccattgaagagggccgaactctaagagtcctcaaaatggtggaaccctggctgagggggaaccaattctgtatcaagattttgaatccttacatgccgagcgtcgtggagacactggagcagatgcagcggaaacatggaggtatgctcgttcgcaaccccctttcgagaaattctacccacgaaatgtattgggtaagttgcggcactgggaacatcgtgtccgctgtcaatatgacaagcaggatgctgttaaaccgatttaccatggcccaccggaagccaacgtacgagcgtgatgtggacctgggagcaggcaccagacatgttgccgtggaacctgaggtcgctaacttggatataattggtcagcgcatcgaaaatatcaaacacgagcataagtcaacatggcactatgacgaggataacccctacaagacttgggcgtatcatgggtcctacgaagtgaaaccttctggaagcgccagttccatggtaaatggcgtggttaagctcctgaccaaaccatgggacgtcattcccatggtgacacaaatagcaatgactgataccacacctttcggccagcagagggtgtttaaggagaaagtcgacacccggactccaaaggctaagagagggacggcccaaatcatggaagttacagcacgctggctatggagcttcctttctaggaacaaaaagccccgaatttgtacccgggaggaatttactagaaaagtgaggtcaaatgccgctatcggagccgtattcgtggacgagaaccagtggaatagtgcgaaggaggcagtcgaagatgaccgcttttgggatctggtgcaccgtgagcgggaactccacaaacagggtaagtgcgccacctgcgtttataacatgatgggcaagagagagaaaaagctgggggaattcggaaaagctaagggctccagggccatttggtacatgtggttgggtgcacgctttctggagttcgaggctctcgggttcatgaatgaagaccattggtttagccgagagaactctctttcgggagtggaaggcgagggcctgcacaaattagggtacatcctgcgggatatatcaaagatcccgggaggtaatatgtatgccgacgatacagctggctgggacacgagaattaccgaggatgacttgcagaacgaagccaaaatcactgatattatggagcctgaacatgcactcctggcgaagagcatcttcaagctaacataccaaaataaagtcgtgagggtacagcgcccagccaagaacgggaccgttatggacgtgatatccagacgggatcagaggggaagtggccaggtcggtacttatgggcttaatacatttaccaacatggaggctcaactgattcgtcagatggaatctgaggagatcttcagccccaacgaactcgagacacctaatctggccgaacgagtgttggactggttagagaaatacggagtggaacgcctgaagagaatggcaatctccggcgacgattgtgtcgttaaaccaattgacgatcggtttgctactgccctcaccgcacttaacgacatgggcaaggtgaggaaggatataccccagtgggagccgtcaaaagggtggaatgactggcagcaagtacctttctgcagtcaccactttcatcagctgatcatgaaggatggacgcgagattgtggtcccctgtagaaaccaggacgaactagtgggtcgggccagggtttctcagggcgcggggtggagcctgcgagagacggcttgcctcggaaaatcctatgcccaaatgtggcagttgatgtacttccaccgtagagatctgcgccttgcagccaatgctatctgttcagccgtgccagtcgactgggtgcctaccagccggacaacttggtctattcatgcacaccatcagtggatgaccacagaagatatgctgtccgtatggaacagggtttggatcgaggaaaatccctggatggaggacaagactagagtgagtagctgggaggacgtcccatatctcggcaaacgcgaagatcaatggtgcggttcgttaatagggctgaccgctcgggccacgtgggcgacaaacatccaggtggctattaatcaggttaggcgattgatcggaaacgagaattactccgactacatgacctctatgaagagatttaagaacgaatcagagcccgagggcgccctgtggtga

SEQ ID NO: 14120 - RNA, 9879 nt, synthetic construct
  misc_feature 1..9879: note = derived and/or modified CDS sequence (opt3) from DENV-1__JN054255__SS-prME
  source 1..9879: mol_type = other RNA
agcgtgaccatgctgctcatgcttatgcccaccgcactggctttccacttgactacgcgaggaggggagcctcatatgatcgtctccaagcaggaaaggggaaaatctttactgtttaagacctcagccggtgttaatatgtgcacactcattgccatggacctcggagagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggttgacgttgtgttggagcacgggtcctgtgtcacaaccatggcaaaggataaacccactctggacatcgaactgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagatgtctggaaccacaactatctttgccggccatctgaaatgccgtctaaagatggataaactcaccctgaaggggatgtcctatgtgatgtgtacaggcagcttcaaacttgagaaggaagtcgctgagactcagcacggtaccgtgttggttcagattaagtacgagggcacggacgcgccttgcaaaataccattctcgacacaagatgaaaagggggtgacccagaacggacgcctgatcactgcaaatcccattgtaacagacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaaccgccagaggcgctaggcggatggccatccttggggatactgcatgggacttcggaagcattggtggcgtttttacctccgtggggaaactggtccatcagatcttcggaacagcgtacggcgtgttgttttctggtgtaagctggacgatgaagattgggataggcgtgctcctgacctggttaggactaaattcacgaagtacttccctaagcatgacatgtatcgctgttggcctcgtcaccctgtaccttggggtgatggtgcaggccgattctggatgcgtcattaactggaaaggccgcgaattgaagtgtggttcagggatcttcgttacaaatgaggtgcacacttggaccgaacaatataagtttcaggcagacagtccgaaaagactgagcgccgctatcggaaaggcctgggaggagggcgtgtgcggtattaggtccgcaacgcggctcgaaaacataatgtggaaacagatctctaacgagctgaatcatattttactggaaaacgacatgaagttcacagtagtcgtgggcgatgttgctgggatccttgcccagggcaaaaagatgattcgccctcaacccatggagcacaaatactcgtggaagaattggggcaaggcgaaaatcataggggccgacgtgcagaacagcacctttatcattgatggaccaaatactcctgaatgttccgacgatcagagagcttggaacatctgggaggtcgaggactatggcttcggtatttttaccacaaatatctggttgaagctcagggattcatacactcaggtgtgcgaccaccgtctgatgagtgcagccataaaagattctaaggctgttcatgccgacatggggtattggattgaaagcgagaaaaacgaaacctggaagctagcacgggcgtccttcatcgaggtgaagacatgtatttggcccaaatcacacacgctgtggagcaatggagtactcgaatctgagatgatcataccaaagatctacggcggtcccatttcccaacataactatcgacctggctacttcacccagactgccgggccatggcacctgggaaaacttgagttggattttgacctgtgcgaaggcacaaccgtcgtggtggatgagcactgcgggaatagaggaccgagtttaaggactacaaccgtcacgggcaagatcattcatgaatggtgttgccgcagctgtactctaccccctctgcggttcagaggtgaggacgggtgctggtacggaatggagatcaggccagttaaagaaaaggaggaaaaccttgtgaagtctatggtatccgctggctcaggtgaggtggacagttttagcctgggcttgctctgtatatcgattatgatcgaagaggtcatgcgctcccgatggtctcggaaaatgctgatgaccgggacactagccgtgttctttctgctcatcatgggacagctgacctggaatgatcttattcgtttgtgcatcatggttggcgcaaacgctagcgacagaatggggatgggaactacatatctggccttaatggcaaccttcaagatgaggcccatgtttgccgtgggcctcctgttccgccggcttacatcaagagaggtcctgctactcactattggtctgagtttggtggcttccgttgaactgcctaattctttagaggaactcggggatggactggcgatgggcataatgatccttaaactgttgaccgactttcaaagccaccagctctgggccacgctgctatccatgacattcattaagaccactttttcactgcattacgcatggaaaaccatggctatggtgcttagcatcgtcagtctcttcccactgtgtttgtctacaacttcccagaagaccacgtggctgcccgtattactcggcagcctggggtgcaagccgcttacaatgtttctgattgccgagaacaaaatctggggaaggaagtcgtggcctttgaacgaaggtataatggccgtgggcatcgtttcaattctcctgtctagtctactgaaaaatgatgtgccacttgctgggcccctcatcgcaggaggcatgctgattgcctgttatgtcatctccggtagctctgcggacttgagcttagagaaggctgccgaggtgtcctgggaagaggaagcagagcactcaggggccagtcataacatactggtagaagtgcaggatgacggaaccatgaaaattaaggatgaggagcgagacgatactctcacaatcctgcttaaagctaccctgttggcagtcagcggcgtttaccctctatctatccccgccactctgttcgtgtggtatttctggcaaaagaagaaacagcgctccggcgtgctctgggacacaccatcacctcccaaggtcgaaaaagcggtgctggatgacgggatttaccggataatgcagagaggacttttaggtaggagtcaggttggcgtaggggtgtttcaagagaatgtcttccacaccatgtggcacgtgacgcgtggagctgttctgatgtatcagggcaagcgcctcgaaccaagctgggcctccgtgaaaaaggacttgatctcttacggtgggggatggcggctgcagggctcgtggaacactggcgaggaggtccaggtgattgcagtagaaccggggaagaatcctaaaaacgtccaaaccgcccccggaacatttaagaccccagagggtgaagtgggcgctatcgccctcgatttcaaacccgggacaagcggatcacctattgttaatagagagggcaagatcgtgggtctgtacgggaacggagtcgtgactacctccggcacgtatgttagtggcatagcacaggctaaagcctctcaggaagggccacttcccgagatcgaggacgaagtgtttaggaagcgaaatctgacaattatggatttgcatcctggaagcggtaagactcggcgctacctaccggcgatcgtcagagaggccattaaaaggaagatgcggaccctgatcctcgcaccaacacgagtggtagcttccgaaatggccgaggctttaaaaggcatgcccataagatatcaaaccactgcagtgaagtcagaacacaccgggaaagagattgttgacctgatgtgccatgccacattcacgatgcgccttctgtctcctgtcagggtgccaaactacaatatgatcatcatggatgaggcccactttactgaccccagcagtattgctgcgcgtggatatatctccacccgggtgggcatgggtgaagcagccgctatattcatgacagccacccctccggggagcgtcgaggcatttccccagtctaacgccgtaattcaggatgaagagagagacatcccagaaaggtcatggaactccggatacgagtggattactgatttccctggcaagacagtgtggtttgttcccagtatcaaggctggcaacgacatagcgaattgtctccgcaaaaacgggaagcgagtgattcagttgagcagaaaaaccttcgatacggagtatcaaaagactaaaaacaatgactgggactacgtcgtgacaaccgatatctcggaaatgggagccaacttccgggcagacagggttatcgatccacgccgttgcctgaagcctgtgattctcaaggacggtcccgagagagtcatcctggctggcccaatgccggtgaccgtagcctctgcagcccagcggagggggcgcattggacgaaatcataacaaagaaggcgatcagtacatatatatgggtcagcctcttaataacgacgagaatcacgctcactggactgaggccaagatgctactggataacatcaatacacccgaagggattatcccagcgttgtttgagcccgaaagagagaaatccgcagccatcgacggcgaataccggttaaggggagaggctcgcaagaccttcgtggagctgatgagaaggggcgatctccctgtttggctgagctataaagtcgcctcagaagggtttcaatacagtgaccggcgttggtgcttcgatggagagcgcaacaatcaggtgcttgaagagaacatggacgtggaaatttggacaaaggagggtgagaggaaaaagctgagaccaagatggctcgatgctcggacttattctgaccccttggcactgcgcgaatttaaggagttcgccgctggcagaaggtccgtcagcggggacctaatactggaaatcggaaaactccctcagcatcttacgcagcgggcccaaaatgcactggataacttagttatgttgcacaattcagagcagggcggtcgagcgtacagacatgccatggaggaactgccggacaccattgagacactcatgctgcttgctctgatcgccgtgctcactgggggcgtaaccttgtttttcctgagtggaaagggcttagggaaaacaagcattggactactgtgtgtgatggcatcctctgctctcctttggatggccagcgtcgaaccacactggatcgcagcctccataatcctggagtttttcttgatggtgctgctcattcccgaacctgatcgccagaggacaccccaggacaaccaactggcttatgttgtgatcggtcttctctttatgattctgactgtcgcggccaacgagatgggcttgctggagacgaccaagaaagatttagggatcggacacgtagcagtggaaaatcatcaccatgctgccatgctagacatagatctgcacccagcctcagcatggacactctacgctgttgccactaccattatcacacctatgatgcggcataccattgagaacactacagcgaatatctctcttacggctatagccaaccaggcagccatcctgatgggcttggacaagggttggcccattagtaagatggatatcggggtgccactgctcgctctgggctgctactcgcaggtcaatcctcttaccttaactgcagccgtgctgatgctcgtcgcgcactatgctattatcggaccgggcttgcaagccaaagcaacacgtgaagcccagaagagaaccgctgccgggataatgaaaaaccccaccattgacggaatcgtggcaatcgatctggacccagttgtgtacgatgctaagttcgagaaacagctaggccagattatgctgctcatcctttgtacaagccaaatactgttgatgaggactacgtgggccctgtgcgaatccattaccctcgcgacaggtcctctgactaccttatgggaggggtctcccggaaagttttggaatacaaccatcgccgtatcaatggcaaacattttccgcggcagctatcttgctggtgccggcctggcattctccctcatgaagagtctagggggaggccggcgagggactggagctcagggcgagacgctgggtgaaaaatggaagagacagttgaatcagctgtctaaaagcgagtttaacacatacaagaggtcagggatcatggaagtggaccgctccgaggccaaagaaggactcaagcggggcgagaccactaagcacgccgtcagtagaggtaccgcgaaacttcgttggttcgttgagaggaatctggtgaagccagaaggcaaagtcatagacttggggtgtggacggggcgggtggagctattactgcgctggactgaagaaagtgacagaggtaaagggctatactaaaggtgggcctggacatgaggaacccatcccgatggcaacctacggctggaacctcgtgaagttacactctggcaaggatgtatttttcattccacctgaaaaatgtgacacactgctttgcgatatcggggagtcctcacccaatccaacgattgaggaaggacgcaccctgcgagtgctaaagatggtcgagccctggctcagaggtaaccaattttgtatcaaaattctgaatccttacatgccgagcgtggtcgaaactttggagcagatgcagaggaagcatggcgggatgctggtgcggaaccccctctcgcgcaattctacacacgagatgtattgggttagttgcggaaccggcaacatcgtatccgccgtgaacatgactagcagaatgcttctgaataggttcacaatggctcaccgaaaaccaacctacgaacgggacgtcgatttaggtgccgggacgcgtcatgtggcagttgagcctgaagtggccaacctggacataattggacagagaatcgagaatatcaagcacgaacataagtcaacctggcactatgatgaggacaacccctacaaaacatgggcttatcatggctcctacgaggtcaagccttctggcagcgcgagttccatggtgaatgggatggtaaaattgctcactaagccatgggatgtgattcccatggttacccaaatagccatgacagacactaccccttttggacagcagcgcgtcttcaaagaaaaggtggatacaaggaccccaaaggcaaaacggggtactgctcaaatcatggaggtgacggccagatggctgtggagctttctatctcgcaacaagaaacccaggatttgtacacgagaagagttcacccggaaggtcagatcaaatgcagccatcggcgctgtttttgtggacgaaaaccagtggaatagtgccaaagaggcggtagaggacgataggttctgggaccttgtgcaccgcgaacgtgagctgcacaagcaggggaagtgcgcaacttgcgtctataacatgatgggaaaacgggaaaagaaactcggcgagtttggtaaggccaaagggtccagagctatttggtacatgtggctgggagccaggttcttggagttcgaggcactgggctttatgaatgaggatcattggttcagccgcgaaaactctctctcgggcgtggagggggaaggacttcacaagctgggttacatcttacgagacatatcaaaaatcccgggcgggaatatgtatgctgatgacaccgccggatgggatacacggattacggaggacgatctgcagaacgaggctaagatcaccgacattatggaacctgagcatgccttgctcgcaaagagcatctttaaactgacttaccaaaataaggttgtgagagtccagaggccatccaaaaacggcacagtgatggatgtaataagtcgcagagaccagcggggttctgggcaggttggaacctatggcctaaacactttcacaaatatggaagcgcaacttattaggcagatggagagcgaagagatcttttcccccaacgagctggaaacccctaatctcgccaagcgtgtgctggattggttggagaaatacggcgtcgaacgattaaagcgcatggctatctcaggggacgactgtgtggtgaagccaattgatgacagattcgccacagcactgactgctctcaacgatatgggaaaagtccggaaggacataccccagtgggagccgagtaaaggttggaatgattggcagcaagttcctttttgctctcaccacttccatcagcttatcatgaaggacggcagggaaattgtggtaccctgtcgcaaccaggatgagctggtggggagagcccgggtcagccagggagcaggctggtccctaagggagaccgcctgcctgggtaaatcatatgcgcaaatgtggcagctcatgtactttcaccgacgtgacttgagactggctgccaatgcaatctgtagcgccgtgccagttgattgggtgcctacgtctcgcaccacatggtccattcatgctcaccatcagtggatgactaccgaagacatgcttagtgtctggaaccgggtgtggatcgaggaaaatccctggatggaggataagacaagggtaagctcgtgggaagacgttccatatctggggaagagagaggaccaatggtgcggatccctcataggcttaactgcccgcgcaacctgggctacgaacatccaggtggccattaatcaggtccggaggctgatcggcaacgagaattactctgattacatgacatcaatgaaacgattcaagaacgaaagcgagcccgaaggggcgttgtggtga

SEQ ID NO: 14121 - RNA, 9879 nt, synthetic construct
  misc_feature 1..9879: note = derived and/or modified CDS sequence (opt3) from DENV-1__KP406801__SS-prME
  source 1..9879: mol_type = other RNA
agcgtgaccatgctgctcatgcttctgcccacagcattggctttccacttaactacgagaggaggggaacctcatatgatcgtctccaagcaggaaaggggaaagtctctgttgtttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatacaatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacactagatatcgaactcctgaagaccgaggtgacgaaccctgcagtgcttaggaaactgtgcattgaagccaagatctccaataccacaactgactctcggtgtccaacccaaggagaggctacattggtcgaagaacaggatgccaacttcgtttgccgccgaacttttgtggacagaggctggggtaatgggtgtggactcttcggcaaaggcagcctgttaacctgcgcaaagtttaagtgcgtaacaaaactggaggggaagatagtgcagtacgaaaacctcaaatattccgtcattgtgaccgttcacactggagatcagcatcaagtgggtaatgagacgacagaacacggcaccatcgctactattacaccccaggcccctacatcagagatccagcttaccgactacggggcgctgactttggactgtagtccaaggacaggactagatttcaacgaaatggtcctgctcacgatgaaggagaaaagctggctggtgcataagcagtggtttcttgacctgccgttgccctggacctctggcgcctccacttcacaagagacatggaatcggcaggatctcctggtaaccttcaaaacagcacacgctaagaagcaggaagttgtggtcttaggtagccaagagggggccatgcacactgctctggccggcgcaaccgaaatccagatgagtggaacgaccacaatttttgccggccatctaaaatgccgtctcaagatggacaaactgactcttaagggggtgtcttatgtcatgtgtaccggatccttcaaattggagaaggaagtggctgagacacagcacggtactgttctggtgcaggtaaagtacgagggcaccgatgcgccttgcaaaataccattcagcatccaagacgaaaagggggtcacgcagaacggacgcctcattacagcaaatcccatcgccaccgataaagagaagcctgtgaacatagaaactgagccaccctttggcgagtcgtatattgttatcggtgctggggaaaaagccctgaaactttcttggttcaagaaaggctcctcaatcggaaagatgtttgaggcaacagccagaggcgctaggcggatggccattctgggggacaccgcatgggatttcggaagtatcggtggcgtgtttactagcgtcgggaaattggtgcatcaggtattcggaaccgcgtacggcgtgctcttttccggtgtttcttggacaatgaagattgggataggcatcctgttaacgtggctgggactaaatagccgatcaaccagtctctccatgacttgtattgctgtcggcatggtgacactgtaccttggggtgatggtccaggccgacagcggatgcgttatcaactggaaaggccgcgaattgaagtgtggttctgggatcttcgtgaccaacgaggtgcacacatggactgaacaatataagtttcaggcagattcaccgaaaagactgagtgccgctattggaaaggcctgggaggagggcgtatgcggtataaggagcgcaacccggctcgaaaatatcatgtggaaacagatttccaacgagctgaatcatatcttactggaaaacgacatgaagttcacggtcgtggttggcgacgctaatgggattcttacacagggcaagaaaatgatccgccctcaacccatggagcacaaatactcttggaagtcgtggggcaaggccaaaataatcggggcggatacccagaacactacctttattatcgacggaccagatacacctgaatgtcccgacgatcagagagcctggaatatttgggaggtggaggactatggcttcggtatctttactaccaacatatggttgaagctcagggatagctacacacagatgtgcgaccaccgtctgatgtccgctgcaattaaagattcaaaggccgtccatgctgacatggggtattggatcgaaagtgagaaaaatgaaacgtggaagctagcccgggcatctttcattgaggtgaagacctgtatctggccacgaagccacactctgtggtccaacggagttctcgaatcagagatgataatccccaaaatttacggcggtcctatcagccaacataattatagaccaggctacttcacacagaccgcggggccgtggcacctgggaaaacttgagttggattttgacctgtgcgaaggcactacagtggtagtcgatgagcactgcgggaacaggggaccctctttacgcaccacgactgtgaccggcaaaattatccatgaatggtgttgccggtcctgtacactccctccactgagattcaagggtgaggacgggtgctggtacggaatggagataaggcccgtgaaagaaaaggaggaaaatcttgtccgcagtatggttagcgccggctctggtgaggtggactccttttcactgggcttgctctgtgtaagtattatgatcgaagaggtgatgcgaagccggtggtcgcgtaagatgctgatgaccgggactctagctgtcttctttctgctcatcatgggacagctgacatggaacgatcttattagattgtgcatcatggtgggcgccaatgtttccgacaggatggggatgggaaccacatatctggcattaatggctactttcaaaatgcgccctatgtttgccgtgggcctcctgttccggagacttacctctagggaggtcctgctactcacgattggtctgagcttggtggcatcagttgaactgccaaacagtttagaggaactcggggatggactggccatgggcataatgatgcttaagctgttgacagactttcaatcccaccagctctggaccactctgctatctctgaccttcatcaaaacaactcttagcctcgattacgcttggaagaccattgcgatggtgctgtccatcgtctcattgtttcccctgtgtttaagcacgacaagtcagaaaaccacttggctcccggtactgcttggctctttcgggtgcaagcctctgacaatgtttttgattaccgagaacaagatctggggacgacgctcctggccactcaatgaaggtataatggccgtgggcatcgttagcattctgctatcgtcactgcttaaaaacgacgtgcccctcgcagggcctctgatcgctggaggcatgttgattgcctgttatgtcatctctggtagttccgccgatttaagcctggagaaggctgcagaggtgtcttgggaagaggaagccgagcatagcggggcgtcccacaatatactcgtagaagtgcaggacgatggaactatgaaaattaaggacgaggagcgggatgacacactgaccatccttctgaaagctacgttgctagccgtctcaggcgtttaccccatgagtatcccagcaactctgttcgtgtggtatttctggcaaaagaaaaagcagagaagcggcgtgctctgggataccccttctcccccagaagtcgagagggccgtgctggacgacgggatttaccgtatacttcagcgcggattactgggtcggtcccaggttggcgtaggggtgtttcaagatggagtcttccatacaatgtggcacgtgaccagaggcgctgttctcatgtatcagggtaagaggttggaaccgtcatgggcaagtgtgaaaaaggacctgatcagctacgggggaggctggcgatttcagggctcctggaacacaggggaggaggtccaggtgattgccgtagaacctggcaagaatcccaagaacgtccaaactaccccaggtacgttcaaaacacccgagggcgaagtgggggcgatcgctctcgattttaagcctggaacttctggctcgccaattgttaatcgggagggtaagatcgtggggctgtacggaaacggcgtcgtgaccacaagcggcacctatgtttcagccatagcacaggccaaggcttcccaggaagggccccttcctgagatcgaggacgaagtgttcaagaaacgcaatctgactattatggatttgcacccgggaagtggtaagaccagaaggtacctaccagccatcgtccgggaggcaattaaacgaaagctgagaacactcatcttagctcccacgcgcgtggtagcctctgaaatggcggaggccctgaagggcatgcctataaggtatcaaactaccgcagtgaaaagcgaacatacagggcgtgagattgttgaccttatgtgccacgctacctttactatgcggctgctctccccagtcagagtgcccaactacaatatgatcatcatggatgaggcccatttcacagaccctgcttcaattgcagccaggggatatatctctacccgcgtgggcatgggtgaagccgctgcgatatttatgacggcaactccgcccgggagcgtcgaggccttcccacagagtaacgctgtaattcaggatgaagaacgagacatccctgaaagatcctggaatagcggatacgattggattacagactttcccggcaagaccgtgtggttcgttccatctatcaaatcaggcaacgacatagccaattgtttgcggaagaacgggaaaagggtgattcagctgtcccgcaagaccttcgatactgagtatcaaaagaccaagaacaatgactgggattacgtcgtgaccacagacatcagtgagatgggagcaaactttcgtgccgatagagttatcgaccctcggaggtgcctcaagcccgtgattctgaaagatggtccagaacgcgtcatccttgctggcccgatgcctgtgactgtagcgagcgccgcacagcgaagagggcggattggaaggaatcagaacaaggagggcgaccagtacatatatatgggtcaacccctaaataacgatgaagaccacgctcattggacggaggccaaaatgctgttggataatatcaacaccccagaggggattatccccgcattattcgaacctgagcgcgaaaagtcggccgctatcgacggcgagtacagactgaggggagaagcccggaagacatttgtggagctcatgcgtcgcggcgatctgccagtttggctttcttataaagtcgcgtccgaggggttccagtacagcgaccgaagatggtgctttgacggagaaaggaataaccaggtgctggaggaaaatatggatgtggagatttggactaaggaaggtgagcggaaaaagctccgccccagatggttggacgcaaggacctattcagatcctctggccctacgggagttcaaagaatttgctgccggccgaagaagtgtctctggggacctgatactcgagatcggaaaacttccgcagcacctgacattacgcgctcaaaacgcattggataatctggttatgctccacaactccgaacagggcggtaaagcctacaggcatgctatggaggaactgccagacaccattgagactcttatgctgctcgccttgatcgcagtgctgaccgggggagtaacgttattctttctaagcggaaagggcctggggaagacatcaattggactcctttgtgtgatggcgagtagcgtcctgttgtggatggcctccgtggagccccactggatcgctgcctctataatcctggagttctttctcatggttctgcttattcctgagcccgatcggcagcgtactccacaggacaatcaactcgcatatgtggtcatcggtctgttgttcatgattctgaccgtagctgccaacgaaatgggcttactagagacaaccaaaaaggatctggggatcggacatgtggttgcagagaaccaccaccatgccactatgctcgacatagatcttcaccctgctagcgcgtggacactgtacgccgtggcaacgaccattatcactcccatgatgagacatacaattgaaaataccaccgctaacatctccttgacagccatagccaatcaggcagctatcctgatgggcctcgacaaaggttggccaatttcaaagatggatatcggggtccctctgcttgccttaggctgctactctcaggtgaacccgctgactctcacggcggctgtcttgatgctggtggcccactatgcaattatcggacccggcctacaagccaaagctaccagggaggcacagaagcgcacagccgcggggataatgaagaatccaactgttgacggaattgtggctatcgacctggatcctgtagtgtacgacgccaaatttgaaaagcagctcggccagatcatgcttctgattttgtgtaccagtcaaatcctgctcatgcggacaacctgggcactgtgcgagtcgataactttagccacgggtccccttacaaccctgtgggaagggagcccaggaaaattctggaacactaccattgctgtctccatggccaatatcttccgaggctcttatctcgccggtgctggcctagccttttcactgatgaaaagcctagggggaggcagaagggggacaggagcgcagggcgagactctgggtgagaaatggaagcgccagctcaaccagctttccaagagtgagttcaatacctacaaacggtctgggattatggaggttgatagaagcgaagccaaggagggactgaaacgtggcgaaacaacgaagcatgcagtgtcaaggggtaccgctaaattgcggtggtttgtcgagcgcaacctggtgcgacctgagggcaaggtaatcgacctcgggtgtggaagaggcgggtggtcctattactgcgccggattaaagaaagtgactgaagttaagggctatacaaaaggtgggcccggacacgaggaaccgataccaatggcaacctacggctggaatctggtgaaactttacagtggcaaagatgtcttctttactcctcccgagaagtgtgacacactgctatgcgatatcggggaaagctctccaaaccccaccattgaggagggaaggacgctccgggtgctgaaaatggtcgaaccttggttgcgcggtaatcaattctgtatcaagattctgaacccgtatatgccctccgtggttgagaccctcgaacagatgcagagaaagcacggcgggatgcttgtaaggaatccactgtcacgaaacagcacacatgagatgtactgggtgtcgtgcggaactggcaatatcgtctctgctgtgaacatgaccagtcggatgttactgaaccgttttacaatggcccacagaaaacctacttatgagcgcgacgttgatttgggtgccgggaccaggcatgtggcggtcgaacccgagattgctaatctcgacatcataggacagcggattgaaaacatcaagaatgagcacaaatccacatggcactacgatgaagacaacccttataagacctgggcataccatggcagctatgaggtgaaaccatcaggctccgcctctagcatggtaaatggggtggttagactgctaactaagccctgggacgtcatccctatggtgacgcaaattgctatgacagataccactccattcggacagcagcgcgtgtttaaggagaaagtcgacaccaggacaccccgaccgaagcggggtacggcccaaataatggaagttaccgcaaaatggctttggggcttcctgagtagaaacaagaaacctaggatctgtactcgcgaggaatttacacgtaaggtgcggtccaatgccgctattggggcggtattcgtggatgagaaccagtggaatagcgccaaggaagcagtcgaggacgagaaattttgggatctcgtgcacagagaaagggagctgcataagcagggaaaatgcgctacctgcgtttacaacatgatgggcaagcgcgagaagaagttgggtgagttcgggaaggccaaaggatctcgagcaatctggtacatgtggctgggcgcccggttcctcgaatttgaggctcttggcttcatgaatgaggaccactggttttcaagagaaaacagtctgtccggggtggagggagaaggtttacataagctgggctatattttgagggatatcagcaaaataccagggggaaatatgtacgccgacgatactgcgggctgggacacacgcatcaccgaggatgacctccagaacgaggcaaagattacagatatcatggaacccgagcacgccctgctagctacttctattttcaaacttacctatcaaaataaggtcgtgagagtacagcggcctgccaaatcgggtacggttatggacgtgatctcaaggcgtgaccagcgagggagcggacaggtcggcacctacggcctgaacacatttactaacatggaagtgcaactcatacgccagatggagtccgaagggattttcagtccatctgagctggagaatagcaacttggcagaaagagtgttagattggctggagaagcacggagtcgaacggctcaagaggatggctatctccggtgacgattgtgttgtgaaacccaccgacgatcgctttgccacagctcttactgccctgaatgacatgggcaaggtaagaaaagatatcccgcagtgggagccttcaaaggggtggaacgactggcagcaagtgcccttctgcagtcatcactttcatcagctaattatgaaagatggacgggaaatagtcgtgccatgtaggaatcaggacgagctggttggccgagcacgtgtgtctcagggtgcggggtggagcctcagagagaccgcctgcttgggaaagtcctatgctcaaatgtggcagctgatgtacttccaccgccgggatcttaggctggccgcaaacgctatctgttcagccgtccctgtggactgggtacccacgagcagaacaacctggtctattcacgcacatcaccagtggatgactacagaagacatgctctccgtttggaatcgcgtgtggatcgaggaaaacccatggatggaggataagacccatgtcagtagctgggaagacgtgccctatttaggcaaacgggaggatcaatggtgcggctcgctgattgggttgactgccagggcgacctgggctacaaatatccaggttgccataaaccaggtgcgaagactgatcggaaatgagaactacctcgactacatgacgtccatgaagcggtttaaaaatgaatctgatcctgagggtgcactttggtga

SEQ ID NO: 14122 - RNA, 9879 nt, synthetic construct
  misc_feature 1..9879: note = derived and/or modified CDS sequence (opt3) from DENV-1__KP406802__SS-prME
  source 1..9879: mol_type = other RNA
agcgtgacaatgctgctcatgcttatgcccacagccctggctttccacttgactacgaggggaggggaacctcatatgatcgtctccaagcaggaaaggggaaaatctttactgtttaagacatcagcaggtattaacatgtgcacattaatagccatggacctcggcgagctgtgtgaagatactcttacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagagggtcgaaacttgggctctgcggcaccctggattcaccgtgatcgcactgtttctcgcccatgctattggcacatcgatcacccagaagggcataatcttcattttactgatgcttgttacgccatcaatggccatgcgctgcgtggggatcggaagcagagattttgtcgagggtttgagtggcgcgacttgggtggacgtagttctggagcacgggtcctgtgtgacaaccatggcaaaggataaacccactctggacattgaactcctgaagacagaggtcaccaaccctgccgtgcttaggaaactgtgcatcgaagctaagatatctaatacgaccacagatagccggtgtccaactcaaggagaggccaccttggtggaagaacaggacgcaaacttcgtctgccgccgaacatttgttgatagaggctggggtaatgggtgtggactcttcggcaaaggctccctgattacttgcgctaagtttaagtgcgtgaccaaattagaggggaagatcgtacagtacgaaaacctgaaatattcagtgattgtcacagtgcacaccggagaccagcatcaagttggtaatgagagtactgaacacggcacgacagccaccatcactccccaggcgcctaccacagagatccagctcaccgactacggggcccttactctggattgtagcccaaggacaggattggacttcaacgaaatggtgctactgacgatgaaggagaaatcttggctcgtccataagcagtggtttctggatcttccgctgccctggacctccggcgcatcaactagccaagagatttggaatcggcaggacttgctcgtgacattcaaaaccgctcacgccaagaagcaggaagtagttgtgctgggtagtcaagagggggctatgcacacagccttaactggcgcaaccgaaatacagacgtctggaaccacaactatctttgccggccatctgaaatgccgtctaaagatggataaactcaccctgaaggggatgtcctatgtcatgtgtacagggagcttcaaacttgagaaggaagtggctgagactcagcacggtaccgtcttggtgcagattaagtacgagggcacggacgcgccttgcaaaatcccattctcgacacaagatgaaaagggggttacccagaacggacgcctgataactgcaaatcccattgtgacagacaaagagaagcctgtaaacatcgaagccgagccaccctttggcgagtcttatatcgtcattggtgctggggaaaaagccctcaagctgtcctggttcaagaaaggctcaagtatcggaaagatgtttgaggcaaccgccagaggcgctaggcggatggccattcttggggatactgcatgggacttcggaagcataggtggcgtgtttacctccgttgggaaactggtgcatcagatcttcggaacagcgtacggcgtcttgttttctggtgtgagctggacgatgaagattgggatcggcgtactcctgacctggttaggactaaattcacgaagtacttccctaagcatgacatgtatcgctgtgggcctcgttaccctgtaccttggggtcatggtgcaggccgattctggatgcgtgattaactggaaaggccgcgaattgaagtgtggttcagggatattcgtcacaaatgaggttcacacttggaccgaacaatataagtttcaggcagacagtccgaaaagactgagcgccgctatcggaaaggcctgggaggagggcgtgtgcggtattaggtccgcaacgcggctcgaaaacatcatgtggaaacagatttctaacgagctgaatcatatcttactggaaaacgacatgaagttcacagtggtagtcggcgatgtggctgggatacttgcccagggcaaaaagatgatccgccctcaacccatggagcacaaatactcgtggaaaagctggggcaaggcgaaaattatcggggccgacgttcagaataccacttttattatcgatggaccaaacacccctgaatgtcccgacgatcagagagcttggaatatatgggaggtggaggactatggcttcggtatttttacaactaacatctggttgaagctcagggattcctacacccaggtctgcgaccaccgtctgatgtcagcagccattaaagatagtaaggctgtgcatgccgacatggggtattggatcgaatctgagaaaaatgaaacatggaagctagcacgggcgagcttcatagaggttaagacgtgtatctggccaaaatcccacaccctgtggtcaaacggagtgctcgaaagcgagatgattatccccaagatttacggcggtcctatctctcaacataattatcgaccaggctacttcactcagacagccgggccgtggcacctgggaaaacttgagttggattttgacctgtgcgaaggcaccactgtagtcgtggatgagcactgcgggaacagaggaccctccttaaggacaaccacggtgactggcaagataattcatgaatggtgttgccgcagttgtaccctccctccactgcggttcagaggtgaggacgggtgctggtacggaatggagatcaggcccgtcaaagaaaaggaggaaaatcttgttaagagcatggtgtctgctggctccggtgaggtagactcatttagtctgggcttgctctgtatcagcattatgatcgaagaggtgatgcgctcgcgatggtcccggaaaatgctgatgacagggaccctagccgtcttctttctgctcattatgggacagctgacttggaacgatcttatacgtttgtgcatcatggtgggcgcaaatgcttctgacagaatggggatgggaacaacctatctggccttaatggcaacattcaagatgaggcctatgtttgccgttggcctcctgttccgccggcttactagcagagaggtgctgctactcaccattggtctgtcattggtcgctagtgtggaactgccaaactccttagaggaactcggggatggactggcgatgggcatcatgattcttaaactgttgacggactttcaatctcaccagctctgggccacactgctaagcctgaccttcatcaagactaccttttcccttcattacgcatggaaaacaatggctatggttctctcaatagtgagcctgttccccttgtgtctgagtactacctctcagaagacgacatggttaccggtcctcctgggctcccttgggtgcaagcctctgaccatgtttttgatcgccgagaataaaatttggggaagaaagtcctggccactcaacgaaggtatcatggccgtaggcattgtgtcgatcctgctatcatctctgcttaaaaacgatgttcccctcgctgggcctctgatagcaggaggcatgttgattgcctgttatgtgatcagtggttccagcgcggacttatctctggagaaggctgccgaggtcagctgggaagaggaagcagagcactccggggcctcacataatatcctcgtggaagtacaggatgacggaactatgaaaattaaggatgaggagcgagacgatacactgaccatacttctgaaagctactttgctagcagtgagtggcgtctaccccctgagcatcccagccacactcttcgtttggtatttctggcaaaagaagaaacagcgctctggcgtgctgtgggacaccccttcacccccagaagtggagcgggcggtccttgatgacgggatttacagaatcatgcagaggggattactgggtcgtagccaggtgggcgttggggtatttcaagaaaacgtgttccacacgatgtggcacgtcactcgcggagctgtgctcatgtatcagggcaagcggttggagccgagttgggccagcgttaaaaaggacctgatttcctacggtgggggatggagactccagggctcttggaataccggcgaggaagtgcaggtcatcgcagtggagcctgggaaaaaccccaagaatgtacaaacagccccaggaacctttaagacacccgaaggtgaggtcggcgctatagccctggatttcaaacctgggacttcgggaagcccaatcgtgaacagggaaggcaagattgttggtctttacgggaatggagtggtcaccacgtcaggcacatatgtgtccgcaatcgctcaggccaaagcgagtcaggagggccccctgcctgagattgaagacgaggtttttcgaaagcggaacttgactatcatggatctacatccggggtctggaaaaacccgcagatacctgccagccatagtgagggaagcaattaagcggaagctccgaacattaatcctggctcccaccagagtcgtggccagcgagatggctgaagcacttaaaggtatgcctatccgctatcaaactaccgccgtaaagtccgagcacacaggcaaagagattgtggacctgatgtgccatgccacgttcactatgaggctcttgtcaccagttcgtgtccccaattacaacatgatcataatggatgaagctcactttaccgacccttctagcattgcggcacgggggtatatcagtacaagagtgggaatgggcgaggccgctgccattttcatgaccgcaactccgcccggttccgtggaagcctttccacagagcaatgctgtcatccaggatgaggaaagggacatacctgagcgctcttggaactcagggtacgagtggattacagatttccccggaaagaccgtatggtttgtgccatccatcaaaagtggcaatgacatcgcgaactgtctgcgaaagaatggcaagagagttattcagctcagccggaaaacgttcgatactgaatatcaaaagaccaaaaataacgactgggactacgtggtcaccaccgatatctcggagatgggggccaatttcagggcagaccgcgtgattgatcctcgtagatgcctgaagcccgttatacttaaagacggaccagaacgggtgatcctagctggtccgatgcctgtcactgtggcctctgcagcccagaggcgcggccgagtagggagaaaccataataaggagggagatcagtacatttatatgggccagcccctgaacaatgacgaggatcacgctcactggacagaagccaagatgttgttagacaacatcaataccccagagggtatcattcccgcgctgtttgaacctgagcgggaaaaatccgcagccatagatggggagtacaggctccgcggcgaggctagaaagacattcgtggaactgatgaggcggggagaccttccagtttggctgagctataaagtcgcctcagagggctttcaatacagtgatcgtcgctggtgcttcgacggggaacgaaacaatcaggtgctcgaggaaaacatggatgtggagatctggactaaggagggagaaaggaaaaagttgaggccccggtggctggacgctcgcacgtattctgaccctctagcactgagagagtttaaagagttcgccgctggtaggcggtccgtcagcggcgatctcattcttgagatcgggaagctgccgcagcatttaacccagcgagcccaaaatgcattggacaacctggttatgctccacaattcagaacagggaggcagagcgtaccgccatgccatggaggagctgccagatacaattgaaactcttatgctgctcgctttgatcgccgtgctgaccggtggggtaacattatttttcctaagtggcaggggactgggcaagaccagcatagggctcctttgtgtgatggcatcctctgtcctgttgtggatggctagcgtggagccccactggatcgccgcatccattatcctggaatttttcctcatggttctgcttattcctgagcccgaccggcagcgtactccacaggataaccaactcgcctatgtggtcatcggactgttgtttatgatactgacggtagctgcgaatgagatgggtttactagaaaccaccaaaaaggacctgggcattgggcacgtggccgttgagaaccatcaccatgcagctatgctcgatgtggaccttcaccctgcctcagcctggactctgtacgcagtcgctaccacaatcattacccccatgatgagacatactatcgaaaacacaacggccaatatatctttgaccgcgatcgctaaccaggccgcaattctgatgggactcgataaaggctggccaatcagtaagatggacattggtgtgcctctgcttgccttagggtgctactcgcaggtcaatccgctgactctcacagctgcagtgttgatgctggttgcccactatgcgatcataggccccggactacaagctaaagccaccagggaggcacagaagcgcaccgccgctggcattatgaagaacccaacagtggatgggatcgtagccatcgacctggatcctgtggtctacgacgcaaaattcgaaaagcagctcggacagattatgcttctgatcttgtgtactagccaaatactgctcatgcggacgacctgggctctgtgcgagtccattacattagccactggcccccttaccacactgtgggagggttctccagggaaattttggaataccactatcgcggtttcaatggccaacattttccgaggaagctatctcgcaggcgctggtctagccttctccctgatgaagagtttgggcgggggaagaaggggcacgggggcacagggagaaacactgggcgagaaatggaagcgccagctcaatcagctttctaagagcgaatttaacacctacaaacggtcaggtatcatggaggtggacagatccgaagctaaggaggggctgaaacgtggagagactaccaagcacgccgtcagtaggggcacagccaaattgcggtggttcgtggaacgcaatctggtaaagcctgagggtaaggtgatagatctcggctgtgggcgaggaggctggagctattactgcgcggggctaaagaaggttactgaagtgaaaggatataccaagggcggtcccgggcatgaggaaccgatcccaatggctacatacggatggaacctggtcaaacttcactctggcaaggacgtgtttttcattcctcccgagaaatgtgatacgctgctatgcgacatcggcgagtcctcaccaaatcccaccattgaagaggggagaactctcagggtcctgaagatggtggaaccttggttgcggggaaaccaattttgtatcaagattctgaatccgtacatgcccagcgttgtagagacactcgagcagatgcagcgcaaacatggtggcatgcttgtgagaaacccactgtcgagaaattctacccacgaaatgtattgggtcagttgcgggactggaaacatcgtgtccgcagttaatatgacaagccgaatgttactgaaccggttcaccatggcccaccgtaagcctacgtacgagagagatgtggacttgggcgctggtacccgccatgtcgccgtggaacccgaggtagcaaacctcgatataattgggcagaggatcgaaaatatcaaacacgagcataagtcaacatggcactatgacgaggataacccttacaaaacttgggcctatcatggatcctacgaagtgaagccatctggcagcgctagttccatggttaatggcgtcgtgaagctgctaaccaaaccctgggacgtgattcctatggtcacacaaatagcgatgactgataccacaccatttgggcagcagcgggttttcaaggagaaagtggacaccagaactcccaaggccaaacgcggaacgacacaaatcatggaagtaaccgcaaggtggctttggggttttctgagccgaaacaagaagccgcggatttgtactagagaggagttcaccaggaaagtgcgctctaatgctgccatcggcgcagtctttgtggacgagaaccagtggaactcagccaaggaggctgttgaagatgagcgtttctgggacctcgtgcaccgggaaagagagctgcacaaacaggggaagtgcgccacatgcgtctataacatgatgggaaaaagggaaaagaagttgggcgagtttggtaaagcgaaggggagtcgcgcaatttggtacatgtggctgggagcccgattcctcgagttcgaagctcttggctttatgaatgaggatcattggttctcccgggaaaacagcctgtctggcgtggagggggagggattacacaaactgggttacatcttgagagacatatcgaagatccctggcgggaatatgtatgccgatgacacggcaggatgggataccaggattactgaagacgatctccagaacgaggctaaaatcacagacattatggaaccagagcatgccctgctagctaaggccatctttaaacttacctaccaaaataaggtagttcgcgtgcagagacccgcaaagaacggcactgtcatggatgtgatatcacggagggaccagcgtggtagcggacaggtgggaacatatggcctgaataccttcacaaacatggaagcgcaactcattcgacagatggagtccgagggcatctttagtccttctgaactggagactccaaacttggccgaacgcgtcttagattggctggagaaatacggggttgaaagactcaagcggatggctatcagcggagacgactgtgtggtaaaacccattgatgacaggttcgccaccgcacttacggctctgaatgatatgggtaaggtgcgcaaagacataccgcagtgggagccttccaagggctggaacgattggcagcaagtccccttttgctcacaccacttccatcagctaatcatgaaggacgggagagagattgtggttccatgtcggaatcaggatgaactggtgggaagggcccgagtcagtcagggcgcaggttggtctctccgtgagaccgcctgcttggggaaaagctatgcgcaaatgtggcagctgatgtactttcacagacgcgaccttcggctggctgccaacgcaatctgttccgccgtgcctgtagattgggttcccacatcaaggactacctggagcattcatgctcaccatcagtggatgacaactgaagacatgctctctgtgtggaatagagtctggatcgaggaaaacccatggatggaggataagacccacatatccagttgggaggacgtgccctatttaggaaaacgcgaagaccaatggtgcggcagcctgatcggcttgacggcccgggcaacatgggctaccaatattcaggttgccatcaaccaggtgaggcgactgattgggaatgagaactacctcgattacatgacttcgatgaagagattcaaaaatgaatccgaccctgagggagcgctttggtga

SEQ ID NO: 14123 - RNA, 9879 nt, synthetic construct
  misc_feature 1..9879: note = derived and/or modified CDS sequence (opt3) from DENV-1__KP406803__SS-prME
  source 1..9879: mol_type = other RNA
tccgtgaccatgctgctcatgcttctgcccactgccttggctttccacttaactacgagaggaggggaacctcatatgatcgtatccaagcaggaaaggggaaaatctctgctatttaagacctcagccggtgttaatatgtgcaccctcattgccatggacctgggcgagctttgtgaagatactatgacctacaaatgcccacggataacagagaccgaaccggacgatgtggactgttggtgcaatgcgactgagacatgggtaacctatgggacgtgtagtcaaactggagagcaccgccgagataagcgtagcgtggctctggcaccccatgtcggcttgggtctcgaaaccagaacagagacttggatgtcctctgaaggggcatggaggcagatccagaaagtggagacctgggccctgcggcaccctggattcacagttattgctctgtttctcgcacatgccatcggcacctcgattacgcagaagggcatcatattcatcttactgatgcttgtgactccatcaatggctatgcgctgcgtcgggattggaaacagggactttgtggagggtttgagcggcgccacatgggtagatgttgtgctggaacacgggagttgtgtcaccactatggcgaaggacaaacccacactagatatcgagctcctgaagaccgaagtgacgaatcctgcagtgcttaggaaactgtgcattgaggccaagatctccaacaccacaactgactctcggtgtccaacccaaggagaagctacattggtcgaggagcaggatactaatttcgtttgccgccgaacctttgtggacagaggctggggtaacgggtgtggactcttcggcaaaggcagcctgataacatgcgccaagtttaagtgcgtaaccaaattagaagggaagattgtgcagtacgagaatctgaaatattccgtcatcgtgactgttcacacgggagatcagcatcaagtgggtaacgaaacaaccgagcacggcactaccgcaacaattacaccccaggctcctacttcagaaatccagctcacagactacggggcccttacgctggactgtagtccaaggaccggattggatttcaatgagatggtcctactgactatgaaggagaaaagctggctcgtgcataagcagtggtttctggaccttccgctgccctggacatctggcgcgtccacctcacaagaaacatggaaccggcaggatttgctcgtaactttcaaaaccgcccacgcaaagaagcaggaggttgtggtcctgggtagccaagaaggggctatgcacacggccttaaccggcgctacagagatccagacaagtggaaccacaactatttttgccggccatctgaaatgccgtctaaagatggacaaactcaccctgaagggggtgtcttatgtcatgtgtacgggatccttcaaacttgaaaaggaggtggcagagacacagcacggtaccgttttggtgcaggtaaagtacgaaggcactgatgccccttgcaaaataccattcagctcgcaagacgagaagggggtcacacagaatggacgcctgatcaccgctaaccccattgtgactgataaagaaaagcctgttaatatcgaggcggagccaccctttggcgaatcttatctcgtggtcggtgcaggggagaaagccctgaaactttcctggttcaagaaaggctcaagtataggaaagatgtttgaagctaccgccagaggcgcaaggcggatggccattctgggggacacagcttgggatttcggaagcatcggtggcgtgtttacgtccgtagggaaattgatccatcagattttcggaaccgcctacggcgtgctcttttctggtgttagctggactatgaagatcgggattggcatactgttaacatggctgggactaaactcacgaagtacctccctcagcatgacatgtatcgcagtcggcatggtgactctgtaccttggggtgatggtccaggcggactctggatgcgttattaattggaaaggccgcgagttgaagtgtggttcagggatcttcgtgaccaacgaagtgcacacgtggacagagcaatataagtttcaggctgatagtccgaaaagactgagcgccgcaatcggaaaggcctgggaggaaggcgtatgcggtattaggtccgctacccggctcgagaacataatgtggaaacagatctctaatgaactgaaccatattttactggagaatgacatgaagttcactgtcgtggttggcgacgtgaacgggatccttgcccagggcaagaagatgattcgccctcaacccatggaacacaaatactcgtggaaaagctggggcaaggcaaaggtcatcggggctgatgtgcagaatataacctttatcattgacggaccaaacacacctgagtgtcccgatgaccagagagcctggaatatctgggaggttgaagattatggcttcggtatttttactaccaacatctggttgaagctcagggactcctacacacaggtgtgcgatcaccgtctgatgtcagcggccataaaagacagtaaggctgtacatgcagatatggggtattggattgagtctgagaagaatgagacgtggaagctaacccgggccagcttcatcgaagtcaagacttgtgtgtggccaaaatcccacacactgtggtcaaacggagtgctcgagagcgagatgattatccccaagatatacggcggtcctatctctcaacataattatcgaccaggctacttcacccagactgctgggccgtggcacctgggaaaacttgaattggactttggcctgtgcgaggggacaaccgtcgttgtggatgaacactgcggaaacagaggcccctccttaaggacgactaccgtaacaggtaagattatccatgagtggtgttgccgcagttgtaccctccctccactgcggttcaaaggggaggacggatgctggtacggcatggaaattagacccgtgaaggagaaggaagagaatcttgtcaaaagcatggtgtctgccggttccggcgaagttgattcatttagtctggggttgctctgtatcagcataatgattgaggaggtgatgaggtcgcgctggtcccgaaagatgctgatgactggaacactagcagtcttcctgctcctgatcatgggccagcttacctggaacgacttgatccggctgtgcattatggtgggggcgaatgcctctgacaaaatgggaatgggcacaacttatttagctctcatggccacctttcgtatgagacctatgttcgcagttggtctgctttttaggcgcctgacgagccgggaagtgctactcctgacagtcgggttgtcactggtagctagtgtggagttaccaaactccctcgaagaactgggagatggccttgccatgggcatcatgatgctgaagttgctcaccgacttccaatctcaccagctgtgggcagccctactgagccttacttttgttaaaaccacattctccctccattacgcttggaagactatggcgatgattctgtcaatagtgagcttgtttcccctgtgtttaagtaccacgtctcagaagacaacctggctcccggtcctgcttgggtccctgggatgcaaacctttgactatgttcctcatcacagaaaacaagatttggggtagaaaaagctggccactgaatgagggcatcatggccgtggggattgtatcgatcctactgtcatctcttctcaagaacgatgtgcccctggcaggacctttgatagctggcggtatgttaatcgcctgttatgtcattagtgggtccagcgccgacctgtctctcgagaaagctgcagaagttagctgggaggaagaggccgaacactccggagcgtcacataatatcctggtggaggtgcaggatgacggcaccatgaagattaaagatgaggaaagggacgatactcttacaatcctgttgaaggctaccctactggccataagtggcgtctaccccatgagcattccagcaacgctctttgtgtggtatttctggcaaaagaaaaagcagcgatctggggttctgtgggacactccttcacccccagaggtagaacgcgccgtgcttgatgacggaatctaccggatcttacagagaggtctgctcggcaaaagccaggtcggggtgggagttttccaagagggcgtgtttcacaccatgtggcacgtcacaaggggtgctgtgttgatgtatcaggggaagcgtctggagccgagttgggcaagcgtcaaaaaggatctcatttcctacggaggcggctggcgcttccaggggtcttggaacaccggagaagaggtccaggtgatagccgttgaacctggtaagaatcccaaaaacgtgcaaacagcgccaggcacttttaagacccccgagggggaagtcggagctatcgccctggacttcaaacctggcacgtcgggtagcccaattgtgaatcgggaggggaagatcgttggactttacggcaacggcgtggtcacaacttcagggacctatgtgtccgcaattgcccaggctaaagccagtcaggagggacccctgcctgaaatcgaggacgaagtatttagaaagaggaatttgacaataatggatctacatccgggttctggcaagacccgacggtacctgccagcaatcgtgcgcgaggctattaaaagaaagctcaggactttagttctggcccccacccgggtcgtggcgagcgaaatggccgaggcacttaaagggatccctattcgatatcaaacaacggctgtgaagtccgagcacactggaaaagaaatcgtcgacctgatgtgccatgccaccttcacaatgagactcttgtcaccagtacgcgtgcccaactacaatatgataattatggatgaggctcactttaccgaccctgcatctatcgccgccaggggctatatcagcactcgtgttggtatgggggaagctgcggcaattttcatgacagccaccccgcccggaagtatggaggcttttccacagtccaacgccgcaatccaggatgaagaacgggacatacctgagagaagctggaactctggctacgattggattacggacttccccggcaagactgtgtggtttgtcccatcaatcaagtccgggaacgatattgccaattgtctgaggaaaaacggaaagcgcgtggttcagctcagtcgaaaaacattcgacaccgaatatcaaaagaccaaaaacaatgattgggactacgtggtcactacagacatcagcgagatgggtgctaacttcagagcggatcgggtgatagaccctaggcgctgcctgaagcccgtaattcttaaggatggcccagaacgtgtgatcctagccgggccgatgcctgttaccgtcgcatcggctgcccagagacggggaaggatcggccgcaatcagaacaaagagggtgaccagtacatttatatggggcaacccctgaataacgatgaggaccatgcacactggacagaagccaagatgttgttagataatatcaacactccagagggcattatacccgctctgtttgaacctgagcgagaaaaatctgccgcgatcgacggagagtacagactccggggcgaggcaaggaagacgttcgtggaactgatgcgcagaggggatcttccagtgtggctgtcctataaagtcgccagcgagggatttcagtactcagacaggcggtggtgcttcgatggtgaacgtaataaccaggttctcgaggaaaatatggacgtggagatttggaccaaggagggcgaacgcaaaaagttgcgacccagatggctggatgctaggacatatagtgaccctctagccctgcgggagtttaaggagttcgctgcagggcgcagatctgtatccggagacctcatccttgagatcggcaaactgccgcagcacttaactcaaagggcccagaacgctttggataatctggtgatgctccataacagcgaacagggtgggaaggcctaccggcacgcaatggaggagctgccagacaccattgaaacacttatgctgctcgcgttgatagccgtcctgaccggcggagtgactttatttttcctatcaggccgagggctgggaaaaacgagtatcggtctcctttgtgttatggctagctccgccctgttgtggatggcatctgtggagccccattggattgctgccagcatcattctggaatttttcctcatggtcctgcttatccctgagcccgatagacagcgcaccccacaagacaatcagctcgcatatgtagtgataggcctgttgtttatgatcctgacagttgccgctaacgagatggggttactagaaactaccaagaaagatctgggaattggccacgtggcggccgagtcccaccatcacgcagctatgctcgacgtcgatcttcatcctgcctcagcctggacactgtacgcagtggctaccactatcattacacccatgatgaggcacacgatcgaaaacaccactgccaatatatctttgacagcgattgctaaccaggccgcaatcctgatgggtctcgacaaggggtggccaattagtaagatggatatcggcgtccctctgcttgccttaggatgctactcgcaagtgaatccgctgaccctcaccgctgcagttttgatgctggtggcccattatgcgataatcggccccgggctacaggctaaagccacacgggaggcacagaagcgtactgccgctggaattatgaaaaacccaacggtagacggcatcgtggccattgatctggaccctgtcgtttacgatgcaaagttcgaaaaacagctcggtcaaatcatgcttctgatattgtgtaccagccagattctgctcatgagaacaacttgggctctgtgcgagtccatcaccttagccacagggccccttaccactctgtgggagggatctccaggcaagttttggaatacgacaatcgcggtgtcaatggccaacattttcaggggtagctatctcgcaggcgctgggctagccttctccctgatgaagagtttgggaggcgggcgccggggaaccggcgcacagggtgaaactctgggggagaaatggaagcgacagctcaatcaactttctaaaagcgaatttaacacctacaagagatcaggaatcatagaggtcgacaggtccgaagctaaagagggcctgaagcgcggtgagacaactaagcacgccgtgagtcggggcaccgccaaattgagatggttcgtagaacgtaatctggtgaagcctgaggggaaagttattgacctcggatgtggcagagggggatggagctattactgcgcgggcttaaagaaagtgacagaagtcaagggttatacgaaagggggacccggccacgaggaaccgatcccaatggctacctacggctggaacctggtgaaactttactctgggaaggatgtctttttcactcctcccgagaaatgtgacacactgctatgcgatattggagagtcctcaccaaatcccaccatcgaagagggtcggactctccgcgtgctgcgaatggttgaaccttggttgagaggcaaccagttttgtataaaggtactgaatccgtatatgcccagcgtggtcgagacactcgagcagatgcagaggaaacatgggggaatgcttgtgcggaacccactgtcgcgcaattctacccacgaaatgtactgggttagttgcggcacgggtaacatcgtgtccgcagtcaatatgaccagcagaatgttactgaacaggttcacaatggcccatcgaaagcctacttatgagcgggacgtggatttgggggctggaacccgtcacgtagccgtggaacccgaggttgcaaacctcgacattatcggccaaagaattgaaaatatcaaaaacgagcacaagtcaacatggcattacgatgaggacaatccttataagacttgggcctaccacggctcctatgaagtcaaaccatctgggagcgctagttccatggtgaacggagtggtccgcctgctaaccaagccctgggatgttattcctatggtgacacagatcgcgatgaccgacactacgccatttggtcagcaaagggtattcaaagagaaggtggatacacggacccccaaagccaagagaggcactgcacagataatggaagtcaccgctcgctggctttgggggtttctgagcaggaataagaaaccgcgaatttgtacacgggaggagttcacgagaaaggtgaggtctaacgccgcaatcggagccgtttttgtggacgagaatcagtggaactcagctaaagaggccgtcgaagacgagcgcttctgggatctcgtgcatcgtgaacgggagctgcacaagcagggcaaatgcgcgacctgcgtatacaatatgatgggtaagagagaaaagaaattgggggagtttggaaaggcaaaaggcagtagggccatctggtacatgtggctgggcgctcgcttcctcgagttcgaagcccttgggtttatgaacgaggaccattggttctcccgagaaaatagcctgtctggagttgagggtgagggcttacacaagctggggtatattttgcgggatatatcgaaaatccctggaggcaacatgtacgcagacgatactgctggttgggacacaagaattaccgaagatgacctccaaaatgaggccaagatcactgatattatggaaccagagcacgctctgctagccacatcaatctttaaacttacctatcagaacaaggtggtcagggtgcagcgccccgcaaagaatgggacagtgatggacgtcataagcagacgggatcagaggggatccggccaagttggcacttacgggctgaacaccttcacgaacatggaagcgcagctcatccgtcagatggagagtgagggaatttttctgccttctgaattggagaccccaaatttagccgaacgagtgctggactggctcgagaaatatggtatcgaacgccttaagagaatggctattagcggcgatgactgtgtagtgaaacccatcgacgatcggttcgccacagcactgactgctctaaacgacatggggaaggtcaggaaagatataccgcagtgggagccttccaagggatggaatgactggcaacaggtgcccttttgctcacatcacttccatcagctgattatgaaggatggccgcgagatcgttgtgccatgtagaaaccaggacgaactcgtcggtcgggccagggtgagtcaaggggcaggatggtctttgcgagagaccgcctgcctgggcaaaagctacgcgcagatgtggcagcttatgtattttcaccgtagagatctgcgcctcgctgccaatgcaatctgttccgccgtacctgttgactgggtgcccacatcacggactacctggagcattcacgctcatcaccaatggatgacgacagaagatatgttatctgtctggaacagggtgtggatagaggaaaatccatggatggaggacaagacccatgtttccagttgggaggatgtgccctacctgggcaaaagagaagaccagtggtgcgggagcttgatcggactgactgcccgcgcaacatgggctaccaacattcaggtcgccatcaatcaggtgcggaggctcattggtaacgagaattaccttgactatatgacttcgatgaagcgattcaaaaacgaatccgatcctgagggcgcgctgtggtga

SEQ ID NO: 14124 - RNA, 9879 nt, synthetic construct
  misc_feature 1..9879: note = derived and/or modified CDS sequence (opt3) from DENV-1__KJ438293__SS-prME
  source 1..9879: mol_type = other RNA
agcgtgaccatgctgctaatgcttatgcccacagcactggctttccacttgactacgaggggaggggagcctcatatgatcgtctccaagcaggaaaggggaaaatctttactgtttaagacctcagccggtgttaacatgtgcacacttattgccatggacctcggagagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactgctcaagacagaggtgaccaaccctgccattctgaggaaactttgcatcgaagctaagatatctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcatgacttgcgctaagtttaagtgcgtgaccaaactggaggggaagattgtacagtacgaaaacttaaaatattcagtgatcgtcacagtgcacaccggagaccagcatcaagttggtaatgagagtactgaacacggcacgacagccaccattactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagatctcctggttcaagaaaggctcaagtattggaaagatgtttgaggcaactgccagaggcgctaggcggatggccatcctcggggataccgcatgggacttcggaagcattggtggcgtgtttacatccgttgggaaactggtgcatcagatattcggaacggcgtacggcgtcctattttctggtgtgagctggaccatgaagatcgggattggcgtactgttgacttggctcggactaaattcacgaagtacatccttaagcatgacctgtatcgctgtgggcctggttacactatacctcggggtcatggtgcaggccgattctggatgcgtgatcaactggaaaggccgcgaactgaagtgtggttcagggattttcgtcactaatgaggttcacacctggacggaacaatataagtttcaggcagacagtccgaaaagacttagcgccgctataggaaaggcctgggaggagggcgtgtgcggtatcaggtccgcaacacggttggaaaacattatgtggaaacagatctctaacgagctgaatcatattctcctggaaaacgacatgaagttcaccgtggtagtcggcgatgtggctgggatcttagcccagggcaagaagatgatacgccctcaacccatggagtacaaatattcgtggaaaagctggggcaaggcgaagatcattggggccgacgttcagaatactacctttatcattgatggaccaaacacacctgaatgtcccgacgatcagagagcttggaatatctgggaggtggaggactacggcttcggtatatttactaccaacatttggctgaaacttagggattcctatacacaggtctgcgaccaccgtttgatgtcagcagccatcaaagatagtaaggctgtgcacgccgacatggggtactggattgaatctgagaaaaatgaaacgtggaagctcgcacgggcgagcttcatcgaggttaagacctgtatatggccaaaatcccatactctgtggtcaaacggagtgctagaaagcgagatgatcattcccaagatctatggcggtcctatttctcaacacaattaccgaccaggctacttcacacagaccgccgggccgtggcatctgggaaaactcgagctggattttgacctttgcgaaggcactacagtagtcgtggatgagcactgcgggaacagaggaccctccttgaggaccacgactgtgaccggcaagatcatacacgaatggtgttgccgcagttgtacactgcctccattacggttcagaggtgaggacgggtgctggtatggaatggagattaggcccgtcaaagaaaaggaggaaaatctcgttaagagcatggtgtctgctggctccggtgaggtagactcatttagtctgggccttctgtgtatcagcatcatgattgaagaggtgatgcgctcgcgatggtcccggaaaatgttgatgaccgggactctcgccgtcttctttctgctaatcatgggacagctgacatggaacgatctcattcgtctgtgcataatggtgggcgcaaatgcttctgacagaatggggatgggaaccacataccttgccttgatggcaactttcaagatgaggcctatgtttgccgttggcctgttattccgccggctcaccagcagagaggtgctgcttctgacgatcggtctatcactcgtcgctagtgtggaactgccaaactccttggaggaactgggggatggattagcgatgggcattatgatcctcaaactgcttacaggctttcaatctcatcagctgtgggccaccttgctcagcctgactttcattaagaccacattttccctacactatgcatggaaaactatggctatggttctgtcaatcgtgagccttttccccctctgtctgagtaccacgtctcagaagacaacctggttgccggtcctgttagggtccctcggatgcaagcctctgactatgtttcttataacagagaataaaatctggggtagaaagtcctggccactgaacgaaggcattatggccgtagggatcgtgtcgattttgctctcatctctgctcaaaaatgacgttcccctggccggacctcttatcgctggcggtatgctcatagcatgttacgtgattagtgggtccagcgccgatctgtctttggagaaggcggctgaggtcagctgggaagaggaagccgagcattccggagcatcacacaatatcttagtggaagtacaggacgatggcaccatgaaaatcaaggacgaggagcgagatgacactctgacaattctcctgaaagccacccttctggctgtgagtggcgtctatcccttgagcataccagcaacgctattcgtttggtacttctggcaaaagaagaaacagcgctctggggtgctgtgggatactccttcacccccagaagtggagcgggccgtcctcgacgatggaatctatagaattatgcagaggggtctgcttggccgtagccaggtgggggttggagtatttcaagaaaacgtgttccataccatgtggcacgtcacacgcggcgcggtgttaatgtaccagggtaagcggctggagccgagttgggctagcgttaaaaaggacctcatctcctacgggggaggctggagattgcagggctcttggaataccggggaggaagtgcaggtcattgccgtggagcctggcaaaaaccccaagaatgtacaaacagcaccaggtacttttaagacccccgaaggcgaggtcggggccatcgctctggacttcaaacctggaacgtcgggcagcccaatagtgaacagggaaggtaagatcgttgggctctatggaaatggcgtggtcacaacttcaggcacctacgtgtccgccattgcacaggctaaagccagtcaggaggggcccctgcctgagatcgaagatgaggtttttcgaaagcggaaccttacaattatggacctgcacccgggatctggtaaaacccgcagatatttgccagcgatcgtgagggaagccataaagcggaagctacgaactctgattctcgcacccaccagagtcgtggctagcgagatggccgaggctttaaaaggcatgcctatccgctaccaaacaacggcagtaaagtccgagcatactgggaaagagatcgtggatctgatgtgccacgccaccttcacaatgaggcttctgtcaccagttcgtgtccccaattataacatgattatcatggacgaagcccattttaccgatccttctagcatagctgcgcggggatacattagtactagagtgggcatgggtgaggcagccgctatcttcatgacagccaccccgcccgggtccgtggaagcatttccacagagcaatgccgtcattcaggacgaggaaagggatatccctgagcgctcttggaactcaggatatgactggataacggatttccccggcaagactgtatggtttgtgccatccattaaaagtggcaatgacatcgctaactgtctccgaaagaatgggaagagagttatccagttgagccggaaaacattcgataccgagtaccaaaagaccaaaaacaacgactgggactacgtggtcactacagatatttcggaaatgggagcgaatttcagggccgaccgcgtgatcgatcctcgtagatgcctgaagcccgttattctcaaagacggtccagagcgggtggtcctggcaggcccgatgcctgtgaccgtagcttctgccgcacagaggcgcgggcgaataggaagaaaccacaataaggaaggcgatcagtatatctacatgggtcagccccttaacaatgacgaggatcatgcccactggacagaggctaagatgctactggacaacattaatactccagaagggatcatccccgccttgtttgagcctgaacgggagaaatccgcggcaattgatggcgaatataggttacgcggagaggccagaaagacgttcgtggagctgatgaggcggggcgacctcccagtttggctgagctacaaagtcgcttcagaagggtttcaatatagtgatcgtcgctggtgcttcgacggagagcgaaacaatcaggtgcttgaagagaacatggatgtggaaatatggaccaaggagggtgagaggaaaaagctgaggccccggtggctcgacgcccgcacatactctgaccctttggctctgagagaatttaaagagttcgcagccggcaggcggtccgtcagcggggatctaatcctggaaattggaaagctcccgcagcaccttactcagcgagctcaaaatgccctggacaacttagttatgttgcataattcagagcagggcggtagagcatatcgccacgcgatggaggaactgccagataccatcgagacactcatgctgcttgccctgattgctgtgctcaccgggggcgtaactttgtttttcctgagtggaaggggcttagggaagacgagcatcggactactgtgtgtgatggcctcctctgtcctcctttggatagcaagcgtggaaccccattggatcgctgcctccattatcctggagtttttcttgatggttctgctcattcctgaacccgaccggcagcgtaccccacaggataaccaactggcatacgtggtcatcggtcttctctttatgatactgacagtagccgctaatgagatgggcttgctggagactaccaaaaaggacttagggattggacacgtggcggttgaaaaccaccatcacgccgcaatcctagatgtggacctgcatcctgcttcagcctggacactctacgccgtcgcaaccactattatcacacccatgatgagacacacgatagagaacaccactgctaatatctctcttacagccattgcgaaccaggctgccatcctgatgggcttggataaaggttggccaattagtaagatggacatcggggtgcctctgctcgcactgggctgctattcgcaggtcaatccgcttaccttaaccgccgctgtgctgatgctcgttgcacattacgccataattggacccggcttgcaagcgaaagctacaagggaagcccagaagcgcactgcagccgggatcatgaagaacccaacggtggatggaatcgtagctattgacctggatcctgtggtctatgacgccaaattcgagaagcagctaggccagatcatgctgctcatactttgtaccagccaaattctgttgatgcggacaacttgggcactgtgcgaatccatcaccctcgctacaggtcccctgaccactttatgggaggggtctccaggaaaattttggaatacgacaattgccgtttcaatggcgaacatcttccgaggcagctaccttgccggtgcaggcctggctttctccctcatgaagagtctagggggaggcagaagggggaccggagcccagggcgagactctgggtgaaaaatggaagcgccagttgaatcagctgtctaagagcgagtttaacacctataaacggtcagggataatggaagtggacagatccgaggcaaaggaaggactcaaacgtggcgagacaactaagcacgctgtcagtaggggtaccgccaaacttcggtggttcgtggagcgcaatctggtaaagcctgaaggcaaggtgatcgatttggggtgtggacgaggcgggtggagctactattgcgccggactgaaaaaggttacagaggtgaaaggctacacgaagggtgggcccggacacgaggaaccgattccaatggcgacctacggctggaacctcgtcaaattatattctggcaaggacgtgtttttcatccctcccgaaaaatgtgatactctgctttgcgacattggggagtcctcaccaaatcccacaatcgaggaaggaagaaccctgagggtcctaaagatggtggagccttggctccggggtaaccaattttgtattaagatcctgaatccgtacatgcccagcgttgtagaaactttggagcagatgcagcgcaaacatggcgggatgctggtgagaaacccactctcgagaaattctacacacgagatgtattggataagttgcggaaccggcaacattgtctccgctgtgaatatgacgagccgaatgcttctgaaccggttcaccatggcacatcgtaagcctacatacgaaagagatgttgacttaggtgccgggactcgccacgtggctgtcgagcccgaagtggccaacctggatatcatcggacagaggattgagaatataaaacacgaacataagtcaacctggcactatgacgaggataacccttacaaaacatgggcatatcatggctcctacgaggtaaagccatctggcagcgccagttccatggtgaatggggttgtcaagttgctcactaaaccctgggacgtgatccctatggtgacccaaattgctatgacagataccactccatttggacagcagcgggtcttcaaggaaaaagttgacacgagaacacccaaggcgaaacgcggtaccgcccaaatcatggaggtgactgcaaggtggctgtggggctttctaagccgaaacaagaagccgcggatttgtaccagagaagagttcacaaggaaagtacgctctaatgctgccatcggggcagtgtttgtcgacgaaaaccagtggaactcagccaaggaggctgtggaggatgaacgtttctgggaccttgttcaccgggagagagaactgcataaacagggaaagtgcgccacgtgcgtgtacaacatgatgggcaaaagggagaagaagctcggtgaatttgggaaagcgaagggaagtcgcgcaatatggtatatgtggctgggcgcccgattcttggagttcgaggctctgggctttatgaatgaagatcactggttctcccgggagaacagcctctctggggtcgaaggagagggtcttcacaaactgggctacatcttaagagacatttcgaagatccctgggggaaatatgtatgccgatgacaccgcaggctgggatactaggattacagaggacgatctgcagaacgaagctaaaatcaccgacataatggagccagaacatgccttgctcgctaaggccatttttaaactgacttaccaaaataaggtggtacgcgttcagagacccgcaaagaacggtacagtgatggatgtcatctcacggagggaccagcgtgggagcggacaggtgggcacctatggcctaaatacattcactaacatggaggcgcaacttatccgacagatggaatccgaggggatttttagtccttctgagctggaaaccccaaacctcgccgagcgcgtgctggattggttggaaaaatacggagtcgagagattaaagcggatggctataagcggtgacgactgtgttgtgaaacccatcgatgacaggttcgccacggcactgaccgctctcaatgatatgggcaaggtacgcaaagacattccgcagtgggaaccttccaaggggtggaacgattggcagcaagtgcccttttgctcacaccatttccaccagcttatcatgaaggacggaagagagattgtcgtgccatgtcggaatcaggatgagctggttggcagggcccgagtgagtcagggtgcagggtggtctctacgtgaaacagcctgcctgggaaaaagctatgcgcaaatgtggcagctcatgtactttcacagacgcgacttgcggctggctgccaacgcaatctgttccgccgtccctgtggattgggtacccacttcaaggaccacatggagcatacatgctcaccatcagtggatgactaccgaggacatgctttctgtttggaatagagtgtggatcgaagagaacccatggatggaagataagacgcacatttccagttgggaggacgtcccctacctgggcaaacgcgaggaccaatggtgcggcagcctcatcgggttaacagcccgggcaacctgggctactaatattcaggtggccatcaaccaggttaggcgactgattggaaatgaaaactatttggattacatgacatcgatgaagagattcaaaaatgagtccgaccctgaaggtgcgctgtggtga

SEQ ID NO: 14125 - RNA, 9879 nt, synthetic construct
  misc_feature 1..9879: note = derived and/or modified CDS sequence (opt3) from DENV-1__KJ438296__SS-prME
  source 1..9879: mol_type = other RNA
agcgtgacaatgctgctcatgcttatgcccacagcactggctttccacttgactacgagaggaggggaacctcatatgatggtctccaagcaggaaaggggaaaatctttactgtttaagacatcagccggtgttaacatgtgcacactaatcgccatggacctcggcgaactgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatacagagggtggaaacttgggctctccggcaccctggattcaccgttatcgcactgtttctggcccatgctattggcacatcgatcacccagaagggcattatcttcatactcttaatgctggtgacgccatcaatggccatgcgctgcgtcgggatcggaagcagagattttgtggagggtcttagtggcgcgacttgggtagacgttgtgttggagcacgggtcctgtgtcacaaccatggcaaaggataaacccactctggacattgaactactcaagacagaggtgaccaaccctgccgtgctgaggaaactttgcatcgaagctaagatttctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcatcacttgcgctaagtttaagtgcgtaaccaaactggaggggaagatagtgcagtacgaaaacttaaaatattcagtcattgtgacagttcacaccggagaccagcatcaagtgggtaatgagagtactgaacacggcacgacagccaccatcactccccaggcgcctaccacagagattcagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatctttgccggccatttaaaatgccgtctgaagatggataaactaacactcaaggggatgtcctatgtgatgtgtactggatcgttcaaactggagaaggaagtcgctgagacccagcacggtacggtgcttgttcagattaagtacgagggcacagacgcgccttgcaaaataccattctcgacccaagatgaaaagggggtgactcagaacggacgcttgatcacagcaaatcccattgtaaccgacaaagagaagcctgtcaacatcgaagccgagccaccctttggcgagtcttatatagtgattggtgctggggaaaaagccctgaagctctcctggttcaagaaaggctcaagtatcggaaagatgtttgaggcaactgccagaggcgctaggcggatggccatcctgggggataccgcatgggacttcggaagcattggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgctgggatcctggcccagggcaagaagatgattcgccctcaacccatggagtacaaatattcgtggaaaagctggggcaaggcgaagatcataggggccgacgtgcagaatactacctttatcattgatggaccaaacacacctgaatgtcccgacgatcagagagcttggaatatctgggaggtcgaggactacggcttcggtatttttactaccaacatctggcttaagttgagggattcctatacacaggtgtgcgaccaccgtctcatgtcagcagccataaaagatagtaaggctgttcacgccgacatggggtactggattgaatctgagaaaaatgaaacgtggaagctggcacgggcgagcttcatcgaggtgaagacctgtatttggccaaaatcccatactctatggtcaaacggagtactggaaagcgagatgatcatacccaagatctatggcggtcctatttctcaacacaattaccgaccaggctacttcacacagaccgccgggccgtggcatctcggaaaactggagcttgattttgacttgtgcgaaggcactacagtcgtggtggatgagcactgcgggaacagaggaccctccctgaggaccacgactgtcaccggcaagatcattcacgaatggtgttgccgcagttgtacattacctccactccggttcagaggtgaggacgggtgctggtatggaatggagatcaggcccgttaaagaaaaggaggaaaatctggtgaagtccatggtatctgctggctccggtgaggtggactcatttagtcttggcctgttgtgtataagcattatgatcgaagaggtcatgcgctcgcgatggtcccggaaaatgctcatgatcgggaccctggccgtgttctttctactgattatgggacagctcacttggaacgatctgatccgtctttgcattatggttggcgcaaatgcttctgacagaatggggatgggaacaacctacttggccctgatggcaacattcaagatgaggcctatgtttgccgtgggcttactcttccgccggctgactagcagagaggtccttctgctaaccataggtctctcactggtggctagtgcggaattgccaaactccctggaggaattaggggatggactcgccatgggcatcatgattctgaaacttctgacggactttcaatctcatcagttgtgggcaacactcctgagcctaaccttcatcaagactaccttttccctgcactatgcttggaaaacaatggccatggttctttcaattgtgagcctcatccccctgtgtttgagtactacctctcagaagacgacatggctgccggtcttactcggctccctggggtgcaagcctcttaccatgttcctgatagccgagaataaaatctggggaagaaagagctggccattgaacgaaggtattatggctgtaggcatcgtgtcgattctcctgtcatctctactgaaaaacgatgttccccttgcagggcctctcatcgccggaggcatgctgatagcgtgttacgtgattagtggttccagcgctgacttgtctttagagaaggccgcagaggtcagctgggaagaggaagccgagcattccggggcttcacacaatatcctggtggaagtacaggatgacggaactatgaaaatcaaggatgaggagcgagacgatacactcaccattctgcttaaagcaactctgttggccgtgagtggcgtctttcccctaagcataccagcgacactgttcgtttggtatttctggcaaaagaagaaacagcgctctggcgtgctctgggacaccccttcacccccagaagtggagcgggctgtcctggatgacgggatctacagaattatgcagaggggacttttaggtcgtagccaggtgggcgttggggtatttcaagaaaacgtgttccatacgatgtggcacgtcactcgcggagccgtgctgatgtatcagggcaagcggctcgagccgagttgggcaagcgttaaaaaggacttgatctcctacggtgggggatggagactgcagggctcttggaataccggcgaggaagtgcaggtcattgccgtggagcctgggaaaaaccccaagaatgtacaaacagctccaggaacctttaagacacccgaaggtgaggtcggcgccatcgcactcgatttcaaacctgggacttcgggaagcccaatagtgaacagggaaggcaagatcgttggtctgtacgggaatggagtggtcaccacgtcaggcacatatgtgtccgctattgcccaggcgaaagccagtcaggagggcccccttcctgagatcgaagacgaggtttttcgaaagcggaacctgactattatggatttgcacccggggtctggaaaaacccgcagatacctaccagcaatcgtgagggaagctataaagcggaagctgcgaacactcattttagcccccaccagagtcgtggctagcgagatggcagaagccctgaaaggtatgcctatccgctatcaaactaccgccgtaaagtccgagcatacaggcaaagagatcgtggaccttatgtgccacgctacgttcactatgaggctgctctcaccagttcgtgtccccaattacaacatgattatcatggatgaagcgcattttaccgacccttctagcatagcagcccgggggtatattagtacaagagtgggaatgggcgaggctgccgcaatcttcatgaccgccactccgcccggttccgtggaggcttttccacagagcaatgcggtcattcaggatgaggaaagggacatccctgagcgctcttggaactcagggtacgagtggataacagatttccccggaaagaccgtatggtttgtgccatccattaaaagtggcaatgacatcgccaactgtttgcgaaagaatggcaagagagttatccagctgagccggaaaacgttcgatactgaatatcaaaagaccaaaaataacgactgggactacgtggtcaccaccgatatttcggagatgggggcaaatttcagggctgaccgcgtgatcgatcctcgtagatgcctcaagcccgttattctgaaagacggaccagaacgggtgatacttgccggtccgatgcctgtcactgtggcatctgccgctcagaggcgcggccgaatcgggagaaaccacaataaggagggagatcagtacatttatatgggccagcccctaaacaatgacgaggatcatgcccactggacagaagcgaagatgctgttggacaacatcaataccccagagggtatcattcccgcattatttgaacctgagcgggaaaaatccgccgctatagatggggagtacaggctgcgcggcgaggccagaaagacattcgtagaactcatgaggcggggagacctgccagtgtggcttagctataaagttgcttcagagggctttcaatacagtgatcgtcgctggtgcttcgacggggaacgaaacaatcaggtcctggaggaaaacatggatgtggagatctggactaaggagggagaaaggaaaaagctcaggccccggtggttggacgcacgcacgtattctgaccctctggccctaagagagtttaaagagttcgctgccggtaggcggtccgtgagcggcgatctgattctcgagatcgggaaacttccgcagcacctgacccagcgagcacaaaatgcgttagacaacttggtcatgctgcataattcagaacagggaggcagagcctaccgccacgctatggaggagctcccagatacaattgaaactctgatgcttctggccctcatcgcagttttgaccggtggggtgacactgtttttcttaagtggcaggggactaggcaagaccagcatagggctgctctgtgtaatggcttcctctgtgcttctgtggatggccagcgtcgagccccattggatcgcagcctccattatcttggaatttttcctgatggtgctcctgattcctgagcccgaccggcagcgtactccacaggataaccaacttgcttatgttgtgatcggactcctgtttatgatattgacggtcgcggccaatgagatgggtctgttagaaaccaccaaaaaggacctaggcattgggcacgtagcagtggagaaccaccatcacgctgccatgctggatgttgacctccatcctgcctcagcatggactctttacgctgtggccaccacaatcattacccccatgatgagacacactatcgaaaacacaacggcgaatatatctctgaccgctatcgccaaccaggcagccattttgatgggactggataaaggctggccaatcagtaagatggacattggtgtccctctcctggctcttgggtgctacagccaggtgaatccgttaactctgacagcagccgtcctcatgttggtggcgcattatgctatcataggccccggactgcaagccaaagcaaccagggaggcccagaagcgcaccgctgccggcattatgaagaacccaacagttgatgggatcgtggcaatcgacctagatcctgtagtgtacgacgctaaattcgaaaagcagctgggacagattatgctccttatcctgtgtactagccaaatattgctgatgcggacgacctgggccctctgcgagtccattacactggcgactggccccttaaccacactttgggagggttctccagggaaattttggaataccactatcgccgtctcaatggcaaacattttccgaggaagctatctggctggcgccggtctcgcattctccctaatgaagagtctgggcgggggaagaaggggcacgggggctcagggagaaacattgggcgagaaatggaagcgccggctgaatcagctctctaagagcgaatttaacacctacaaaagatcaggtatcatggaggttgaccgttccgaagccaaggaggggcttaaaaggggagagactaccaagcacgccgtgagtcggggcacagcgaaactgcgctggttcgtcgaacgaaatttggtgaagcctgagggtaaggtaatagatctgggctgtgggagaggaggctggagctattactgcgctgggctcaaaaaggtgactgaagttaaaggatataccaagggcggtcccgggcacgaggaaccgatcccaatggcaacatacggatggaacttagtgaaactgcattctggcaaggacgtctttttcattcctcccgagaaatgtgatacgcttctgtgcgacatcggcgagtcctcaccaaatcccaccattgaagaggggaggactctacgggtgctcaagatggtcgaaccttggctgcgcggaaaccagttttgtatcaagattttgaatccgtacatgcccagcgtggttgagacactggagcaaatgcagagaaaacacggtggcatgctcgtaaggaacccactttcgcgaaattctacccatgaaatgtattgggtgagttgcgggactggaaacatcgtctccgccgtgaatatgacaagccggatgctgttaaaccgtttcaccatggctcacagaaagcctacgtacgagcgcgatgttgacctgggcgccggtaccaggcacgtggcagtcgaacccgaggtggccaacttggatataattgggcagcggatcgaaaatatcaaacatgagcacaagtcaacatggcattatgacgaggataacccttacaaaacttgggcttatcacggatcctacgaagtaaagccatctggcagcgcgagttccatggtgaatggcgttgtcaagctcctgaccaaaccctgggacgtgattcctatggtgacacagatagccatgactgataccacaccatttgggcaacagagagtcttcaaggagaaagttgacacccgcactcccaaggcaaaaaggggaacggctcagatcatggaagtgacagcccgatggctatggggttttcttagccggaacaagaagccgagaatttgtaccagggaggagttcactcgcaaagtacgttctaatgcagccatcggcgctgtgtttattgacgagaaccaatggaactcagccaaggaggcggtcgaagatgagcggttctgggacctggtgcatagagaaagggagctccacaaacaggggaagtgcgcaacctgcgtttataacatgatgggaaaacgcgaaaagaagctgggcgagtttggtaaagccaaggggagtcgagctatctggtacatgtggttgggagcccggttcctggagttcgaagcactcggctttatgaatgaggatcactggttctccagagaaaacagcctttctggcgtggagggggagggactgcataaattaggttacatactgagggacatctcgaagattcctggcgggaatatgtatgctgatgacacagccggatgggatacgcgcatcaccgaagacgatttgcagaacgaggctaaaattactgacatcatggaaccagagcacgccctcctggcaaaggcgatatttaaactaacataccagaataaggtcgtgagagtacaacggcccgccaagaacggcaccgttatggatgtgatttcaaggcgtgaccagcgaggtagcgggcaggtcggaacttatggccttaatacattcaccaacatggaagctcagctgatccgccaaatggagtccgagggcatctttagtccttctgaactcgagacaccaaacctggccgaaagagtgttggattggttagggaaatacggagtggagcggctgaagaggatggcaattagcggtgacgactgtgtcgttaaacccatagatgaccgcttcgctactgccctcaccgcacttaatgatatgggcaaggtgagaaaagacatcccgcagtgggaaccttccaaggggtggaacgattggcagcaggtacccttttgctcacatcacttccaccaactgattatgaaggacggacgggagatcgtggtcccatgtaggaatcaggatgagctagtgggccgagcccgtgttagtcagggtgcggggtggtctctgagagaaacggcttgcctcggaaaaagctatgcccagatgtggcaattgatgtactttcatcgccgggacctgaggcttgcagccaacgctatttgttccgccgtgcctgtcgattgggtgcccacctcaagaacaacttggagcatccacgcacatcaccagtggatgaccacagaggacatgctgtctgtatggaatcgcgtttggatagaagagaacccatggatggaagataagactcatatctccaattgggaggacgtgccctatctcggcaaacgggaggaccagtggtgcggcagtttaattgggctgaccgctagggccacgtgggcgacaaacatccaagtcgctattaatcaggtgcgaagattgatcggaaacgaaaattacctggattacatgaccagcatgaagcggttcaaaaacgagtcggaccctgaaggtgccctctggtga

SEQ ID NO: 14126 - RNA, 9879 nt, synthetic construct
  misc_feature 1..9879: note = derived and/or modified CDS sequence (opt3) from DENV-1__KC692495__SS-prME
  source 1..9879: mol_type = other RNA
agcgtgaccatgctgctcatgcttctgcccaccgccttggctttccacttaactacgaggggcggggagcctcatatgatcgtctccaagcaggaaaggggaaaatctctgctatttaagacctcagctggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctttggtggccctataagccaacataattacagaccagggtatttcacccagactgcgggaccgtggcacctcggcaagctggaacttgattttgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagattcagaggggaagacggatgctggtacggcatggaaatccgccccgttaaggagaaagaagagaatctggtgcgaagtatggtaagcgccggttctggcgaagtggattccttttcacttgggattctgtgtgtcagtatcatgatagaggaggtgatgcggagccgttggtcgagaaagatgttgatgactggaacactcgctgttttcctgctactgattatgggccagctcacctggaacgacctgatcaggctttgcatcatggtgggggccaatgcatccgaccgcatgggaatgggcacaacttacttggctctgatggccacctttaagatgcggcctatgttcgcagtcggtttactctttagaaggctgacgtctcgagaagtgcttctgctaacaattgggctcagcctggttgcctcagtggagttgccaaacagtctggaagagttaggagatggcctcgctatgggcatcatgatgctgaaacttctgaccgagttccaaccccaccagttgtggactaccctcctgtccctaacatttgtcaagactaccctgtctcttgactatgcgtggaaaacgacagccatggtactcagcattgtgtccctgttcccgttgtgtctgtcaaccactagccagaagacaacctggttacctgttctcctggggagttttggatgcaaaccacttactatgttcctgataacagagaacaagatctggggtcgcaagtcttggcccttgaatgagggcattatggcaatcgggattgtgtccatcctcctgagctcgctactgaaaaacgatgtccctcttgctggacccctcatagccggcggtatgctgatcgcctgttacgtgatttcagggtctagtgctgacttgtccttagaaaaggcagccgaggtaagctgggaacaggaggcggaacattctggagctagccacaatatcctggtggaggtccaagatgacggcaccatgaaaattaaggatgaggaacgggacgatacgctcactatcctgcttaaagccaccctgttggcagtttccggcgtgtatccaatgtcaatacctgccacactattcgtgtggtacttttggcagaagaaaaagcagagaagtggggtcctgtgggacacccccagcccaccggaggtggaaagggctgttctcgatgacggaatttatcgtatcctgcagcgcggtcttttaggccggtctcaagtaggggtgggagtcttccaggatggcgtgtttcatacaatgtggcacgttactagaggtgcagtgctgatgtaccaggggaagaggctcgagccttcctgggcctcagtcaaaaaggacttgatcagttatggaggcggctggcgattccaggggagctggaacaccggagaggaagtgcaagtaattgcggtcgagcccggtaaaaatccaaagaacgtgcagacgacacccggcacttttaaaacccctgaaggggaggttggagctatagccctggacttcaagccaggcacatccggttctcccatcgtgaatcgggaagggaagattgtcggactctacggcaacggcgtggttaccacttcggggacctacgtgagcgcaatcgcccaggctaaagcctcacaagagggacctctgccggagattgaagatgaggtctttaagaaacgcaatcttacaatcatggacctgcacccaggttccggcaagacgagaaggtatttgcccgcaatagtgcgggaagctatcaaacgaaagctaagaactctgattctcgcccctacccgcgtagtggcgagtgagatggccgaagcattaaaggggatgccaatcaggtaccagacaaccgctgttaaatctgagcatactggacgtgagattgtcgatctgatgtgccacgccacattcaccatgcggcttctgagccccgtgagagtgcctaactataatatgatcataatggacgaagctcattttacggatccggcatccattgccgccaggggctacatctcaactcgcgtcggtatgggggaggctgcggcaatcttcatgacagccacacccccaggatctgtagaggcttttcctcagagcaacgccgtgattcaggacgaggaacgagatatccccgagagaagttggaactccggctatgactggataaccgatttcccaggcaagactgtttggttcgtgcctagcattaaatctgggaacgacatcgcaaattgtctccggaagaacggaaaaagggtcattcaattgtcacgcaagacatttgataccgagtaccagaagaccaaaaataatgactgggactatgtggttactacggatatctccgaaatgggtgccaacttccgtgctgacagagtgatagatccccggaggtgcctgaagccagtcattctcaaagacggcccggagcgcgtgatcctggcggggcctatgcccgtaaccgtggccagtgcagctcagcgaagaggacggatcggcaggaatcagaacaaggaaggtgatcaatacgtttacatggggcagccacttaataacgacgaggatcacgcccattggacagaggcaaaaatgctactggacaatattaacactcccgaaggcatcattcctgccttgtttgagccagaacgcgagaaaagcgctgccatagatggagaatatagattaaggggcgaagcgcggaagaccttcgtcgagctgatgcgtcgcggggacctccccgtgtggctgtcgtacaaagtggcatctgaaggatttcagtattccgatcgaagatggtgcttcgacggtgagaggaataaccaggtccttgaagagaatatggatgttgaaatctggacaaaggagggcgagcggaaaaagctgcgccctagatggctcgacgccaggacctacagcgacccgttggctctgcgggaatttaaagagttcgccgctgggcgaagatcagtgagtggagatctaattctggaaatcggcaagctcccacaacaccttactctgcgcgcacagaacgccttagacaatttggtaatgctgcacaactctgagcagggtgggaaggcttataggcatgccatggaagaactccccgatacgatcgagaccctgatgcttctggcactcattgcggtgttgacaggcggagtcactctgtttttcttatccggcaaggggctaggaaagaccagcataggtctgctctgtgtgacagcctcaagtgcacttctgtggatggccagcgttgaacctcactggatcgcagcttccattatcttggagtttttcctgatggtgctcctgattcccgaaccagaccggcagcgtacccctcaagataatcagcttgcctacgtcgtaatcggcctcctgtttatgatattgactgtggcagccaacgagatggggctgttagagacaacgaaaaaggacctaggaatcggctatgttgctgcggaaaaccatcagcacgccaccatgctggatgtggacctccaccccgcatctgcttggactctttacgccgtcgccacaaccgtgattaccccaatgatgagacatacaatcgagaatactacggcaaacattagcctgaccgctatcgccaatcaagcggctatattgatgggtctggataaagggtggcctatttccaagatggacatcggcgtcccgctcctggcccttggatgctactcacaggtgaaccccttaacactgactgcagccgttctcatgttggtggctcactatgcaattatcggcccagggctgcaggccaaagcgaccagggaagctcagaagcgcacagccgcaggaataatgaagaatcctaccgtagatggcatcgtggccattgacctagatcccgtcgtttacgacgctaaattcgagaagcaactgggtcagatcatgctccttattctgtgtacttctcagatcttgctgatgcggacgacatgggccctctgcgaaagtataaccctggcaactgggccattaaccacactttgggagggatcgcctggcaaattctggaacactaccattgctgtgagcatggccaatatctttcgaggttcctatctggcgggcgccgggctcgcattctctctaatgaagtcactgggaggcgggagaaggggaacaggcgctcagggtgagacgttgggggaaaaatggaagcgccaactgaaccagctcagcaagtccgagtttaatacctacaaacggagtggaatcatggaagtcgacagatctgaggccaaggaaggccttaaacgtggtgagactacaaagcatgcagtgagcaggggcaccgctaaactgcggtggttcgtagagcgcaacttggtgaagcccgaagggaaggttattgatctgggatgtggccgagggggatggtcatattactgcgccggcctcaaaaaggtgactgaggtcaaaggttatacaaaagggggaccgggccacgaggaaccaatccctatggccacctacggctggaatttagtgaaactgcattccgggaaggacgtctttttcatgcccccagaaaaatgtgatacgcttctgtgcgacataggagagagtagccccaaccctaccattgaggaaggtagaacactaagggtgctcaagatggttgagccgtggctgcggggcaatcagttttgtatcaagattttgaacccctacatgccatctgtagtggaaactctggagcagatgcaacgcaaacacgggggaatgctcgtcagaaatcctctttccaggaactcaacccacgagatgtattgggtgagctgcggcacaggtaatatcgtttcggcggtgaacatgacttctcgaatgctgttaaaccggttcaccatggctcatcgtaagcccacatacgaaagagatgtcgacctgggggcaggaacccgccacgtggccgtagagcctgaagtggctaatttggatataatcggccagaggattgagaacatcaaaaatgaacataagagtacttggcactatgacgaggataacccatacaaaacgtgggcctatcacggctcctacgaggttaagcccagcgggtcagcatcctctatggtcaatggagtggtgcggctcctgacaaagccttgggacgtcattccaatggttacccagatcgccatgactgataccacaccctttggtcaacagagagtgttcaaagaaaaggtagacacgcgcaccccgagggctaaacgaggcactacacagattatggaggtgaccgcgaagtggctatgggggtttcttagccggaacaaaaagcctagaatctgtactagggaagagttcacacgcaaggtccgtagtaatgccgcaataggagctgtgtttgttgacgaaaaccagtggaactccgccaaagaggcagtggaggatgaacggttctgggacctggtccatagagagagggaactccacaagcaaggcaaatgcgcaacctgcgtgtataacatgatgggtaagcgcgagaaaaagctgggggagttcggaaaggctaaaggcagccgagccatttggtacatgtggttgggcgcgcggtttctggagttcgaggcactcgggtttatgaatgaagatcattggttctctagagagaactcacttagtggagtagaaggtgagggcctgcacaagttagggtacatcctgagggacatctccaaaattccaggaggcaatatgtatgccgatgacacagctggttgggatactcgcataaccgaggacgatttgcagaacgaagccaagatcacggacattatggagcccgaacatgcactcctggctaccagcatctttaaactaacataccagaataaggttgtgagagtccagcggcctgccaaaaacgggactgtgatggatgtgatttctaggcgtgaccaacgaggatcgggccaggtcggcacctatgggcttaacacattcactaatatggaggttcagctgatccgccagatggaatcagagggaatatttctcccaagcgagctggaaacccccaacttggctgagagagccttagattggctggaaaagcacggtgcagagcggctcaagaggatggcgatctccggcgacgactgtgtggtaaaaccgattgatgaccgcttcgccacggctcttacagccctgaatgatatggggaaggtgagaaaagacatccctcaatgggaacccagtaagggatggaacgattggcagcaggtcccattttgctctcaccatttccaccagctaattatgaaagacggccgggagatcgtggttccttgtaggaatcaagatgagctggtgggtcgagcacgtgtcagccagggggctggatggtccctcagagaaaccgcctgcttgggcaagtcatacgcacagatgtggcaactgatgtattttcatcgccgggaccttaggctggccgcgaacgctatatgtagtgccgtgcccgtagattgggttccagcatctagaactacatggagcattcacgcccaccatcagtggatgaccactgaggacatgctctccgtgtggaatcgcgtctggatcgaagagaacccctggatggaagataagacccacgtgtcaagctgggaggaggttccttacttaggcaaacgggaagaccagtggtgcgggtctctgatcggattgacagctagggccacgtgggcaaccaatattcaggtggctataaaccaagtccgaagactgatcggtaatgagaactatctcgactacatgacttccatgaagcggttcaaaaatgaaagtgatccagagggcgccctttggtga

SEQ ID NO: 14127 - RNA, 9879 nt, synthetic construct
  misc_feature 1..9879: note = derived and/or modified CDS sequence (opt3) from DENV-1__KC692496__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaggcagatccagcgggtggagacttgggctctgcgccaccctggattcaccgttattgcatttttcctggcccatgctatcggcacatcgattacccagaaaggcatcatatttatcctcttaatgctggtgacgccatcaatggccatgagatgcgtcgggattggaaacagggacttcgtggagggtcttagcggcgcgacttgggtagatgttgtgttggaacacgggagttgtgtcacaaccatggcaaagaataagcccactctggacatcgagctactcaaaacagaagtgaccaaccctgccgtgctgcggaagctttgcattgaggctaaaatctccaatacgaccacagattctcgctgtccaactcaaggagaagccaccctggtcgaggagcaggacgcaaactttgtttgccgaagaacattcgtggataggggctggggtaatgggtgtggattgtttggcaagggcagcctcctgacttgcgctaaattcaagtgcgtaaccaagttagaagggaaaatagtgcagtacgagaacctgaagtattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccacggactggattggactttaacgagatggtcctactgacaatgaaagagaagagctggctcgtgcataaacagtggttcctggatcttccgctgccctggacgtctggcgcatccacctcacaagaaacttggaatcgtcaggacttgctcgtaacatttaagaccgctcacgccaaaaagcaggaggttgtggtcctgggtagccaagaaggggctatgcacacagccttaactggcgcaaccgagatccagacgagtggaaccacaactattttcgccggccatctgaagtgccgcctaaaaatggataagctcaccctgaaagggatgtcttatgtgatgtgtacaggatccttcaagcttgaaaaagaggtcgctgagactcagcacggtaccgtgttggttcaggtgaagtacgaaggcacggacgcgccttgcaagataccatttagcacacaagatgagaaaggggtaacccagaacggaagactgatcactgcaaatcccattgtcacagacaaggaaaaacctgtgaacatcgagaccgagccacccttcggcgaatcgtatatagttgtgggtgccggggagaaggctctcaaactgtcttggtttaagaggggctcctcaattggaaagatgttcgaagccactgcacggggcgcccgacgcatggctatccttggggataccgcctgggactttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagcagatcaacaagtctatccatgacctgtatagcggtgggcatggtgacactctacctgggggtcatggttcaggctgatagcggatgcgtgatcaactggaaaggcagggagcttaagtgtggttctgggatttttgtgactaacgaagtacacacctggacggagcaatataaattccaggccgactcaccgaagcggttgagtgcagccatcggaaaggcttgggaggaaggcgtctgcggtatccgcagcgccacaagactggagaatattatgtggaaacagatatccaacgaactcaatcatatcctgttagagaacgatatgaagtttaccgtggttgtgggcgacgcaaatgggattctggctcagggaaaaaagatgatcaggcctcaacccatggaacacaaatactcttggaagtcgtggggcaaagccaagattatcggggcggacatacagaacactaccttcatcattgatggaccagacacacctgagtgtcccgatggccagcgtgcctggaatatctgggaggtcgaagactatggttttggggtgttcactaccaacatttggcttaagttgcgggatagctacacacagatgtgcgaccaccgactcatgtccgctgcaatcaaagattcaaaggccgttcatgctgacatgggatattggatagagagtgaaaaaaatgagacgtggaagctggccagagcatctttcattgaagtgaaaacctgtacttggccaaagagccacacactatggtccaacggcgtactggagtcagagatgatcattcccaagatctttggtggccctataagccaacataattacaggccagggtatttcacccagactgcgggaccgtggcacctcggcaaactggaacttgattttgacttgtgcgaggggacaaccgtcgtggtggatgaacactgcggaaaccgcggcccctctctgcggacgactaccgtcacaggtaagatcattcatgagtggtgttgcagatcctgtaccttacctccactcaggttccgcggggaggacggatgctggtacggcatggaaatccgacccgttaaagagaaggaagagaatctggtgcggagtatggtaagcgccggttctggcgaagtggattccttttcacttgggattctgtgtgtcagtatcatgatagaggaggtgatgcgtagcagatggtcgaggaaaatgttgatgactggaacactcgctgttttcctgctactgattatgggccagctcacctggaacgacctgatccgcctttgcatcatggtgggggccaatgcatccgaccggatgggaatgggcacaacttacttggctctgatggccacctttaagatgagacctatgttcgcagtcggtttactctttaggcgactgacgtctcgcgaagtgcttctgctaacaattgggctcagcctggttgcctcagtggagttgccaaacagtctggaagagttaggagatggcctcgctatgggcatcatgatgctgaagcttctgaccgaattccaaccccaccagttgtggactaccctcctgtccctaacatttgtcaaaactaccctgtctcttgactatgcgtggaagacgacagccatggtactcagcattgtgtccctgttcccgttgtgtctgtcaaccactagccagaaaacaacctggttacctgttctcctggggagttttggatgcaagccacttactatgttcctgataacagagaacaaaatctggggtcggaagtcttggcccttgaatgagggcattatggcaatcgggattgtgtccatcctcctgagctcgctactgaagaacgatgtccctcttgctggacccctcctggccggcggtatgttgatagcctgttacgtgatctcagggtctagtgctgacttatccctggaaaaagcagccgaggtaagctgggaacaggaggcggaacattctggagctagccacaatattctcgtggaggtccaagatgacggcaccatgaagatcaaagatgaggaaagagacgatacgctgactattcttctgaaggccaccttgctagcagtttccggcgtgtatccaatgtcaatccctgccacactgttcgtgtggtacttttggcagaaaaagaaacagaggagtggggtcctctgggacacccccagcccaccggaggtggaacgtgctgttctggatgacggaatatatcgcattcttcagcggggtttactgggcagatctcaagtaggggtgggagtcttccaggatggcgtgtttcatacaatgtggcacgttactaggggtgcagtgctcatgtaccaggggaagcgattggagccttcctgggcctcagtcaagaaagacctgatcagttatggaggcggctggcggttccaggggagctggaacaccggagaggaagtgcaagtaatcgcggtcgagcccggtaagaatccaaaaaacgtgcagacgacacccggcacttttaagacccctgaaggggaggttggagctattgccctcgacttcaaaccaggcacatccggttctcccatagtgaatcgcgaagggaagatcgtcggactgtacggcaacggcgtggttaccacttcggggacctacgtgagcgcaattgcccaggctaaggcctcacaagagggacctcttccggagatcgaagatgaggtctttaaaaagagaaatctgacaattatggacttgcacccaggttccggcaaaacgaggcggtatctacccgcaatcgtgcgagaagctataaagagaaaactgcgcactctcatcttagcccctaccagggtagtggcgagtgagatggccgaagcactgaaggggatgccaattcgttaccagacaaccgctgttaagtctgagcatactggacgggagatcgtcgatcttatgtgccacgccacattcaccatgagactgctcagccccgtgagggtgcctaactataatatgattatcatggacgaagctcattttacggatccggcatccatagccgcccgcggctacatttcaactcgagtcggtatgggggaggctgcggcaatcttcatgacagccacccccccaggatctgtagaagcttttcctcagagcaacgccgtgatccaggacgaggaaagagatattcccgagcggagttggaattccggctatgactggatcaccgatttcccaggcaaaactgtttggttcgtgcctagcataaagtctgggaacgacattgcaaattgtttgaggaaaaacggaaagcgcgtcatccaactgtcacgtaaaacatttgataccgagtaccagaagacaaagaacaatgactgggactatgtggttactacggatatttccgaaatgggtgccaacttcagagctgaccgggtgatcgatcccaggcgctgcctcaaaccagtcatactgaaggacggcccggagcgagtgattcttgcggggcctatgcccgtaaccgtggccagtgcagctcagagacggggaaggatcggccgcaatcagaacaaagaaggtgatcaatacgtttacatggggcagccactaaataacgacgaggatcacgcccattggacagaggcaaagatgctgttggacaatatcaacactcccgaaggcattatccctgccttatttgagccagaaagagagaaaagcgctgccattgatggagaatataggctgcggggcgaggcgcgtaagaccttcgtcgagctcatgcgccgaggggacctgcccgtgtggctttcgtacaaggtggcatctgaaggatttcagtattccgatagaaggtggtgcttcgacggtgagcggaataaccaggtcctggaagagaatatggatgttgaaatatggacaaaagagggcgagcgcaagaaactcagacctaggtggttggacgcccggacctacagcgacccgctggctctacgagaatttaaggagttcgccgctgggagacgctcagtgagtggagatctgatcctcgaaattggcaaacttccacaacacctgactttaagggcacagaacgccttggacaatctggtaatgctccacaactctgagcagggtgggaaggcttatcggcatgccatggaagagctgcccgatacgatcgagacccttatgctgctcgcattgatcgcggtgctgacaggcggagtcactttatttttcctatccggcaaagggctgggaaagaccagcattggtctcctttgtgtgacagcctcaagtgctctgttgtggatggccagcgttgaacctcactggatagcagcttccatcattctggagtttttcctcatggtgctgcttatccccgaaccagaccgtcagagaacccctcaagataatcagctcgcctacgtcgtaattggcctgttgtttatgatcctgactgtggcagccaacgagatggggttactagagacaacgaagaaagacctgggaataggctatgttgctgcggaaaaccatcagcacgccaccatgctcgatgtggaccttcaccccgcatctgcttggactctgtacgccgtcgccacaaccgtgatcaccccaatgatgaggcatacaattgagaatactacggcaaacatcagcttgaccgctattgccaatcaagcggctatcctgatgggtctcgataaggggtggcctatatccaaaatggacattggcgtcccgctgcttgccttaggatgctactcacaggtgaaccccctgacactcactgcagccgttttgatgctggtggctcactatgcaatcattggcccagggctacaggccaaggcgacccgcgaagctcagaaacggacagccgcaggaatcatgaagaatcctaccgtagatggcatagtggccatcgacctggatcccgtcgtttacgacgctaagttcgagaaacaactcggtcagattatgcttctgatcttgtgtacttctcagattctgctcatgcgaacgacatgggccctgtgcgaaagtatcaccttagcaactgggccacttaccacactgtgggagggatcgcctggcaagttctggaacactaccatagctgtgagcatggccaatatttttagaggttcctatctcgcgggcgccgggctagcattctctctgatgaaatcattgggaggcgggaggcgcggaacaggcgctcagggtgagacgctgggggaaaagtggaaacggcaactcaaccagcttagcaagtccgagtttaatacctacaagagaagtggaatcatggaagtcgaccgttctgaggccaaagaaggcctgaagaggggtgagactacaaaacatgcagtgagccggggcaccgctaagttgcgctggttcgtagagcgaaacctggtgaaacccgaagggaaggttatcgatctcggatgtggcagagggggatggtcatattactgcgccggcttaaagaaagtgactgaggtcaagggttatacaaaagggggaccgggccacgaagagccaattcctatggccacctacggctggaatctggtgaagcttcattccgggaaagacgtctttttcatgcccccagaaaagtgtgatacgctgctatgcgacatcggagagagtagccccaaccctaccatagaggaaggtaggacactccgggtgctgaaaatggttgagccgtggttgcgcggcaatcagttttgtattaagatcctgaacccctacatgccatctgtagtggaaactctcgagcagatgcaaagaaagcacgggggaatgcttgtcaggaatcctctgtcccgaaactcaacccacgagatgtattgggtgagctgcggcacaggtaatattgtttcggcggtgaacatgacttctcggatgttactgaaccgtttcaccatggctcatagaaaacccacatacgaacgcgatgtcgacttgggggcaggaaccaggcacgtggccgtagagcctgaagtggctaatctcgatatcataggccagcggatcgagaacattaagaatgaacataaaagtacttggcactatgacgaggataacccatacaagacgtgggcctatcacggctcctacgaggttaaacccagcgggtcagcatcctctatggtcaatggagtggtgagactgctaacaaagccttgggacgtcatcccaatggttacccagattgccatgactgataccacaccctttggtcaacagcgcgtgttcaaggaaaaagtagacacgaggaccccgcgagctaagcggggcactacacagatcatggaggtgaccgcgaaatggctttgggggtttctgagcagaaacaagaaacctaggatttgtactcgcgaagagttcacacgtaaggtccggagtaatgccgcaatcggagctgtgtttgttgacgaaaaccagtggaattccgccaaggaggcagtggaggatgaaagattctgggacctcgtccatagggagcgcgaactgcacaaacaaggcaagtgcgccacctgcgtgtataacatgatgggtaaacgagagaagaaattgggggaattcggaaaggctaagggcagccgggccatatggtacatgtggctgggcgcgagatttctcgagttcgaggcacttgggtttatgaatgaagatcattggttctctagggagaactcactgagtggagtagaaggtgagggcttacacaaactggggtacattttgcgcgacatctccaagatcccaggaggcaatatgtatgccgatgacacagctggttgggatactagaattaccgaggacgatctccagaacgaagccaaaataacggacatcatggagcccgaacatgcactgctagctaccagcatttttaagcttacataccagaataaagttgtgcgggtccagaggcctgccaagaacgggactgtgatggatgtgatctctcgtcgagaccaacgcggatcgggccaggtcggcacctatgggctgaacacattcactaatatggaggttcagctcattagacagatggaatcagagggaatctttctgccaagcgagttggaaacccccaacttagctgagcgggccctggattggctcgaaaaacacggtgcagagaggcttaagcgcatggcgatatccggcgacgactgtgtggtaaagccgatcgatgacagattcgccacggctctgacagccctaaatgatatggggaaagtgcggaaggacattcctcaatgggaacccagtaaaggatggaacgattggcagcaggtcccattttgctctcaccatttccaccagctgatcatgaaggacggcagggagattgtggttccttgtcgaaatcaagatgagctcgtgggtcgtgcaagagtcagccagggggctggatggtccttgcgcgaaaccgcctgcctgggcaaatcatacgcacagatgtggcaacttatgtattttcatcggagggacctgagactcgccgcgaacgctatctgtagtgccgtgcccgtagattgggttccagcatctcgcactacatggagcatacacgcccaccatcagtggatgaccactgaggacatgttatccgtgtggaatcgggtctggattgaagagaacccctggatggaagataagacccacgtgtcaagctgggaggaggttccttacctgggcaagagggaagaccagtggtgcgggtctttgatcggactgacagctcgagccacgtgggcaaccaatatccaggtggctattaaccaagtcagacggctcataggtaatgagaactatcttgactacatgacttccatgaaaaggttcaagaatgaaagtgatccagagggcgccctgtggtga

SEQ ID NO: 14128 - RNA, 9879 nt, synthetic construct
  misc_feature 1..9879: note = derived and/or modified CDS sequence (opt3) from DENV-1__KC692497__SS-prME
  source 1..9879: mol_type = other RNA
agcgtgaccatgctgctcatgcttctgcccacagcattggctttccacttaactacgaggggcggggagcctcatatgatcgtctccaagcaggaaaggggaaagtctctgttatttaagacctcagccggtgttaatatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaatagagactttgtggagggtttgagcggcgcgacttgggtagatgttgtgctggaacacgggagttgtgtcacaaccatggcaaagaataaacccactctagacatcgagctcctgaagacagaagtgaccaaccctgccgtgcttaggaaactgtgcattgaggctaagatctccaatacgaccacagattctcggtgtccaactcaaggagaagccaccttggtcgaggagcaggacgcaaacttcgtttgccgccgaacatttgtggatagaggctggggtaatgggtgtggactcttcggcaaaggcagcctgttaacttgcgctaagtttaagtgcgtaaccaaactggaagggaagatagtgcagtacgagaacctcaaatattccgtcattgtgacagttcacaccggagaccagcatcaagtgggtaatgaaactacggagcacggcacaatcgccaccattactccccaggcgcctacctcagaaatccagcttacagattacggggccctgaccttggactgtagtccaaggactggactagacttcaacgagatggtcctgctcacaatgaaggagaaaagctggctggtgcataagcagtggtttcttgatctgccgttgccctggacgtctggcgcatccacctcacaagaaacttggaatcggcaggacctcctggtaacattcaaaaccgctcacgccaagaagcaggaggttgtggtcttaggtagccaagaaggggctatgcacacagccctgactggcgcaaccgagatccagacgagtggaaccacaactatttttgccggccatctaaaatgccgtctcaagatggataaactgacccttaaggggatgtcttatgtgatgtgtacaggatccttcaaattggaaaaggaggtcgctgagactcagcacggtaccgtgctggttcaggtgaagtacgaaggcacggacgcgccttgcaaaataccattcagcacacaagatgagaagggggtaacccagaacggacgcctcatcactgcaaatcccattgtcacagacaaagaaaagcctgtgaacatcgagaccgagccaccctttggcgaatcgtatatagttgtgggtgccggggagaaagctctgaaactttcttggttcaagagaggctcctcaattggaaaaatgtttgaagccactgcaaggggcgcccggcgaatggctatcctgggggataccgcctgggacttcggaagtatcggtggcgtctttacaagcgtggggaagttggtacatcaggtgttcggaacggcatacggcgttctcttttccggtgtctcttggaccatgaaaattgggatcggcattctgttaacttggctgggactaaatagccgctcaacaagtctctccatgacctgtatagcggtgggcatggtgacactgtaccttggggtcatggttcaggctgatagcggatgcgtgatcaactggaagggcagagagttgaaatgtggttctgggattttcgtgactaacgaagtacacacctggacggagcaatataagtttcaggccgactcaccgaagaggctgagtgcagccatcggaaaggcttgggaggaaggcgtctgcggtatccggagcgccacacgcctcgagaatattatgtggaagcagatatccaacgaactgaatcatatcttactggagaacgatatgaaattcaccgtggttgtgggcgacgcaaatgggattcttgctcagggaaagaaaatgatcagacctcaacccatggaacacaagtactcttggaaatcgtggggcaaggccaagattatcggggcggacatacagaacactacctttatcattgatggaccagacacacctgagtgtcccgatggccagagggcctggaatatctgggaggtcgaagactatggtttcggggtgtttactaccaacatttggttgaaactccgtgatagctacacacagatgtgcgaccaccggctgatgtccgctgcaatcaaggattcaaaagccgttcatgctgacatgggatattggatagagagtgaaaagaatgagacgtggaaactagcccgagcatctttcattgaagtgaagacctgtacttggccaaagagccacacactgtggtccaacggcgtactcgagtcagagatgatcattcccaaaatcttcggtggccctataagccaacataattacagaccagggtattttacccagactgcgggaccgtggcacctgggcaaacttgaattggatttcgacctgtgcgaggggacaaccgtcgtggtggatgaacactgcggaaacaggggcccctctttacgcacgactaccgtcacaggtaaaatcattcatgagtggtgttgccggtcctgtaccctccctccactgagatttagaggggaagacggatgctggtacggcatggaaatccgccccgttaaggagaaagaagagaatcttgtgcgaagtatggtaagcgccggttctggcgaagtggattccttctcactggggattttgtgtgtcagtatcatgatagaggaggtgatgcggagccgttggtcgagaaagatgctcatgactggaacactggctgtttttctactgctcattatgggccagctgacctggaacgaccttatcaggttgtgcatcatggtgggggccaatgcatccgaccgcatgggaacaggcactacctacctggctttaatggccacgttcaagatgcggcctatgtttgcagtcggtctcctgttcagaaggcttacatctcgagaagtgctgctactcaccattgggctgagcttggttgcctcagtggagctgccaaacagtttagaggaactcggagatggcctggctatgggcatcatgatgcttaaactgttgactgaatttcaaccccaccagctctggaccacactgctatccctgactttcgtcaagaccacgctttctctcgactatgcgtggaaaacaaccgccatggtactgagcattgtgtccttgtttccgctgtgtttatcaactacaagccagaagaccacttggctccctgttctgcttgggagtttcggatgcaaaccactgacaatgtttttgataaccgagaacaagatctggggtcgcaagtcttggcccctcaatgagggcattatggcaatcgggattgtgtccatcctgctaagctcgctgcttaaaaacgatgtccctctcgctggacccctgatagccggcggtatgttgatcgcctgttacgtgatttcagggtctagtgctgacttatccctggaaaaggcagccgaggtaagctgggaacaggaggcggaacattctggagctagccacaatatcctcgtggaggtccaagatgacggcacgatgaaaattaaggatgaggaacgggacgatactctgaccatccttctgaaagccacattgctagcagtttccggcgtgtatccaatgtcaatacctgccaccctgttcgtgtggtacttctggcagaagaaaaagcagagaagtggggtcctctgggacacacccagcccaccggaggtggaaagggctgttctggatgacggaatttatcgtatccttcagcgcggtttactgggccggtctcaagtaggggtgggagtctttcaggatggcgtgttccatactatgtggcacgttaccagaggtgcagtgctcatgtaccaggggaagaggttggagccttcctgggcctcagtcaaaaaggacctgatcagttatggaggcggctggcgatttcaggggagctggaacacgggagaggaagtgcaagtaattgcggtcgagcccggtaaaaatccaaagaacgtgcagacaactcccggcaccttcaaaacacctgaaggggaggttggagctatagccctcgactttaagccaggcacctccggttctcccatcgtgaatcgggaagggaagattgtcggactgtacggcaacggcgtggttactacctcggggacatacgtgagcgcaatcgcccaggctaaagcctcacaagagggacctcttccggagattgaagatgaggtcttcaagaaacgcaatctgacgatcatggacttgcacccaggttccggcaagactagaaggtatctacccgcaatagtgcgggaagctatcaaacgaaagctgagaaccctcattttagcccctacacgcgtagtggcgagtgagatggccgaagcactgaaggggatgccaatcaggtaccagaccactgctgttaaatctgagcatacaggacgtgagattgtcgatcttatgtgccacgccacctttacgatgcggctgctcagccccgtgagagtgcctaactataatatgatcataatggacgaagctcatttcactgatccggcatccattgccgccaggggctacatctcaacacgcgtcggtatgggggaggctgcggcaatctttatgaccgccacacccccaggatctgtagaggctttccctcagagcaacgccgtgattcaggacgaagaacgagatatccccgagagaagttggaactccggctatgactggataactgattttccaggcaagacagtttggttcgtgcctagcattaaatctgggaacgacatcgcaaattgtttgcggaagaacggaaaaagggtcattcaactgtcacgcaagaccttcgatacagagtaccagaagactaaaaacaatgactgggactatgtggttacgaccgatatctccgaaatgggtgccaactttcgtgctgacagagtgatagatccccggaggtgcctcaagccagtcattctgaaagacggcccggagcgcgtgatccttgcggggcctatgcccgtaacagtggccagtgcagctcagcgaagaggacggatcggcaggaatcagaacaaggaaggtgatcaatacgtttacatggggcagccactaaataacgacgaggatcacgcccattggactgaggcaaaaatgctgttggacaatattaacacccccgaaggcatcattcctgccttattcgagccagaacgcgaaaagagcgctgccatagatggagaatatagactgaggggcgaggcgcggaagacatttgtcgagctcatgcgtcgcggggacctgcccgtgtggctttcgtacaaagtggcatctgaaggattccagtattccgatcgaagatggtgctttgacggtgagaggaataaccaggtcctggaagagaatatggatgttgaaatctggaccaaggagggcgagcggaaaaagctccgccctagatggttggacgccaggacttacagcgacccgctggctctacgggagttcaaagagtttgccgctgggcgaagatcagtgagtggagatctgattctcgaaatcggcaaacttccacaacacctgacgttacgcgcacagaacgccttggacaatctggtaatgctccacaactctgagcagggtgggaaggcttataggcatgccatggaggaactgcccgataccatcgagacacttatgctgctcgcattgattgcggtgctgactggcggagtcaccttattctttctatccggcaaggggctgggaaagacaagcataggtctcctttgtgtgaccgcctcaagtgctctgttgtggatggccagcgttgaacctcactggatcgcagcttccattatcctggagttctttctcatggtgctgcttattcccgaaccagaccggcagcgtactcctcaagataatcagctcgcctacgtcgtaatcggcctgttgttcatgatactgacagtggcagccaacgagatggggttactagagacgaccaaaaaggacctgggaatcggctatgttgctgcggaaaaccatcagcacgccactatgctcgatgtggaccttcaccccgcatctgcttggacactgtacgccgtcgccaccaccgtgattacaccaatgatgagacatactatcgagaatacgaccgcaaacattagcttgacagctatcgccaatcaagcggctatactgatgggtctcgataaagggtggcctatttccaagatggacatcggcgtcccgctgcttgccttaggatgctactcacaggtgaaccccctgactctcaccgcagccgttttgatgctggtggctcactatgcaattatcggcccagggctacaggccaaagcgacaagggaagctcagaagcgcaccgccgcaggaataatgaagaatcctactgtagatggcatcgtggccattgacctggatcccgtcgtttacgacgctaaatttgagaagcaactcggtcagatcatgcttctgattttgtgtacgtctcagatcctgctcatgcggacaacctgggccctgtgcgaaagtataactttagcaaccgggccacttacaactctgtgggagggatcgcctggcaaattctggaacaccacaattgctgtgagcatggccaatatcttccgaggttcctatctcgcgggcgccgggctagcattttctctgatgaagtcattgggaggcgggagaaggggaacgggcgctcagggtgagaccctgggggaaaaatggaagcgccaactcaaccagcttagcaagtccgagttcaatacttacaaacggagtggaatcatggaagtcgacagatctgaggccaaggaaggcctgaaacgtggtgagacaaccaagcatgcagtgagcaggggcactgctaaattgcggtggtttgtagagcgcaacctggtgaagcccgaagggaaggttattgatctcggatgtggccgagggggatggtcatattactgcgccggcctaaagaaggtgacagaggtcaaaggttataccaaagggggaccgggccacgaggaaccaatccctatggccacgtacggctggaatctggtgaaacttcattccgggaaggacgtcttctttatgcccccagaaaaatgtgataccctgctatgcgacataggagagagtagccccaaccctacaattgaggaaggtagaactctcagggtgctgaagatggttgagccgtggttgcggggcaatcagttctgtatcaagattctgaacccctacatgccatctgtagtggaaaccctcgagcagatgcaacgcaaacacgggggaatgcttgtcagaaatcctctgtccaggaactcaacacacgagatgtattgggtgagctgcggcactggtaatatcgtttcggcggtgaacatgacctctcgaatgttactgaaccggtttacaatggctcatcgtaagcccacctacgaaagagatgtcgacttgggggcaggaactcgccacgtggccgtagagcctgaagtggctaatctcgatgttataggccagaggatcgagaacattaaaaatgaacataagagtacgtggcactatgacgaggataacccatacaaaacatgggcctatcacggctcctacgaggtcaagcccagcgggtcagcatcctctatggtgaatggagtggtccggctgctaaccaagccttgggacgttatcccaatggtgactcagattgccatgaccgatacaacgcccttcggtcaacagagagtatttaaagaaaaggtggacacccgcactccgagggctaaacgaggcacaacccagatcatggaggtcactgcgaagtggctttgggggttcctgagccggaacaaaaagcctagaatttgtacaagggaagagtttacccgcaaggtgcgtagtaatgccgcaatcggagctgttttcgtggacgaaaaccagtggaactccgccaaagaggcagtcgaggatgaacggttttgggacctcgtgcatagagagagggaactgcacaagcaaggcaaatgcgccacatgcgtatataacatgatgggtaagcgcgagaaaaagttgggggagttcggaaaggctaaaggcagccgagccatatggtacatgtggctgggcgcgcggttcctcgagtttgaggcacttgggttcatgaatgaagatcattggttttctagagagaactcactgagtggagttgaaggtgagggcttacacaagctggggtacattttgagggacatctccaaaatcccaggaggcaatatgtatgccgatgacactgctggttgggatacccgcattacggaggacgatctccagaacgaagccaagataaccgacatcatggagcccgaacatgcactgctagctacaagcattttcaaacttacttaccagaataaggtggtcagagtgcagcggcctgccaaaaacgggaccgtgatggatgtcatctctaggcgtgaccaacgaggatcgggccaggttggcacatatgggctgaacacttttaccaatatggaggtgcagctcattcgccagatggaatcagagggaatcttcctgccaagcgagttggaaacgcccaacttagctgagagagccctggattggctcgaaaagcacggtgcagagcggcttaagaggatggcgatatccggcgacgactgtgtagtgaaaccgatcgatgaccgctttgccacagctctgaccgccctaaatgatatggggaaggtcagaaaagacattcctcaatgggaacccagtaagggatggaacgattggcaacaggtgccattctgctctcaccattttcaccagctgatcatgaaagacggccgggagattgttgtgccttgtaggaatcaagatgagctcgtcggtcgagcacgtgtgagccagggggctggatggtccttgagagaaactgcctgcctgggcaagtcatacgcacagatgtggcaacttatgtatttccatcgccgggacctgaggctcgccgcgaacgctatctgtagtgccgtacccgttgattgggtgccagcatctagaacaacctggagcatacacgcccaccatcagtggatgactaccgaggacatgttatccgtctggaatcgcgtgtggattgaagagaacccctggatggaagataagacacacgtttcaagctgggaggaggtgccttacctgggcaaacgggaagaccagtggtgcgggtctttgatcggactgacggctagggccacctgggcaactaatatccaggtcgctattaaccaagtgcgaagactcataggtaatgagaactatcttgactacatgacatccatgaagcggtttaaaaatgaaagtgatccagagggcgccctgtggtga

SEQ ID NO: 14129 - RNA, 9879 nt, synthetic construct
  misc_feature 1..9879: note = derived and/or modified CDS sequence (opt3) from DENV-1__KC692498__SS-prME
  source 1..9879: mol_type = other RNA
agcgtgaccatgctgctcatgcttctgcccacagcattggctttccacttaactacgaggggcggggagcctcatatgatcgtctccaagcaggaaaggggaaagtctctgttatttaagacctcagccggtgttaatatgtgcaccctcattgccatggacctgggcgagctttgtgaagatactatgacctacaagtgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagactttgtggagggtttgagcggcgcgacttgggtagatgttgtgctggaacacgggagttgtgtcacaaccatggcaaagaataaacccactctagacatcgagctcctgaagacagaagtgaccaaccctgccgtgcttaggaaactgtgcattgaggctaagatctccaatacgaccacagattctcggtgtccaactcaaggagaagccaccttggtcgaggagcaggacgcaaacttcgtttgccgccgaacatttgtggatagaggctggggtaatgggtgtggactcttcggcaaaggcagcctgttaacttgcgctaagtttaagtgcgtaaccaaactggaagggaagatagtgcagtacgagaacctcaaatattccgtcattgtgacagttcacaccggagaccagcatcaagtgggtaatgaaactacggagcacggcacaatcgccaccattactccccaggcgcctacctcagaaatccagcttacagattacggggccctgaccttggactgtagtccaaggactggactagacttcaacgagatggtcctgctcacaatgaaggagaaaagctggctggtgcataagcagtggtttcttgatctgccgttgccctggacgtctggcgcatccacctcacaagaaacttggaatcggcaggacctcctggtaacattcaaaaccgctcacgccaagaagcaggaggttgtggtcttaggtagccaagaaggggctatgcacacagccctgactggcgcaaccgagatccagacgagtggaaccacaactatttttgccggccatctaaaatgccgtctcaagatggataaactgacccttaaggggatgtcttatgtgatgtgtacaggatccttcaaattggaaaaggaggtcgctgagactcagcacggtaccgtgctggttcaggtgaagtacgaaggcacggacgcgccttgcaaaataccattcagcacacaagatgagaagggggtaacccagaacggacgcctcatcactgcaaatcccattgtcacagacaaagaaaagcctgtgaacatcgagaccgagccaccctttggcgaatcgtatatagttgtgggtgccggggagaaagctctgaaactttcttggttcaagagaggctcctcaattggaaaaatgtttgaagccactgcaaggggcgcccggcgaatggctatcctgggggataccgcctgggacttcggaagtatcggtggcgtctttacaagcgtggggaagttggtacatcaggtgttcggaacggcatacggcgttctcttttccggtgtctcttggaccatgaaaattgggatcggcattctgttaacttggctgggactaaatagccgctcaacaagtctctccatgacctgtatagcggtgggcatggtgacactgtaccttggggtcatggttcaggctgatagcggatgcgtgatcaactggaagggcagagagttgaaatgtggttctgggattttcgtgactaacgaagtacacacctggacggagcaatataagtttcaggccgactcaccgaagaggctgagtgcagccatcggaaaggcttgggaggaaggcgtctgcggtatccggagcgccacacgcctcgagaatattatgtggaagcagatatccaacgaactgaatcatatcttactggagaacgatatgaaattcaccgtggttgtgggcgacgcaaatgggattcttgctcagggaaagaaaatgatcagacctcaacccatggaacacaagtactcttggaaatcgtggggcaaggccaagattatcggggcggacatacagaacactacctttatcattgatggaccagacacacctgagtgtcccgatggccagagggcctggaatatctgggaggtcgaagactatggtttcggggtgtttactaccaacatttggttgaaactccgtgatagctacacacagatgtgcgaccaccggctgatgtccgctgcaatcaaggattcaaaagccgttcatgctgacatgggatattggatagagagtgaaaagaatgagacgtggaaactagcccgagcatctttcattgaagtgaagacctgtacttggccaaagagccacacactgtggtccaacggcgtactcgagtcagagatgatcattcccaaaatcttcggtggccctataagccaacataattacagaccagggtattttacccagactgcgggaccgtggcacctgggcaaacttgaattggatttcgacctgtgcgaggggacaaccgtcgtggtggatgaacactgcggaaacaggggcccctctttacgcacgactaccgtcacaggtaaaatcattcatgagtggtgttgccggtcctgtaccctccctccactgagatttagaggggaagacggatgctggtacggcatggaaatccgccccgttaaggagaaagaagagaatcttgtgcgaagtatggtaagcgccggttctggcgaagtggattccttctcactggggattttgtgtgtcagtatcatgatagaggaggtgatgcggagccgttggtcgagaaagatgctcatgactggaacactggctgtttttctactgctcattatgggccagctgacctggaacgaccttatcaggttgtgcatcatggtgggggccaatgcatccgaccgcatgggaacaggcactacctacctggctttaatggccacgttcaagatgcggcctatgtttgcagtcggtctcctgttcagaaggcttacatctcgagaagtgctgctactcaccattgggctgagcttggttgcctcagtggagctgccaaacagtttagaagaactcggagatggcctggctatgggcatcatgatgcttaaactgttgactgaatttcaaccccaccagctctggaccacactgctatccctgactttcgtcaagaccacgctttctctcgactatgcgtggaaaacaaccgccatggtactgagcattgtgtccttgtttccgctgtgtttatcaactacaagccagaagaccacttggctccctgttctgcttgggagtttcggatgcaaaccactgacaatgtttttgataaccgagaacaagatctggggtcgcaagtcttggcccctcaatgagggcattatggcaatcgggattgtgtccatcctgctaagctcgctgcttaaaaacgatgtccctctcgctggacccctgatagccggcggtatgttgatcgcctgttacgtgatttcagggtctagtgctgacttatccctggaaaaggcagccgaggtaagctgggaacaggaggcggaacattctggagctagccacaatatcctcgtggaggtccaagatgacggcacgatgaaaattaaggatgaggaacgggacgatactctgaccatccttctgaaagccacattgctagcagtttccggcgtgtatccaatgtcaatacctgccaccctgttcgtgtggtacttctggcagaagaaaaagcagagaagtggggtcctctgggacacacccagcccaccggaggtggaaagggctgttctggatgacggaatttatcgtatccttcagcgcggtttactgggccggtctcaagtaggggtgggagtctttcaggatggcgtgttccatactatgtggcacgttaccagaggtgcagtgctcatgtaccaggggaagaggttggagccttcctgggcctcagtcaaaaaggacctgatcagttatggaggcggctggcgatttcaggggagctggaacacgggagaggaagtgcaagtaattgcggtcgagcccggtaaaaatccaaagaacgtgcagacaactcccggcaccttcaaaacacctgaaggggaggttggagctatagccctcgactttaagccaggcacctccggttctcccatcgtgaatcgggaagggaagattgtcggactgtacggcaacggcgtggttactacctcggggacatacgtgagcgcaatcgcccaggctaaagcctcacaagagggacctcttccggagattgaagatgaggtcttcaagaaacgcaatctgacgatcatggacttgcacccaggttccggcaagactagaaggtatctacccgcaatagtgcgggaagctatcaaacgaaagctgagaaccctcattttagcccctacacgcgtagtggcgagtgagatggccgaagcactgaaggggatgccaatcaggtaccagaccactgctgttaaatctgagcatacaggacgtgagattgtcgatcttatgtgccacgccacctttacgatgcggctgctcagccccgtgagagtgcctaactataatatgatcataatggacgaagctcatttcactgatccggcatccattgccgccaggggctacatctcaacacgcgtcggtatgggggaggctgcggcaatctttatgaccgccacacccccaggatctgtagaggctttccctcagagcaacgccgtgattcaggacgaagaacgagatatccccgagagaagttggaactccggctatgactggataactgattttagcggcaagacagtttggttcgtgccatctattaaatcagggaacgacatcgcaaattgtttgcggaagaacggaaaaagggtcattcaactgtcccgcaagaccttcgatacagagtaccagaagactaaaaacaatgactgggactatgtggttacgaccgatatcagtgaaatgggtgccaactttcgtgctgacagagtgatagatcctcggaggtgcctcaagcccgtcattctgaaagacggcccagagcgcgtgatccttgcggggccgatgcctgtaacagtggccagcgcagctcagcgaagaggacggatcggcaggaatcagaacaaggaaggtgatcaatacgtttacatggggcagcccctaaataacgacgaggatcacgcccattggactgaggcaaaaatgctgttggacaatattaacaccccagaaggcatcattcccgccttattcgagcctgaacgcgagaagtcggctgccatagatggagaatatagactgaggggcgaggcgcggaagacatttgtcgagctcatgcgtcgcggggacctgccagtgtggctttcttacaaagtggcatccgaaggattccagtatagcgatcgaagatggtgctttgacggtgagaggaataaccaggtcctggaagagaatatggatgttgaaatctggaccaaggagggcgagcggaaaaagctccgccccagatggttggacgccaggacttactcagaccctctggctctacgggagttcaaagagtttgccgctgggcgaagaagtgtgtctggagatctgattctcgaaatcggcaaacttccgcaacacctgacgttacgcgcacagaacgccttggacaatctggtaatgctccacaactccgagcagggtgggaaggcttataggcatgccatggaggaactgccagataccatcgagacacttatgctgctcgcattgattgcggtgctgactggcggagtcaccttattctttctaagcggcaaggggctgggaaagacatcaataggtctcctttgtgtgaccgccagtagcgctctgttgtggatggcctccgttgaaccccactggatcgcagcttctattatcctggagttctttctcatggtgctgcttattcctgaacccgaccggcagcgtactccacaagataatcagctcgcctacgtcgtaatcggcctgttgttcatgatactgacagtggcagccaacgagatggggttactagagacgaccaaaaaggacctgggaatcggctatgttgctgcggaaaaccatcagcacgccactatgctcgatgtggaccttcaccctgcaagcgcttggacactgtacgccgtcgccaccaccgtgattacacccatgatgagacatactatcgagaatacgaccgcaaacatttccttgacagctatcgccaatcaagcggctatactgatgggtctcgataaagggtggccaatttcaaagatggacatcggcgtccctctgcttgccttaggatgctactctcaggtgaacccgctgactctcaccgcagccgttttgatgctggtggctcactatgcaattatcggccccgggctacaggccaaagcgacaagggaagctcagaagcgcaccgccgcaggaataatgaagaatccaactgtagatggcatcgtggccattgacctggatcctgtcgtttacgacgctaaatttgagaagcaactcggtcagatcatgcttctgattttgtgtacgagtcagatcctgctcatgcggacaacctgggccctgtgcgaatcgataactttagcaaccgggccccttacaactctgtgggagggaagcccaggcaaattctggaacaccacaattgctgtgtccatggccaatatcttccgaggttcttatctcgcgggcgccgggctagcattttcactgatgaaatccttgggaggcgggagaaggggaacgggcgctcagggtgagaccctgggggaaaaatggaagcgccaactcaaccagcttagcaagagtgagttcaatacttacaaacggtctggaatcatggaagtcgacagaagcgaggccaaggaaggcctgaaacgtggtgagacaaccaagcatgcagtgtcaaggggcactgctaaattgcggtggtttgtagagcgcaacctggtgaagcctgaagggaaggttattgatctcggatgtggccgagggggatggtcctattactgcgccggcctaaagaaggtgacagaggtcaaaggttataccaaagggggacccggccacgaggaaccgatcccaatggccacgtacggctggaatctggtgaaacttcatagtgggaaggacgtcttctttatgcctcccgaaaaatgtgataccctgctatgcgacataggagagagctctccaaaccccacaattgaggaaggtagaactctcagggtgctgaagatggttgagccttggttgcggggcaatcagttctgtatcaagattctgaacccgtacatgccctccgtagtggaaaccctcgagcagatgcaacgcaaacacgggggaatgcttgtcagaaatccactgtcaaggaacagcacacacgagatgtattgggtgtcgtgcggcactggtaatatcgtttctgcggtgaacatgaccagtcgaatgttactgaaccggtttacaatggctcatcgtaagcctacctacgaaagagatgtcgacttgggggcaggaactcgccacgtggccgtagagcccgaagtggctaatctcgatgttataggccagaggatcgagaacattaaaaatgaacataagtccacgtggcactatgacgaggataacccttacaaaacatgggcctatcacggcagctacgaggtcaagccatcagggtccgcatctagcatggtgaatggagtggtccggctgctaaccaagccctgggacgttatccctatggtgactcagattgccatgaccgatacaacgccattcggtcaacagagagtatttaaagaaaaggtggacacccgcactcccagggctaaacgaggcacaacccagatcatggaggtcactgcgaagtggctttgggggttcctgagtcggaacaaaaagccgagaatttgtacaagggaagagtttacccgcaaggtgcgttccaatgccgcaatcggagctgttttcgtggacgaaaaccagtggaatagcgccaaagaggcagtcgaggatgaacggttttgggacctcgtgcatagagagagggaactgcacaagcaaggcaaatgcgccacatgcgtatataacatgatgggtaagcgcgagaaaaagttgggggagttcggaaaggctaaaggctctcgagccatatggtacatgtggctgggcgcgcggttcctcgagtttgaggcacttgggttcatgaatgaagatcattggttttcaagagagaacagtctgtccggagttgaaggtgagggcttacacaagctggggtacattttgagggacatcagcaaaatccctggaggcaatatgtatgccgatgacactgctggttgggatacccgcattacggaggacgatctccagaacgaagccaagataaccgacatcatggagccagaacatgcactgctagctacatctattttcaaacttacttaccagaataaggtggtcagagtgcagcggcccgccaaaaacgggaccgtgatggatgtcatctcgaggcgtgaccaacgaggatcaggccaggttggcacatatgggctgaacacttttaccaatatggaggtgcagctcattcgccagatggaaagcgagggaatcttcctgccttccgagttggaaacgccaaacttagctgagagagccctggattggctcgaaaagcacggtgcagagcggcttaagaggatggcgataagtggcgacgactgtgtagtgaaacccatcgatgaccgctttgccacagctctgaccgccctaaatgatatggggaaggtcagaaaagacattccgcaatgggaaccttctaagggatggaacgattggcaacaggtgcccttctgcagccaccattttcaccagctgatcatgaaagacggccgggagattgttgtgccatgtaggaatcaagatgagctcgtcggtcgagcacgtgtgtcccagggggctggatggtcattgagagaaactgcctgcctgggcaagagttacgcacagatgtggcaacttatgtatttccatcgccgggacctgaggctcgccgcgaacgctatctgttctgccgtacctgttgattgggtgcccgcaagcagaacaacctggtccatacacgcccaccatcagtggatgactaccgaggacatgttatcagtctggaatcgcgtgtggattgaagagaacccatggatggaagataagacacacgttagctcttgggaggaggtgccctacctgggcaaacgggaagaccagtggtgcgggtccttgatcggactgacggctagggccacctgggcaactaatatccaggtcgctattaaccaagtgcgaagactcataggtaatgagaactatcttgactacatgacaagtatgaagcggtttaaaaatgaaagcgatcctgagggcgccctgtggtga

SEQ ID NO: 14130 - RNA, 9879 nt, synthetic construct
  misc_feature 1..9879: note = derived and/or modified CDS sequence (opt3) from DENV-1__KC692499__SS-prME
  source 1..9879: mol_type = other RNA
agcgtgaccatgctgctcatgcttctgcccaccgccttggctttccacttaactacgaggggcggggagcctcatatgatcgtctccaagcaggaaaggggaaaatctctgctatttaagacctcagctggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaatagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgttaactttgtgtgccgccgaacattcgtagatagaggctggggtaatgggtgtggattgtttggcaaaggcagcctcctgacttgcgcaaagttcaagtgcgtgaccaaattagaagggaagatagtccagtacgagaacctgaaatattccgtgattgttacagtgcacaccggagaccagcatcaagtcggtaatgaaactacggagcacggcacaatcgctaccattactccccaggcccctacctcagaaatccagctcacagattacggggcgcttaccctggactgtagtccaaggactggattggactttaacgagatggtgctactgacaatgaaggagaaaagctggctcgtacataagcagtggttcctggatcttccgctgccctggacgtctggcgcctccacctcacaagaaacttggaatcggcaggacttgctcgttacatttaaaaccgcacacgctaagaagcaggaggtggtcgtgctgggtagccaagaaggggccatgcacacagctttaactggcgccaccgagatccagacgagtggaaccacaactattttcgcaggccatctgaaatgccgtctaaagatggataaactcaccctgaaggggatgtcttatgtcatgtgtacaggatccttcaaacttgaaaaggaggtggccgagactcagcacggtaccgttttggtgcaggtaaagtacgaaggcacggacgctccttgcaaaataccatttagcacacaagatgagaagggggtcacccagaacggacgcctgatcactgcgaatcccattgtgacagacaaagaaaagcctgttaacatcgagaccgagccacccttcggcgaatcgtatatagtggtcggtgcaggggagaaagccctcaagctgtcttggtttaagagaggctcctcaattggaaaaatgttcgaagctactgccaggggcgcacggcgaatggccatccttggggataccgcttgggactttggaagtatcggtggcgtgttcacaagcgtagggaagctggtgcatcaggtttttggaacggcctacggcgtcttgttctccggtgtgtcttggaccatgaaaattgggatcggcattctcctgacttggttaggactgaatagccgctcaacaagtctatccatgacctgtatagcagtgggcatggtcacactctacctgggggttatggtgcaggcggatagcggatgcgtgatcaactggaagggcagagagcttaaatgtggttctgggatttttgtaactaacgaagtccacacctggacggagcaatataagttccaggctgactcaccgaagaggttgagtgccgcaatcggaaaagcctgggaggaaggcgtgtgcggtatccggagcgctacacgcctggagaatattatgtggaagcagatatccaacgaactcaatcatatcctgttagagaacgatatgaaatttaccgttgtggtcggcgacgccaatgggattctggcacagggaaagaaaatgatcagacctcaacccatggaatacaagtattcttggaaatcgtggggcaaggctaagattatcggggccgacatacagaacactaccttcatcattgatggaccagacacacctgagtgtcccgatggccagagggcgtggaatatctgggaggtggaagactacggttttggggttttcactaccaacatttggcttaaattgcgtgatagctatacacagatgtgcgaccaccggctcatgtccgccgctatcaaggattcaaaagcagtgcacgccgacatgggatactggatagagagtgaaaagaatgagacgtggaaactggctcgagcctctttcattgaagtaaagacctgtacttggccaaagagccatacactatggtccaacggcgtcctggagtcagagatgatcattcccaaaatctttggtggccctataagccaacacaattatagaccagggtacttcacccagactgcaggaccgtggcatctcggcaagctggaacttgattttgacttgtgcgaggggacaaccgtggtggtcgatgaacactgcggaaacaggggcccctctctgcgcacgactaccgttacaggtaaaatcattcacgagtggtgttgccggtcctgtaccttacctccactcagattcagaggggaagacggatgctggtacggcatggaaatccgccccgtgaaggagaaagaagagaatctggtacgaagtatggtgagcgcgggttctggcgaagtcgattccttttcacttgggattctgtgtgtgagtatcatgatagaggaggttatgcggagccgttggtcgagaaagatgttgatgactggaacactcgccgtgttcctgctactgattatgggccagctcacctggaacgacctgatcaggctttgcatcatggtcggggctaatgcctccgaccgcatgggaatgggcacaacttatttggcactgatggctacctttaagatgcggcctatgttcgccgtgggtttactctttagaaggctgacgtctcgagaagttcttctgctaacaattgggctcagcctggtggcatcagtcgagttgccaaacagtctggaagagttaggagatggcctcgccatgggcatcatgatgctgaaacttctgaccgagttccaaccccatcagttgtggactaccctcctgtccctaacatttgtaaagactaccctgtctcttgactacgcttggaaaacgacagcgatggtgctcagcattgtttccctgttcccgttgtgtctgtcaaccactagccagaagacaacctggttacctgtgctcctggggagttttggatgcaaaccacttactatgttcctgataacagagaacaagatctggggtcgcaagtcttggcccttgaatgagggcattatggccatcgggattgtctccatcctcctgagctcgctactgaaaaacgatgtgcctcttgcaggacccctcatagctggcggtatgctgatcgcctgttatgtaatttcagggtctagtgccgacttgtccttagaaaaggctgcagaggtgagctgggaacaggaggccgaacactctggagcgagccataatatcctggtcgaggttcaagatgacggcaccatgaaaattaaggatgaggaacgggacgatacgctcactatcctgcttaaagctaccctgttggccgtgtccggcgtgtacccaatgtcaatacctgcaacactattcgtctggtatttttggcagaagaaaaagcagagaagtggggtgctgtgggacacccccagcccaccggaggttgaaagggccgtactcgatgacggaatttaccgtatcctgcagcgcggtcttttaggccggtctcaagtgggggtcggagtgttccaggatggcgtttttcacacaatgtggcatgtgactagaggtgctgtcctgatgtatcaggggaagaggctcgagccttcctgggcatcagtgaaaaaggacttgatcagttacggaggcggctggcgattccaggggagctggaacaccggagaggaagtacaagtcattgccgtggagcccggtaaaaatccaaagaacgttcagacgacacccggcacttttaaaacccctgaaggggaggtgggagcgatagctctggacttcaagccaggcacatccggttctcccatcgtcaatcgggaagggaagattgtgggactctacggcaacggcgttgtgaccacttcggggacctatgtcagcgccatcgcacaggccaaggcttcacaagagggacctctgccggagattgaagatgaggtgtttaagaaacgcaatcttacaatcatggacctgcacccaggttccggcaagacgagaaggtacttgcccgccatagtacgggaagcaatcaaacgaaagctaagaactctgattctcgctcctacccgcgtggttgccagtgagatggcggaagccttaaaggggatgccaatcaggtatcagacaaccgcagtcaaatctgagcacactggacgtgagattgtggatctgatgtgccatgctacattcaccatgcggcttctgagccccgtgagagtccctaactacaatatgatcataatggacgaagcccactttacggatccggcttccattgcagccaggggctatatctcaactcgcgtaggtatgggggaggccgctgcgatcttcatgacagcaacacccccaggatctgtggaagcctttcctcagagcaacgctgttattcaggacgaggaacgagatatccccgagagaagttggaactccggctacgactggatagccgatttcccaggcaagaccgtgtggttcgtccctagcattaaatctgggaacgacatcgcaaattgtctccggaagaacggaaaaagggtgattcaattgtcacgcaagacttttgatacagagtatcagaagaccaaaaacaatgactgggactacgttgtgacaactgatatctccgaaatgggtgccaacttccgtgctgacagagtcatagatccccggaggtgcctgaagccagtgattctcaaagacggcccggagcgcgtaatcctggcggggcctatgcccgtgacggttgccagtgcagctcagcgaagaggacggatcggcaggaatcagaacaaggaaggtgatcaatacgtctatatggggcagccacttaataacgacgaggatcatgcccactggaccgaggcaaaaatgctactggacaatattaacacacccgaaggcatcattcctgccttgtttgagccagaacgcgagaaaagcgctgccatagatggagaatacagattaaggggcgaagcgcggaagactttcgtggagctgatgcgtcgcggggacctccccgtgtggctgtcgtataaagtcgcatctgaaggatttcagtactccgatcgaagatggtgcttcgacggtgagaggaataaccaggttcttgaagagaatatggatgtggaaatctggaccaaggagggcgagcggaaaaagctgcgccctagatggctcgacgccaggacatatagcgacccgttggctctgcgggaatttaaagagttcgccgctgggcgaagatcagtaagtggagatctaattctggaaatcggcaagctcccacaacatcttaccctgcgcgcacagaacgccttagacaatttggtgatgctgcacaactctgagcagggtgggaaggcttacaggcacgccatggaggaactccccgatactatcgagacgctgatgcttctggcactcattgcggtcttgaccggcggagtgacactgtttttcttatccggcaaggggctaggaaagactagcataggtctgctctgtgttaccgcctcaagtgcacttctgtggatggccagcgtggaacctcattggatcgcagcttccattatcttggagtttttcctgatggtcctcctgattcccgaaccagaccggcagcgtacacctcaagataatcagcttgcctatgtagtgatcggcctcctgtttatgatattgaccgttgcagccaacgagatggggctgttagagactaccaaaaaggacctaggaatcggctacgtggctgcggaaaaccaccagcatgccacgatgctggatgtcgacctccaccccgcatctgcttggaccctttacgccgtggccactacagtcattaccccaatgatgagacacaccatcgagaatacaactgcaaacattagcctgacggctatcgccaatcaagcggctatattgatgggtctggataaagggtggcctatttccaagatggacatcggcgtgccgctcctggcccttggatgctattcacaggttaaccccttaaccctgacagcagccgtgctcatgttggtagctcattacgcaattatcggcccagggctgcaggccaaagcgactagggaagctcagaagcgcaccgccgcaggaataatgaagaatcctacagtggatggcatcgtcgccattgacctagatcccgttgtgtatgacgctaaattcgagaagcaactgggtcagatcatgctccttattctgtgtacctctcagatcttgctgatgcggactacgtgggccctctgcgaaagtataacactggcaaccgggccattaactaccctttgggagggatcgcctggcaaattctggaacacaactattgctgtcagcatggccaatatctttcgaggttcctacctggcgggcgccgggctcgcattctctctaatgaagtcactgggaggcgggagaaggggaaccggcgctcagggtgagacattgggggaaaaatggaagcgccaactgaaccagctcagcaagtccgagtttaatacgtataaacggagtggaatcatggaagtggacagatctgaggccaaggaaggccttaaacgtggtgagaccactaagcacgcagtaagcaggggcacagctaaactgcggtggttcgtggagcgcaacttggttaagcccgaagggaaggtgattgatctgggatgtggccgagggggatggtcatactattgcgccggcctcaaaaaggtcaccgaggtgaaaggttacactaaagggggaccgggccatgaggaaccaatccctatggccacatacggctggaatttagtcaaactgcactccgggaaggacgtgtttttcatgcccccagaaaaatgtgatacccttctgtgcgacataggagagagtagccccaaccctacgattgaggaaggtagaaccctaagggttctcaagatggtagagccgtggctgcggggcaatcagttttgtatcaagattttgaacccctatatgccatctgtggtcgaaacactggagcagatgcaacgcaaacatgggggaatgctcgtgagaaatcctctttccaggaactcaactcacgagatgtactgggttagctgcggcaccggtaatatcgtgtcggcggtcaacatgacatctcgaatgctgttaaaccggttcactatggctcaccgtaagcccacctatgaaagagatgtggacctgggggcaggaacacgccatgtagccgtggagcctgaagttgctaatttggatataatcggccagaggattgagaacatcaaaaatgaacacaagagtacctggcattacgacgaggataacccatataaaacttgggcctaccacggctcctatgaggtcaagcccagcgggtcagcatcctctatggtgaatggagtggtccggctcctgacgaagccttgggacgttattccaatggtgacacagatcgccatgaccgatactaccccctttggtcaacagagagtattcaaagaaaaggtggacacacgcacgccgagggctaaacgaggcaccactcagattatggaggtcacagcgaagtggctatgggggtttcttagccggaacaaaaagcctagaatctgtaccagggaagagttcactcgcaaggtgcgtagtaatgccgcaataggagctgtttttgtggacgaaaaccagtggaactccgccaaagaggcagtcgaggatgaacggttctgggacctggtgcacagagagagggaactccataagcaaggcaaatgcgccacatgcgtatacaacatgatgggtaagcgcgagaaaaagctgggggagttcggaaaggctaaaggcagccgagccatttggtacatgtggttgggcgcgcggtttctggagttcgaggcactcgggtttatgaatgaagatcactggttctctagagagaactcacttagtggagttgaaggtgagggcctgcataagttagggtatatcctgagggacatctccaaaattccaggaggcaatatgtacgccgatgacaccgctggttgggatacacgcataactgaggacgatttgcagaacgaagccaagatcaccgacattatggagcccgaacacgcactcctggctacgagcatctttaaactaacctatcagaataaggtggtcagagtgcagcggcctgccaaaaacgggacagtgatggatgtcatttctaggcgtgaccaacgaggatcgggccaggttggcacttacgggcttaacaccttcacaaatatggaggtgcagctgatccgccagatggaatcagagggaatatttctcccaagcgagctggaaactcccaacttggctgagagagccttagattggctggaaaagcatggtgcagagcggctcaagaggatggcgatctccggcgacgactgtgtagtgaaaccgattgatgaccgcttcgccaccgctcttacggccctgaatgatatggggaaggtcagaaaagacatccctcaatgggaacccagtaagggatggaacgattggcaacaggtgccattttgctctcaccacttccatcagctaattatgaaagacggccgggagatcgttgtgccttgtaggaatcaagatgagctggtcggtcgagcacgtgtgagccagggggctggatggtccctcagagaaacagcctgcttgggcaagtcatatgcacagatgtggcaactgatgtactttcaccgccgggaccttaggctggccgcgaacgctatatgtagtgccgtacccgttgattgggtgccagcatctagaaccacttggagcattcatgcccaccaccagtggatgacaaccgaggacatgctctccgtctggaatcgcgtgtggatcgaagagaacccctggatggaagataagactcatgtttcaagctgggaggaggtgccttatttaggcaaacgggaagaccagtggtgcgggtctctgatcggattgaccgctagggccacatgggcaacgaatattcaggtcgctataaaccaagtgcgaagactgatcggtaatgagaactacctcgactacatgacctccatgaagcggttcaaaaatgaaagtgatccagagggcgccctttggtga

SEQ ID NO: 14131 - RNA, 9879 nt, synthetic construct
  misc_feature 1..9879: note = derived and/or modified CDS sequence (opt3) from DENV-1__KC692500__SS-prME
  source 1..9879: mol_type = other RNA
agcgtgaccatgctgctcatgcttctgcccacagccttggctttccacttaactacgaggggaggggaacctcatatgatcgtctccaaacaggaaaggggaaaatctctgctatttaagacctcagctggtgttaatatgtgcacactcattgccatggacctgggagaactttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagggacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaagggcaaaagctggctcgtgcataagcagtggttcctggatcttccgctgccctggacgtctggtgcatccacctcacaagagacttggaatcggcaggacttgctcgtaacatttaaaaccgctcacgccaagaagcaggaagttgtggtcctggggagccaagagggcgctatgcacacagccttaactggagcaaccgaaatccagacgagtggcaccacaactattttcgccgggcatctgaaatgccgtctaaagatggataaactcaccctgaagggaatgtcttatgtgatgtgtacaggttccttcaaacttgagaaggaagtcgctgagactcagcacggcaccgtgttggttcaggtgaagtacgaggggacggacgcgccttgcaaaataccatttagcacacaagatgaaaagggagtaacccagaacggccgcctgatcactgcaaatcccattgtcacagacaaagagaagcctgtgaacatcgaaaccgagccacccttcggtgagtcgtatatagttgtgggggccggcgaaaaagctctcaagctgtcttggtttaagagaggatcctcaattggcaaaatgttcgaggccactgcaagaggggcccggcgaatggctatccttggagataccgcctgggactttggtagtatcggcggggtcttcacaagcgtgggaaagctggtacatcaggtgtttggcacggcatacggtgttttgttctccggggtctcttggaccatgaaaattggcatcggcattctcctgacttggttaggcctgaatagccgctcaacaagtctatccatgacctgtatagcggtggggatggtgacactctacctgggagtcatggttcaggctgatagcggctgcgtgatcaactggaagggtagagaacttaaatgtgggtctggaatttttgtgactaacgaggtacacacctggacggaacaatataagttccaggccgactcaccgaagaggttgagtgcagccatcggcaaggcttgggaggagggtgtctgcggcatccggagcgccacacgcctggaaaatattatgtggaagcagatatccaacgagctcaatcatatcctgttagaaaacgatatgaaatttaccgtggttgtgggggacgcaaatggcattctggctcagggcaagaaaatgatcagacctcaacccatggagcacaagtactcttggaaatcgtgggggaaggccaagattatcggagcggacatacagaacactaccttcatcattgatggcccagacacacctgaatgtcccgatggtcagagggcctggaatatctgggaggtcgaggactatgggtttggagtgttcactaccaacatttggcttaaattgcgtgatagctacacacagatgtgcgaccaccggctcatgtccgctgcaatcaaggattcaaaagccgttcatgctgacatgggctattggatagaaagtgagaagaatgaaacgtggaaactggcccgagcatctttcattgaggtgaagacctgtacttggccaaagagccacacactatggtccaacggtgtactggaatcagagatgatcattcccaaaatctttggcgggcctataagccaacataattacagaccaggatatttcacccagactgcgggcccgtggcacctcgggaagctggagcttgattttgacttgtgcgaaggaacaaccgtcgtggtggatgagcactgcggcaacaggggtccctctctgcgcacgactaccgtcacagggaaaatcattcatgaatggtgttgccggtcctgtaccttacctccactcagattcaggggagaggacggctgctggtacggtatggagatccgccccgttaaggaaaaagaggaaaatctggtgcgaagtatggtaagcgccggctctggggaggtggattccttttcacttggcattctgtgtgtcagtatcatgatagaagaggtgatgcggagccgttggtcgagaaagatgttgatgactggcacactcgctgttttcctgctactgattatggggcagctcacctggaacgacctgatcaggctttgcatcatggtgggagccaatgcatccgaccgcatgggcatgggtacaacttacttggctctgatggccacctttaagatgcggcctatgttcgcagtcgggttactctttagaaggctgacgtctcgagaggtgcttctgctaacaattggactcagcctggttgcctcagtggaattgccaaacagtctggaggaattaggcgatggcctcgctatggggatcatgatgctgaaacttctgaccgagttccaaccccaccagttgtggactaccctcctgtccctaacatttgtcaagactaccctgtctcttgactatgcgtggaaaacgacagccatggtactcagcattgtgtccctgttcccgttgtgtctgtcaaccactagccagaagacaacctggttacctgttctcctgggaagttttggttgcaaaccacttactatgttcctgataacagaaaacaagatctggggccgcaagtcttggcccttgaatgaggggattatggcaatcggaattgtgtccatcctcctgagctcgctactgaaaaacgatgtccctcttgctggccccctcatagccggtgggatgctgatcgcctgttacgtgatttcaggatctagtgctgacttgtccttagagaaggcagccgaagtaagctgggagcaggaagcggagcattctggcgctagccacaatatcctggtggaagtccaagatgacggcaccatgaaaattaaggatgaggagcgggacgatacgctcactatcctgcttaaagccaccctgttggcagtttccggggtgtatccaatgtcaatacctgccacactattcgtgtggtacttttggcagaagaaaaagcagagaagtggagtcctgtgggacacccccagcccaccggaagtggagagggctgttctcgatgacggtatttatcgtatcctgcagcgcggccttttagggcggtctcaagtaggagtgggcgtcttccaggatggtgtgtttcatacaatgtggcacgttactagaggggcagtgctgatgtaccagggaaagaggctcgaaccttcctgggcctcagtcaaaaaggacttgatcagttatggcggcgggtggcgattcaaaggaagctggaacaccggtgaggaggtgcaggtaattgcggtcgaacccggcaagaatcccaaaaatgtgcaaacgacacccgggacttttaagacccctgagggagaagttggcgctatagccctggacttcaagccaggtacatccgggtctcccatcgtgaatcgggagggaaaaattgtcggcctctacggcaacggggtggttaccacttcgggaacctacgtgagcgcaatcgcccaggctaaggcctcacaggaaggtcctctgccggagattgaggatgaagtctttaaaaagcgcaatcttacaatcatggacctgcacccaggctccgggaaaacgagaaggtatttgcccgcaatagtgcgggaggctatcaagcgaaagctaagaactctgattctcgcccctacccgcgtagtggcgagtgaaatggccgaggcattaaaaggaatgccaatcaggtaccaaacaaccgctgttaagtctgaacatactggccgtgagattgtcgatctgatgtgccacgccacattcaccatgcggcttctgagccccgtgagagtgcctaactataatatgatcataatggacgaggctcattttacggatccggcatccattgccgccaggggttacatctcaactcgcgtcgggatgggagaagctgcggcaatcttcatgacagccacaccaccaggctctgtagaggcttttcctcagagcaacgccgtgattcaggacgaagaacgagatatccccgaaagaagttggaactccggctatgactggataaccgatttcccagggaaaactgtttggttcgtgcctagcattaagtctggaaacgacatcgcaaattgtctccggaaaaacggtaagagggtcattcagttgtcacgcaagacatttgataccgagtaccagaaaaccaagaacaatgactgggactatgtggttactacggatatctccgagatgggcgccaacttccgtgctgacagagtgatagatccccggaggtgcctgaaaccagtcattctcaaggacgggccggaacgcgtgatcctggcgggacctatgcccgtaaccgtggccagtgcagctcagcgaagaggccggatcggtaggaatcagaacaaagagggggatcagtacgtttacatgggccaaccacttaataacgacgaagatcacgcccattggacagaggcaaagatgctactggacaatattaacactcccgagggaatcattcctgccttgtttgaaccagagcgcgaaaagagcgctgccatagatggcgagtatagattaagaggggaagcgcggaaaaccttcgtcgagctgatgcgtcgcggagacctccccgtgtggctgtcgtacaaggtggcatctgagggttttcagtattccgatcgaagatggtgcttcgacggcgaaaggaataaccaggtccttgaggaaaatatggatgttgagatctggacaaaagaaggggagcggaagaaactgcgccctagatggctcgacgccaggacctacagcgacccgttggctctgcgggagtttaaggagttcgccgctggacgaagatcagtgagtggcgatctaattctggagatcggtaaactcccacagcaccttactctgcgcgcacaaaacgccttagacaatttggtaatgctgcacaactctgaacaagggggaaaggcttataggcatgccatggaggaactccccgatacgatcgagaccctgatgcttctggcactcattgcggtgttgacaggaggcgtcactctgtttttcttatccgggaagggactaggtaaaaccagcataggcctgctctgtgtgacagcctcaagtgcacttctgtggatggccagcgttgagcctcactggatcgcagcttccattatcttggaatttttcctgatggtgctcctgattcccgagccagaccggcagcgtacccctcaggataatcaacttgcctacgtcgtaatcgggctcctgtttatgatattgactgtggcagccaacgaaatgggactgttagagacaacgaagaaagacctaggcatcggttatgttgctgcggagaaccatcagcacgccaccatgctggatgtggacctccaccccgcatctgcttggactctttacgccgtcgccacaaccgtgattaccccaatgatgagacatacaatcgaaaatactacggcaaacattagcctgaccgctatcgccaatcaggcggctatattgatggggctggataagggctggcctatttccaaaatggacatcggagtcccgctcctggcccttggctgctactcacaagtgaaccccttaacactgactgcagccgttctcatgttggtggctcactatgcaattatcgggccaggactgcaggccaaggcgaccagggaggctcagaagcgcacagccgcaggcataatgaaaaatcctaccgtagatggtatcgtggccattgacctagatcccgtcgtttacgacgctaagttcgaaaaacagctggggcaaatcatgctccttattctgtgtacttctcagatcttgctgatgcggacgacatgggccctctgcgagagtataaccctggcaactggaccattaaccacactttgggaaggctcgcctggtaagttctggaacactaccattgctgtgagcatggccaatatctttcgaggctcctatctggcgggggccggactcgcattctctctaatgaaatcactgggcgggggaagaaggggcacaggtgctcagggggagacgttgggagagaagtggaagcgccagctgaaccaactcagcaaatccgaatttaatacctacaagcggagtggcatcatggaggtcgacagatctgaagccaaagagggtcttaagcgtggcgaaactacaaaacatgcagtgagcagggggaccgctaagctgcggtggttcgtagagcgcaacttggtgaagcccgagggaaaagttattgatctgggctgtgggcgaggaggctggtcatattactgcgccggtctcaagaaagtgactgaagtcaaggggtatacaaaaggaggcccgggccacgaggaaccaatccctatggccacctacgggtggaatttagtgaagctgcattccggaaaagacgtctttttcatgcccccagagaagtgtgatacgcttctgtgcgacataggtgaaagtagccccaaccctaccattgaggagggcagaacactaagggtgctcaagatggttgaaccgtggctgcgggggaatcagttttgtatcaaaattttgaacccctacatgccatctgtagtggagactctggaacagatgcagcgcaagcacggaggcatgctcgtcagaaatcctctttccaggaactcaacccacgagatgtattgggtgagctgcggtacagggaatatcgtttcggcggtgaacatgacttctcgaatgctgttaaaccggttcaccatggctcatcgtaaacccacatacgagagagatgtcgacctgggagcaggcacccgccacgtggccgtagaacctgaggtggctaatttggatataatcggccaaaggattgaaaacatcaagaatgagcataaaagtacttggcactatgacgaagataacccatacaagacgtgggcctatcacgggtcctacgaggttaagcccagcggatcagcatcctctatggtcaatggtgtggtgcggctcctgacaaaaccttgggacgtcattccaatggttacccagatcgccatgactgataccacaccctttggccagcaaagagtgttcaaggagaaagtagacacgcgcaccccgagggctaagcgagggactacacagattatggaagtgaccgcgaaatggctatggggatttcttagccggaacaagaagcctagaatctgtactagggaggagttcacacgcaaagtccgtagtaatgccgcaataggcgctgtgtttgttgacgagaaccagtggaactccgccaaggaagcagtggaggatgagcggttctgggacctggtccatagagaaagggagctccacaaacagggtaagtgcgcaacctgcgtgtataacatgatggggaaacgcgaaaagaagctgggagagttcggcaaagctaagggcagccgagccatttggtacatgtggttgggggcgcggtttctggagttcgaggcactcggatttatgaatgaggatcattggttctctagagaaaactcacttagtggtgtagagggcgaagggctgcacaaattaggatacatcctgagggacatctccaagattccaggcggtaatatgtatgccgatgacacagctgggtgggatactcgcataaccgaggacgatttgcaaaacgaggccaaaatcacggacattatggaacccgagcatgcactcctggctaccagcatctttaagctaacataccagaataaagttgtgagagtccagcggcctgccaagaacggaactgtgatggatgtgatttctaggcgtgaccagcgaggctcgggccaagtcgggacctatggacttaacacattcactaatatggaagttcagctgatccgccagatggagtcagaaggtatatttctcccaagcgagctggagacccccaacttggctgaaagagccttagattggctggagaagcacggcgcagaacggctcaaaaggatggcgatctccggggacgactgtgtggtaaagccgattgatgaccgcttcgccacggctcttacagccctgaatgatatgggaaaagtgagaaaggacatccctcagtgggagcccagtaaaggctggaacgattggcaacaggtcccattttgctctcaccatttccaccagctaattatgaaggacggtcgggaaatcgtggttccttgtaggaatcaggatgagctggtggggcgagcacgtgtcagccaaggagctggctggtccctcagagagaccgcctgcttgggcaagtcatacgcacagatgtggcagctgatgtattttcatcgccgggaccttaggctggccgcgaacgctatatgtagtgccgtgcccgtagattgggttccagcatctagaactacatggagcattcacgcccaccatcaatggatgaccactgaagacatgctctccgtgtggaatcgcgtctggatcgaggaaaacccctggatggaggataaaacccacgtgtcaagctgggaagaggttccttacttagggaagcgggaggaccagtggtgcggatctctgatcggtttgacagctagggccacgtgggcaaccaatattcaggtggctataaaccaggtccgaagactgatcggcaatgaaaactatctcgactacatgacttccatgaaacggttcaagaatgagagtgatccagaaggggccctttggtga

SEQ ID NO: 14132 - RNA, 9879 nt, synthetic construct
  misc_feature 1..9879: note = derived and/or modified CDS sequence (opt3) from DENV-1__KC692501__SS-prME
  source 1..9879: mol_type = other RNA
agcgtgaccatgctgctcatgcttctgcccaccgccttggctttccacttaactacgagaggcggggaacctcatatgatcgtctccaaacaggaaaggggaaaatctctgctgtttaagacctcagctggtgttaatatgtgcacactcattgccatggacctgggcgaactttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctttggtggccctataagccaacataattacagaccagggtatttcacccagactgcgggaccgtggcacctcggcaagctggaacttgattttgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagattccgcggggaagacggatgctggtacggcatggaaatcaggcccgttaaggagaaagaagagaatctggtgcgaagtatggtaagcgccggttctggcgaagtggattccttttcacttgggattctgtgtgtcagtatcatgatagaggaggtgatgcggagccgttggtcgagaaagatgttgatgactggaacactcgctgttttcctgctactgattatgggccagctcacctggaacgacctgatcaggctttgcatcatggtgggggccaatgcatccgaccgcatgggaatgggcacaacttacttggctctgatggccacctttaagatgcggcctatgttcgcagtcggtttactctttagaaggctgacgtctcgagaagtgcttctgctaacaattgggctcagcctggttgcctcagtggagttgccaaacagtctggaagagttaggagatggcctcgctatgggcatcatgatgctgaaacttctgaccgagttccaaccccaccagttgtggactaccctcctgtccctaacatttgtcaagactaccctgtctcttgactatgcgtggaaaacgacagccatggtactcagcattgtgtccctgttcccgttgtgtctgtcaaccactagccagaagacaacctggttacctgttctcctggggagttttggatgcaaaccacttactatgttcctgataacagagaacaagatctggggtcgcaagtcttggcccttgaatgagggcattatggcaatcgggattgtgtccatcctcctgagctcgctactgaaaaacgatgtccctcttgctggacccctcatagccggcggtatgctgatcgcctgttacgtgatttcagggtctagtgctgacttgtccttagaaaaggcagccgaggtaagctgggaacaggaggcggaacattctggagctagccacaatatcctggtggaggtccaagatgacggcaccatgaaaattaaggatgaggaacgggacgatacgctcactatcctgcttaaagccaccctgttggcagtttccggcgtgtatccaatgtcaatacctgccacactattcgtgtggtacttttggcagaagaaaaagcagagaagtggggtcctgtgggacacccccagcccaccggaggtggaaagggctgttctcgatgacggaatttatcgtatcctgcagcgcggtcttttaggccggtctcaagtaggggtgggagtcttccaggatggcgtgtttcatacaatgtggcacgttactagaggtgcagtgctgatgtaccaggggaagaggctcgagccttcctgggcctcagtcaaaaaggacttgatcagttatggaggcggctggcgattccaggggagctggaacaccggagaggaagtgcaagtaattgcggtcgagcccggtaaaaatccaaagaacgtgcagacgacacccggcacttttaaaacccctgaaggggaggttggagctatagccctggacttcaagccaggcacatccggttctcccatcgtgaatcgggaagagaagattgtcgggctctacggaaacggcgtggttaccacttcgggcacctacgtgagcgcaatcgcccaggctaaagcctcacaagaggggcctctgccggaaattgaggatgaagtctttaagaaacgcaatcttacaatcatggacctgcacccaggatccggtaagacgagaaggtatttgcccgcaatagtgcgggaggctatcaaacgaaagctaagaactctgattctcgcccctacccgcgtagtggcgagtgaaatggccgaggcattaaagggcatgccaatcaggtaccagacaaccgctgttaaatctgagcatactgggcgtgaaattgtcgatctgatgtgccacgccacattcaccatgcggcttctgagccccgtgagagtgcctaactataatatgatcataatggacgaggctcattttacggatccggcatccattgccgccaggggatacatctcaactcgcgtcggcatgggtgaagctgcggcaatcttcatgacagccacacccccagggtctgtagaggcttttcctcagagcaacgccgtgattcaggacgaagaacgagatatccccgagagaagttggaactccggatatgactggataaccgatttcccaggcaagactgtttggttcgtgcctagcattaaatctggcaacgacatcgcaaattgtctccggaagaacgggaaaagggtcattcaattgtcacgcaagacatttgataccgaataccagaagaccaaaaataatgactgggactatgtggttactacggatatctccgagatgggagccaacttccgtgctgacagagtgatagatccccggaggtgcctgaagccagtcattctcaaagacggtccggaacgcgtgatcctggcgggccctatgcccgtaaccgtggccagtgcagctcagcgaagagggcggatcggaaggaatcagaacaaggagggcgatcaatacgtttacatgggtcagccacttaataacgacgaggatcacgcccattggacagaagcaaaaatgctactggacaatattaacactcccgaggggatcattcctgccttgtttgaaccagagcgcgaaaagagcgctgccatagatggcgagtatagattaaggggagaggcgcggaagaccttcgtcgaactgatgcgtcgcggcgacctccccgtgtggctgtcgtacaaagtggcatctgaggggtttcagtattccgatcgaagatggtgcttcgacggagaaaggaataaccaggtccttgaggaaaatatggatgttgagatctggacaaaggagggtgaacggaaaaagctgcgccctagatggctcgacgccaggacctacagcgacccgttggctctgcgggagtttaaagagttcgccgctggccgaagatcagtgagtggggatctaattctggagatcggaaagctcccacaacaccttactctgcgcgcacagaacgccttagacaatttggtaatgctgcacaactctgaacagggcggtaaggcttataggcatgccatggaggagctccccgatacgatcgaaaccctgatgcttctggcactcattgcggtgttgacagggggcgtcactctgtttttcttatccggaaagggcctagggaagaccagcataggactgctctgtgtgacagcctcaagtgcacttctgtggatggccagcgttgagcctcactggatcgcagcttccattatcttggaatttttcctgatggtgctcctgattcccgagccagaccggcagcgtacccctcaagataatcagcttgcctacgtcgtaatcggtctcctgtttatgatattgactgtggcagccaacgagatgggcctgttagaaacaacgaaaaaggacctagggatcggatatgttgctgcggagaaccatcagcacgccaccatgctggatgtggacctccaccccgcatctgcttggactctttacgccgtcgccacaaccgtgattaccccaatgatgagacatacaatcgaaaatactacggcaaacattagcctgaccgctatcgccaatcaagcggctatattgatgggcctggataaaggttggcctatttccaagatggacatcggggtcccgctcctggcccttggctgctactcacaggtgaaccccttaacactgactgcagccgttctcatgttggtggctcactatgcaattatcggaccaggcctgcaggccaaagcgaccagggaggctcagaagcgcacagccgcagggataatgaagaatcctaccgtagatggaatcgtggccattgacctagatcccgtcgtttacgacgctaaattcgaaaagcaactgggccagatcatgctccttattctgtgtacttctcagatcttgctgatgcggacgacatgggccctctgcgagagtataaccctggcaactggtccattaaccacactttgggaggggtcgcctggaaaattctggaacactaccattgctgtgagcatggccaatatctttcgaggctcctatctggcgggtgccggcctcgcattctctctaatgaagtcactagggggaggcagaagggggacaggagctcagggcgaaacgttgggtgagaaatggaagcgccaactgaaccagctcagcaagtccgaatttaatacctacaaacggagtgggatcatggaggtcgacagatctgaagccaaggagggacttaaacgtggcgagactacaaagcatgcagtgagcaggggtaccgctaaactgcggtggttcgtagaacgcaacttggtgaagcccgagggcaaggttattgatctggggtgtggacgaggcgggtggtcatattactgcgccggactcaaaaaggtgactgaagtcaaaggctatacaaagggtgggccgggacacgaggaaccaatccctatggccacctacggctggaatttagtgaaactgcattccggcaaggacgtctttttcatgcccccagagaaatgtgatacgcttctgtgcgacataggggagagtagccccaaccctaccattgaagagggaagaacactaagggtgctcaagatggttgaaccgtggctgcggggtaatcagttttgtatcaagattttgaacccctacatgccatctgtagtggagactctggagcagatgcaacgcaaacacggcgggatgctcgtcagaaatcctctttccaggaactcaacccacgaaatgtattgggtgagctgcggaacaggcaatatcgtttcggcggtgaacatgacttctcgaatgctgttaaaccggttcaccatggctcatcgtaagcccacatacgagagagatgtcgacctgggtgcagggacccgccacgtggccgtagaacctgaggtggctaatttggatataatcggacagaggattgaaaacatcaaaaatgagcataagagtacttggcactatgacgaggataacccatacaaaacgtgggcctatcacggctcctacgaagttaagcccagcggctcagcatcctctatggtcaatggggtggtgcggctcctgacaaagccttgggacgtcattccaatggttacccagatcgccatgactgataccacaccctttggacaacagagagtgttcaaagagaaggtagacacgcgcaccccgagggctaaacgaggtactacacagattatggaagtgaccgcgaagtggctatggggctttcttagccggaacaaaaagcctagaatctgtactagggaggagttcacacgcaaggtccgtagtaatgccgcaataggggctgtgtttgttgacgagaaccagtggaactccgccaaagaggcagtggaagatgagcggttctgggacctggtccatagagaaagggagctccacaagcaaggaaaatgcgcaacctgcgtgtataacatgatgggcaagcgcgagaagaaactgggtgagttcgggaaagctaaaggaagccgagccatttggtacatgtggttgggcgcgcggtttctggagttcgaagcactcggctttatgaatgaggatcattggttctctagagaaaactcacttagtggggtagagggagagggtctgcacaagttaggctacatcctgagggacatctccaaaattccagggggaaatatgtatgccgatgacacagctggctgggatactcgcataaccgaagacgatttgcagaacgaggccaagatcacggacattatggaacccgagcatgcactcctggctaccagcatctttaaactaacataccagaataaggttgtgagagtccagcggcctgccaaaaacggtactgtgatggatgtgatttctaggcgtgaccaacgagggtcgggacaggtcggcacctatggccttaacacattcactaatatggaagttcagctgatccgccagatggagtcagaggggatatttctcccaagcgaactggagacccccaacttggctgaaagagccttagattggctggagaagcacggagcagaacggctcaagaggatggcgatctccggtgacgactgtgtggtaaaaccgattgatgaccgcttcgccacggctcttacagccctgaatgatatgggcaaggtgagaaaagacatccctcaatgggagcccagtaaggggtggaacgattggcagcaggtcccattttgctctcaccatttccaccagctaattatgaaagacggacgggagatcgtggttccttgtaggaatcaagatgaactggtgggccgagcacgtgtcagccagggtgctgggtggtccctcagagagaccgcctgcttgggaaagtcatacgcacagatgtggcaactgatgtattttcatcgccgggaccttaggctggccgcgaacgctatatgtagtgccgtgcccgtagattgggttccagcatctagaactacatggagcattcacgcccaccatcagtggatgaccactgaagacatgctctccgtgtggaatcgcgtctggatcgaggaaaacccctggatggaggataagacccacgtgtcaagctgggaggaagttccttacttaggcaaacgggaggaccagtggtgcggctctctgatcgggttgacagctagggccacgtgggcaaccaatattcaggtggctataaaccaagtccgaagactgatcggaaatgaaaactatctcgactacatgacttccatgaagcggttcaaaaatgagagtgatccagagggtgccctttggtga

SEQ ID NO: 14133 - RNA, 9879 nt, synthetic construct
  misc_feature 1..9879: note = derived and/or modified CDS sequence (opt3) from DENV-1__KC692502__SS-prME
  source 1..9879: mol_type = other RNA
agcgtgaccatgctgctcatgcttctgcccaccgccttggctttccacttaactacgaggggcggggagcctcatatgatcgtctccaaacaggaaaggggaaaatctctgctatttaagacctcagctggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaagggggtgtcttatgtcatgtgtacaggatccttcaaacttgaaaaggaggtggctgagactcagcacggtaccgttttggtgcaggtaaagtacgaaggcacggacgcgccttgcaaaataccatttagcacacaagatgagaagggggtcacccagaacggacgcctgatcactgcaaatcccattgtgacagacaaagaaaagcctgttaacatcgagaccgagccacccttcggcgaatcgtatatagtggtcggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtgttcacaagcgtagggaagctggtgcatcaggtttttggaacggcatacggcgtcttgttctccggtgtgtcttggaccatgaaaattgggatcggcattctcctgacttggttaggactgaatagccgctcaacaagtctatccatgacctgtatagcggtgggcatggtcacactctacctgggggttatggtgcaggctgatagcggatgcgtgatcaactggaagggcagagagcttaaatgtggttctgggatttttgtaactaacgaagtccacacctggacggagcaatataagttccaggccgactcaccgaagaggttgagtgcagccatcggaaaggcttgggaggaaggcgtgtgcggtatccggagcgccacacgcctggagaatattatgtggaagcagatatccaacgaactcaatcatatcctgttagagaacgatatgaaatttaccgttgtggtcggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtggaagactatggttttggggttttcactaccaacatttggcttaaattgcgtgatagctacacacagatgtgcgaccaccggctcatgtccgctgcaatcaaggattcaaaagccgtgcatgctgacatgggatattggatagagagtgaaaagaatgagacgtggaaactggcccgagcatctttcattgaagtaaagacctgtacttggccaaagagccacacactatggtccaacggcgtcctggagtcagagatgatcattcccaaaatctttggtggccctataagccaacataattacagaccagggtatttcacccagactgcgggaccgtggcacctcggcaagctggaacttgattttgacttgtgcgaggggacaaccgtggtggtcgatgaacactgcggaaacaggggcccctctctgcgcacgactaccgttacaggtaaaatcattcatgagtggtgttgccggtcctgtaccttacctccactcagattcagaggggaagacggatgctggtacggcatggaaatccgccccgtgaaggagaaagaagagaatctggtacgaagtatggtgagcgccggttctggcgaagtcgattccttttcacttgggattctgtgtgtgagtatcatgatagaggaggttatgcggagccgttggtcgagaaagatgttgatgactggaacactcgctgtgttcctgctactgattatgggccagctcacctggaacgacctgatcaggctttgcatcatggtcggggccaatgcatccgaccgcatgggaatgggcacaacttacttggctctgatggccacctttaagatgcggcctatgttcgcagtgggtttactctttagaaggctgacgtctcgagaagttcttctgctaacaattgggctcagcctggtggcctcagtcgagttgccaaacagtctggaagagttaggagatggcctcgctatgggcatcatgatgctgaaacttctgaccgagttccaaccccaccagttgtggactaccctcctgtccctaacatttgtacgcactaccctgtctcttgactatgcgtggaagacgacagccatggtgctcagcattgtttccctgttcccgttgtgtctgtcaaccactagccagaaaacaacctggttacctgtgctcctggggagttttggatgcaagccacttactatgttcctgataacagagaacaaaatctggggtcggaagtcttggcccttgaatgagggcattatggcaatcgggattgtctccatcctcctgagctcgctactgaagaacgatgtgcctcttgctggacccctcatagccggcggtatgctgatcgcctgttacgtaatttcagggtctagtgctgacttgtccttagaaaaagcagccgaggtgagctgggaacaggaggcggaacattctggagctagccacaatatcctggtcgaggttcaagatgacggcaccatgaagattaaagatgaggaaagagacgatacgctcactatcctgcttaaggccaccctgttggcagtgtccggcgtgtatccaatgtcaatacctgccacactattcgtctggtacttttggcagaaaaagaaacagaggagtggggtgctgtgggacacccccagcccaccggagatggaacgtgctgttctcgatgacggaatttatcgcatcctgcagcggggtcttttaggcagatctcaagtaggggtgggagtcttccaggatggcgtgtttcatacaatgtggcacgttactaggggtgcagtgctgatgtaccaggggaagcgactcgagccttcctgggcctcagtcaagaaagacttgatcagttatggaggcggctggcggttccaggggagctggaacaccggagaggaagtgcaagtaattgcggtcgagcccggtaagaatcccaaaaatgtgcagacgacacccggcacttttaagacccctgaaggggaggttggagctatagccctggacttcaaaccaggcacatccggttctcccatcgtgaatcgcgaagggaagattgtcggactctacggcaacggcgtggttaccacttcggggacctacgtgagcgcaatcgcccaggctaaggcctcacaagagggacctctgccggagattgaagatgaggtctttaaaaagagaaatcttacaatcatggacctgcacccaggttccggcaaaacgaggcggtatttgcccgcaatagtgcgagaagctatcaagagaaaactacgcactctgattctcgcccctaccagggtagtggcgagtgagatggccgaagcattaaaggggatgccaatccgttaccagacaaccgctgttaagtctgagcatactggacgggagattgtcgatctgatgtgccacgccacattcaccatgagacttctgagccccgtgagggtgcctaactataatatgatcataatggacgaagctcattttacggatccggcatccattgccgcccgcggctacatctcaactcgagtcggtatgggggaggctgcggcaatcttcatgacagccacaccaccaggatctgtagaggcttttcctcagagcaacgccgtgattcaggacgaggaaagagatatccccgagcggagttggaactccggctatgactggataaccgatttcccaggcaaaactgtttggttcgtgcctagcattaagtctgggaacgacatcgcaaattgtctcaggaaaaacggaaagcgcgtcattcaattgtcacgtaaaacatttgataccgagtaccagaagacaaagaacaatgactgggactatgtggttactacggatatctccgaaatgggtgccaacttcagagctgaccgggtgatagatcccaggcgctgcctgaaaccagtcattctcaaggacggcccggagcgagtgatcctggcggggcctatgcccgtaaccgtggccagtgcagctcagagacggggaaggatcggccgcaatcagaacaaagaaggtgatcaatacgtttacatggggcagccacttaataacgacgaggatcacgcccattggacagaggcaaagatgctactggacaatattaacactcccgaaggcatcattcctgccttgtttgagccagaaagagagaaaagcgctgccatagatggagaatataggttacggggcgaggcgcgtaagaccttcgtcgagctgatgcgccgaggggacctccccgtgtggctgtcgtacaaggtggcatctgaaggatttcagtattccgatagaaggtggtgcttcgacggtgagcggaataaccaggtccttgaagagaatatggatgttgaaatctggacaaaagagggcgagcgcaagaaactgagacctaggtggctcgacgcccggacctacagcgacccgttggctctgcgagaatttaaggagttcgccgctgggagacgctcagtgagtggagatctaattctggaaatcggcaaactcccacaacaccttactctgagggcacagaacgccttagacaatttggtaatgctgcacaactctgagcagggtgggaaggcttatcggcatgccatggaagaactccccgatacgatcgagaccctgatgcttctggcactcattgcggtgttgacaggcggagtcactctgtttttcttatccggcaaagggctaggaaagaccagcataggtctgctctgtgtgacagcctcaagtgcacttctgtggatggccagcgttgaacctcactggatcgcagcttccattatcttggagtttttcctgatggtgctcctgattcccgaaccagaccgtcagagaacccctcaagataatcagcttgcctacgtcgtaatcggcctcctgtttatgatattgactgtggcagccaacgagatggggctgttagagacaacgaagaaagacctaggaatcggctatgttgctgcggaaaaccatcagcacgccaccatgctggatgtggacctccaccccgcatctgcttggactctttacgccgtcgccacaaccgtgattaccccaatgatgaggcatacaatcgagaatactacggcaaacattagcctgaccgctatcgccaatcaagcggctatattgatgggtctggataaggggtggcctatttccaaaatggacatcggcgtcccgctcctggcccttggatgctactcacaggtgaaccccttaacactgactgcagccgttctcatgttggtggctcactatgcaattatcggcccagggctgcaggccaaggcgacccgcgaagctcagaaacggacagccgcaggaataatgaagaatcctaccgtagatggcatcgtggccattgacctagatcccgtcgtttacgacgctaagttcgagaaacaactgggtcagatcatgctccttattctgtgtacttctcagatcttgctgatgcgaacgacatgggccctctgcgaaagtataaccctggcaactgggccattaaccacactttgggagggatcgcctggcaagttctggaacactaccattgctgtgagcatggccaatatctttagaggttcctatctggcgggcgccgggctcgcattctctctaatgaaatcactgggaggcgggaggcgcggaacaggcgctcagggtgagacgttgggggaaaagtggaaacggcaactgaaccagctcagcaagtccgagtttaatacctacaagagaagtggaatcatggaagtcgaccgttctgaggccaaagaaggccttaagaggggtgagactacaaaacatgcagtgagccggggcaccgctaagctgcgctggttcgtagagcgaaacttggtgaaacccgaagggaaggttattgatctgggatgtggcagagggggatggtcatattactgcgccggcctcaagaaagtgactgaggtcaagggttatacaaaagggggaccgggccacgaagaaccaatccctatggccacctacggctggaatttagtgaagctgcattccgggaaagacgtctttttcatgcccccagaaaagtgtgatacgcttctgtgcgacataggagagagtagccccaaccctaccattgaggaaggtaggacactacgggtgctcaaaatggttgagccgtggctgcgcggcaatcagttttgtatcaagattttgaacccctacatgccatctgtagtggaaactctggagcagatgcaaagaaagcacgggggaatgctcgtcaggaatcctctttcccgaaactcaacccacgagatgtattgggtgagctgcggcacaggtaatatcgtttcggcggtgaacatgacttctcggatgctgttaaaccgtttcaccatggctcatagaaaacccacatacgaacgcgatgtcgacctgggggcaggaaccaggcacgtggccgtagagcctgaagtggctaatttggatataatcggccagcggattgagaacatcaagaatgaacataaaagtacttggcactatgacgaggataacccatacaagacgtgggcctatcacggctcctacgaggttaaacccagcgggtcagcatcctctatggtcaatggagtggtgagactcctgacaaagccttgggacgtcattccaatggttacccagatcgccatgactgataccacaccctttggtcaacagcgcgtgttcaaggaaaaagtagacacgaggaccccgcgagctaagcggggcactacacagattatggaggtgaccgcgaaatggctatgggggtttcttagcagaaacaagaaacctaggatctgtactcgcgaagagttcacacgtaaggtccggagtaatgccgcaataggagctgtgtttgttgacgaaaaccagtggaactccgccaaggaggcagtggaggatgaaagattctgggacctggtccatagggagcgcgaactccacaaacaaggcaagtgcgcaacctgcgtgtataacatgatgggtaaacgagagaagaaactgggggagttcggaaaggctaagggcagccgggccatttggtacatgtggttgggcgcgagatttctggagttcgaggcactcgggtttatgaatgaagatcattggttctctagggagaactcacttagtggagtagaaggtgagggcctgcacaaattagggtacatcctgcgcgacatctccaagattccaggaggcaatatgtatgccgatgacacagctggttgggatactagaataaccgaggacgatttgcagaacgaagccaaaatcacggacattatggagcccgaacatgcactcctggctatgagcatctttaagctaacctaccagaataaagttgtgcgggtccagaggcctgccaagaacgggacagtgatggatgtgatttctcgtcgagaccaacgcggatcgggccaggtcggcacttatgggcttaacaccttcacaaatatggaggttcagctgatcagacagatggaatcagagggaatatttctcccaagcgagctggaaactcccaacttggctgagcgggccttagattggctggaaaaacacggtgcagagaggctcaagcgcatggcgatctccggcgacgactgtgtggtaaagccgattgatgacagattcgccaccgctcttacggccctgaatgatatggggaaagtgcggaaggacatccctcaatgggaacccagtaaaggatggaacgattggcagcaggtcccattttgctctcaccatttccaccagctaattatgaaggacggcagggagatcgtggttccttgtcgaaatcaagatgagctggtgggtcgtgcaagagtcagccagggggctggatggtccctccgcgaaacagcctgcttgggcaaatcatacgcacagatgtggcaactgatgtattttcatcggagggaccttagactggccgcgaacgctatatgtagtgccgtgcccgtagattgggttccagcatctcgcaccacttggagcattcacgcccaccatcagtggatgacaaccgaggacatgctctccgtgtggaatcgggtctggatcgaagagaacccctggatggaagataagactcacgtgtcaagctgggaggaggttccttacttaggcaagagggaagaccagtggtgcgggtctctgatcggattgaccgctcgagccacatgggcaacgaatattcaggtggctatatcccaagtcagacggctgatcggtaacgagaattatctcgactacatgaccagtatgaaaaggttcaagaacgaaagcgatccagagggcgccctttggtga

SEQ ID NO: 14134 - RNA, 9879 nt, synthetic construct
  misc_feature 1..9879: note = derived and/or modified CDS sequence (opt3) from DENV-1__KC692503__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggatcgcctcaccctgaaagggatgtcttatgtgatgtgtacaggatccttcaagcttgaaaaagaggtcgctgagactcagcacggtaccgtgttggttcaggtgaagtacgaaggcacggacgcgccttgcaagataccatttagcacacaagatgagaaaggggtaacccagaacggaagactgatcactgcaaatcccattgtcacagacaaggaaaaacctgtgaacatcgagaccgagccacccttcggcgaatcgtatatagttgtgggtgccggggagaaggctctcaaactgtcttggtttaagaggggctcctcaattggaaagatgttcgaagccactgcacggggcgcccgacgcatggctatccttggggataccgcctgggactttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagcagatcaacaagtctatccatgacctgtatagcggtgggcatggtgacactctacctgggggtcatggttcaggctgatagcggatgcgtgatcaactggaaaggcagggagcttaagtgtggttctgggatttttgtgactaacgaagtacacacctggacggagcaatataaattccaggccgactcaccgaagcggttgagtgcagccatcggaaaggcttgggaggaaggcgtctgcggtatccgcagcgccacaagactggagaatattatgtggaaacagatatccaacgaactcaatcatatcctgttagagaacgatatgaagtttaccgtggttgtgggcgacgcaaatgggattctggctcagggaaaaaagatgatcaggcctcaacccatggaacacaaatactcttggaagtcgtggggcaaagccaagattatcggggcggacatacagaacactaccttcatcattgatggaccagacacacctgagtgtcccgatggccagcgtgcctggaatatctgggaggtcgaagactatggttttggggtgttcactaccaacatttggcttaagttgcgggatagctacacacagatctgcgaccaccgactcatgtccgctgcaataaaagattcaaaggccgttcatgctgacatgggatattggattgagagtgaaaaaaatgagacgtggaagctggccagagcatctttcatcgaagtgaaaacctgtacttggccaaagagccacacactatggtccaacggcgtactggagtcagagatgattatccccaagatatttggtggccctatcagccaacataattacaggccagggtatttcacccagactgcgggaccgtggcacctcggcaaactggaacttgattttgacttgtgcgaggggacaaccgtcgtggtggatgaacactgcggaaaccgcggcccctctctgcggacgactaccgtcacaggtaagattatccatgagtggtgttgcagatcctgtaccttacctccactcaggttccgcggggaggacggatgctggtacggcatggaaattcgacccgttaaagagaaggaagagaatctggtgcggagtatggtaagcgccggttctggcgaagtggattccttttcacttgggatcctgtgtgtcagtataatgattgaggaggtgatgcgtagcagatggtcgaggaaaatgttgatgatcggaactctcgctgttttcctgctactgatcatgggccagctcacatggaacgacctgattcgcctttgcatcatggtgggggccaatgcatccgaccggatgggaatgggcaccacatacttggctctgatggccacttttaagatgagacctatgttcgcagtcggtttactctttaggcgactgacctctcgcgaagtgcttctgctaacgattgggctcagcctggttgcctcagtggagttgccaaacagtctggaagagttaggagatggcctcgctatgggcataatgatgctgaagcttctgacagaattccaaccccaccagttgtggaccactctcctgtccctaacctttgtcaaaacaactctgtctcttgactatgcgtggaagaccacggccatggtactcagcatcgtgtccctgttcccgttgtgtctgtcaacaaccagccagaaaactacatggttacctgttctcctggggagttttggatgcaagccacttaccatgttcctgattactgagaacaaaatctggggtcggaagtcttggcccttgaatgagggcattatggcaatcgggatagtgtccatcctcctgagctcgctactgaagaacgatgtccctcttgctggacccctcattgccggcggtatgctgatcgcctgttacgtgatttcagggtctagtgctgacttgtccttagaaaaagcagccgaggtaagctgggaacaggaggcggaacattctggagctagccacaatatcctggtggaggtccaagatgacggcacaatgaagataaaagatgaggaaagagacgataccctcacgattctgcttaaggccactctgttggcagtttccggcgtgtatccaatgtcaatccctgccaccctattcgtgtggtacttttggcagaaaaagaaacagaggagtggggtcctgtgggacacacccagcccaccggaggtggaacgtgctgttctcgatgacggaatctatcgcattctgcagcggggtcttttaggcagatctcaagtaggggtgggagtcttccaggatggcgtgtttcataccatgtggcacgttacaaggggtgcagtgctgatgtaccaggggaagcgactcgagccttcctgggcctcagtcaagaaagacttgataagttatggaggcggctggcggttccaggggagctggaacactggagaggaagtgcaagtaatcgcggtcgagcccggtaagaatccaaaaaacgtgcagaccacgcccggcacatttaagactcctgaaggggaggttggagctattgccctggacttcaaaccaggcacctccggttctcccatcgtgaatcgcgaagagaagattgtcgggctctacggaaacggcgtggttacaacctcgggcacttacgtgagcgcaatcgcccaggctaaggcctcacaagaggggcctctgccggaaatagaggatgaagtctttaaaaagagaaatcttaccatcatggacctgcacccaggatccggtaaaacaaggcggtatttgcccgcaattgtgcgagaggctatcaagagaaaactacgcacgctgattctcgcccctactagggtagtggcgagtgaaatggccgaggcattaaagggcatgccaatccgttaccagaccacagctgttaagtctgagcataccgggcgggaaatagtcgatctgatgtgccacgccactttcacaatgagacttctgagccccgtgagggtgcctaactataatatgattatcatggacgaggctcattttaccgatccggcatccatcgccgcccgcggatacatttcaacgcgagtcggcatgggtgaagctgcggcaatcttcatgactgccacacccccagggtctgtagaggcttttcctcagagcaacgccgtgatacaggacgaagagagagatattcccgagcggagttggaattccggatatgactggatcaccgatttcccaggcaaaaccgtttggttcgtgcctagcattaagtctggcaacgacatcgcaaattgtctcaggaaaaacgggaagcgcgtcatacaattgtcacgtaaaacttttgatacagaataccagaagaccaagaacaatgactgggactatgtggttacaactgatatttccgagatgggagccaacttcagagctgaccgggtgatcgatcccaggcgctgcctgaaaccagtcatcctcaaggacggtccggaacgagtgattctggcgggccctatgcccgtaacggtggccagtgcagctcagagacgggggaggatcggacgcaatcagaacaaagagggcgatcaatacgtttacatgggtcagccacttaataacgacgaggatcacgcccattggaccgaagcaaagatgctactggacaatattaacacacccgaggggataatccctgccttgtttgaaccagagagagaaaaaagcgctgccattgatggcgagtataggttacggggagaggcgcgtaagactttcgtcgaactgatgcgccgaggcgacctccccgtgtggctgtcgtacaaggtggcatctgaggggtttcagtattccgatagaaggtggtgcttcgacggagaacggaataaccaggtccttgaggaaaatatggatgttgagatctggaccaaagagggtgaacgcaagaaactgagacctaggtggctcgacgcccggacatacagcgacccgttggctctgcgagagtttaaggaattcgccgctggcagacgctcagtgagtggggatctaatcctggagattggaaaactcccacaacaccttaccctgagggcacagaacgccttagacaatttggtaatgctgcacaactctgaacagggcggtaaggcttatcggcatgccatggaggagctccccgatactatagaaacgctgatgcttctggcactcatcgcggtgttgaccgggggcgtcacactgtttttcttatccggaaaaggcctagggaagactagcattggactgctctgtgtgaccgcctcaagtgctcttctgtggatggccagcgttgagcctcactggatcgcagcttccattatcttggaatttttcctgatggtgctcctgatacccgagccagaccgtcagagaacacctcaagataatcagcttgcctacgtcgtaatcggtctcctgtttatgattttgaccgtggcagccaacgagatgggcctgttagaaactacaaagaaagacctagggatcggatatgttgctgcggagaaccatcagcacgccacgatgctggatgtggacctccaccccgcatctgcttggaccctttacgccgtcgccactacagtgattaccccaatgatgaggcataccatcgaaaatacaactgcaaacataagcctgacggctattgccaatcaagcggctatcttgatgggcctggataagggttggcctatttccaaaatggacatcggggtcccgctcctggcccttggctgctactcacaggtgaaccccttaaccctgacagcagccgttctcatgttggtggctcactatgcaataatcggaccaggcctgcaggccaaggcgactcgcgaggctcagaaacggaccgccgcagggattatgaagaatcctacagtagatggaatcgtggccattgacctagatcccgtcgtttacgacgctaagttcgaaaaacaactgggccagatcatgctccttatactgtgtacctctcagattttgctgatgcgaactacgtgggccctctgcgagagtatcacactggcaaccggtccattaactaccctttgggaggggtcgcctggaaagttctggaacacaactatcgctgtgagcatggccaatatttttagaggctcctatctggcgggtgccggcctcgcattctctctaatgaaatcactggggggaggcaggcgcgggaccggagctcagggcgaaacattgggtgagaagtggaaacggcaactgaaccagctcagcaagtccgaatttaatacgtacaagagaagtgggatcatggaggtcgaccgttctgaagccaaagagggacttaagaggggcgagaccactaaacatgcagtgagccggggtacagctaagctgcgctggttcgtagaacgaaacttggtgaaacccgagggcaaggttatagatctggggtgtggaagaggcgggtggtcatattactgcgccggactcaagaaagtgaccgaagtcaagggctatactaaaggtgggccgggacacgaggaaccaattcctatggccacatacggctggaatttagtgaagctgcattccggcaaagacgtctttttcatgcccccagagaagtgtgatacccttctgtgcgacatcggggagagtagccccaaccctacgattgaagagggaaggaccctacgggtgctcaaaatggttgaaccgtggctgcgcggtaatcagttttgtatcaagatattgaacccctacatgccatctgtagtggagacactggagcagatgcaaagaaagcacggcgggatgctcgtcaggaatcctctttcccgaaactcaactcacgaaatgtattgggtgagctgcggaaccggcaatatcgtttcggcggtgaacatgacatctcggatgctgttaaaccgtttcactatggctcatagaaaacccacctacgagcgcgatgtcgacctgggtgcagggacaaggcacgtggccgtagaacctgaggtggctaatttggatattatcggacagcggattgaaaacatcaagaatgagcataaaagtacctggcactatgacgaggataacccatacaagacttgggcctatcacggctcctacgaagttaaacccagcggctcagcatcctctatggtcaatggggtggtgagactcctgacgaagccttgggacgtcattccaatggttacacagatcgccatgaccgatactaccccctttggacaacagcgcgtgttcaaggagaaagtagacacaaggacgccgcgagctaagcggggtaccactcagataatggaagtgacagcgaaatggctatggggctttcttagcagaaacaagaaacctaggatttgtacccgcgaggaattcactcgtaaggtccggagtaatgccgcaatcggggctgtgtttgttgacgagaaccagtggaattccgccaaggaggcagtggaagatgagagattctgggacctggtccatagggaacgcgagctccacaaacaaggaaagtgcgccacatgcgtgtataacatgatgggcaaacgagaaaagaaactgggtgagttcgggaaggctaagggaagccgggccatctggtacatgtggttgggcgcgagatttctggagttcgaagcactcggctttatgaatgaggatcattggttctctagggaaaactcacttagtggggtagagggagagggtctgcacaaattaggctacattctgcgcgacatatccaagatcccagggggaaatatgtatgccgatgacaccgctggctgggatacaagaattactgaagacgatttgcagaacgaggccaaaatcaccgacattatggaacccgagcatgcactcctggctacgagcatctttaagctaacctaccagaataaagttgtgcgggtccagaggcctgccaagaacggtacagtgatggatgtgatatctcgtcgagaccaacgcgggtcgggacaggtcggcacttatggccttaacaccttcacaaatatggaagttcagctgatcagacagatggagtcagaggggatttttctcccaagcgaactggagactcccaacttggctgaacgggccttagattggctggagaaacacggagcagaaaggctcaagcgcatggcgatctccggtgacgactgtgtggtaaagccgattgatgacagattcgccaccgctcttacggccctgaatgatatgggcaaagtgcggaaggacatccctcaatgggagcccagtaaagggtggaacgattggcagcaggtcccattttgctctcaccatttccaccagctaataatgaaggacggaagggagattgtggttccttgtcgaaatcaagatgaactggtgggccgtgcaagagtcagccagggtgctgggtggtccctccgcgagacagcctgcttgggaaaatcatacgcacagatgtggcaactgatgtattttcatcggagggaccttagactggccgcgaacgctatctgtagtgccgtgcccgtagattgggttccagcatctcgcaccacttggagcatccacgcccaccatcagtggatgacaaccgaagacatgctctccgtgtggaatcgggtctggattgaggaaaacccctggatggaggataagactcacgtgtcaagctgggaggaagttccttacttaggcaagagggaggaccagtggtgcggctctctgatagggttgaccgctcgagccacatgggcaacgaatatccaggtggctattaaccaagtcagacggctgatcggaaatgaaaactatctcgactacatgacctccatgaaaaggttcaagaatgagagtgatccagagggtgccctttggtga

SEQ ID NO: 14135 - RNA, 9879 nt, synthetic construct
  misc_feature 1..9879: note = derived and/or modified CDS sequence (opt3) from DENV-1__KC692504__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaggcagatccagcgggtggagacttgggctctgcgccaccctggattcaccgttattgcatttttcctggcccatgctatcggcacatcgattacccagaaaggcatcatatttatcctcttaatgctggtgacgccatcaatggccatgagatgcgtcgggattggaaacagggacttcgtggagggtcttagcggcgcgacttgggtagatgttgtgttggaacacgggagttgtgtcacaaccatggcaaagaataagcccactctggacatcgagctactcaaaacagaagtgatgaaccctgccgtgctgcggaagctttgcattgaggctaaaatctccaataccacgaccgattctcgctgtccaacacaaggagaagccactctggtcgaggagcaggacgcaaactttgtttgccgaagaaccttcgtggataggggctggggtaatgggtgtggattgtttggcaagggcagcctcctgacatgcgctaaattcaagtgcgtaactaagttagaagggaaaatagtgcagtacgagaacctgaagtattccgtcattgtgaccgttcacacaggagaccagcatcaagtgggtaatgaaaccactgagcacggcacgatcgccacaattaccccccaggcgcctacttcagaaatccagctcaccgattacggggcccttacactggactgtagtccacggaccggattggactttaacgagatggtcctactgactatgaaagagaagagctggctcgtgcataaacagtggttcctggatcttccgctgccctggacatctggcgcatccacgtcacaagaaacctggaatcgtcaggacttgctcgtaacttttaagacagctcacgccaaaaagcaggaggttgtggtcctgggtagccaagaaggggctatgcacaccgccttaacaggcgcaactgagatccagaccagtggaacgaccacaattttcgccggccatctgaagtgccgcctaaaaatggataagctcactctgaaagggatgtcttatgtgatgtgtaccggatccttcaagcttgaaaaagaggtcgctgagacacagcacggtactgtgttggttcaggtgaagtacgaaggcaccgacgcgccttgcaagataccatttagcacgcaagatgagaaaggggtaacacagaacggaagactgatcaccgcaaatcccattgtcactgacaaggaaaaacctgtgaacatcgagacagagccacccttcggcgaatcgtatatagttgtgggtgccggggagaaggctctcaaactgtcttggtttaagaggggctcctcaattggaaagatgttcgaagccaccgcacggggcgcccgacgcatggctatccttggggatactgcctgggactttggaagtatcggtggcgtcttcaccagcgtggggaaactggtacatcaggtgtttggaacagcatacggcgttttgttctccggtgtctcttggacgatgaagattgggatcggcattctcctgacctggttaggactgaatagcagatcaactagtctatccatgacatgtatagcggtgggcatggtgaccctctacctgggggtcatggttcaggctgatagcggatgcgtgatcaactggaaaggcagggagcttaagtgtggttctgggatttttgtgacaaacgaagtacacacttggaccgagcaatataaattccaggccgactcaccgaagcggttgagtgcagccatcggaaaggcttgggaggaaggcgtctgcggtatccgcagcgccacgagactggagaatattatgtggaaacagatatccaacgaactcaatcatatcctgttagagaacgatatgaagtttacagtggttgtgggcgacgcaaatgggattctggctcagggaaaaaagatgatcaggcctcaacccatggaacacaaatactcttggaagtcgtggggcaaagccaagattatcggggcggacatacagaacaccactttcatcattgatggaccagacacccctgagtgtcccgatggccagcgtgcctggaatatctgggaggtcgaagactatggttttggggtgttcacaactaacatttggcttaagttgcgggatagctacacccagatgtgcgaccaccgactcatgtccgctgcaatcaaagattcaaaggccgttcatgctgacatgggatattggatagagagtgaaaaaaatgagacatggaagctggccagagcatctttcattgaagtgaaaacgtgtacctggccaaagagccacactctatggtccaacggcgtactggagtcagagatgatcattcccaagatctttggtggccctataagccaacataattacaggccagggtatttcacacagaccgcgggaccgtggcacctcggcaaactggaacttgattttgacttgtgcgaggggactacagtcgtggtggatgaacactgcggaaaccgcggcccctctctgcggaccacgactgtcaccggtaagatcattcatgagtggtgttgcagatcctgtacattacctccactcaggttccgcggggaggacggatgctggtacggcatggaaatccgacccgttaaagagaaggaagagaatctggtgcggagtatggtaagcgccggttctggcgaagtggattccttttcacttgggattctgtgtgtcagtatcatgatagaggaggtgatgcgtagcagatggtcgaggaaaatgttgatgaccggaactctcgctgttttcctgctactgattatgggccagctcacatggaacgacctgatccgcctttgcatcatggtgggggccaatgcatccgaccggatgggaatgggcaccacatacttggctctgatggccacttttaagatgagacctatgttcgcagtcggtttactctttaggcgactgacctctcgcgaagtgcttctgctaacgattgggctcagcctggttgcctcagtggagttgccaaacagtctggaagagttaggagatggcctcgctatgggcatcatgatgctgaagcttctgacagaattccaaccccaccagttgtggaccactctcctgtccctaacctttgtcaaaacaactctgtctcttgactatgcgtggaagaccacggccatggtactcagcattgtgtccctgttcccgttgtgtctgtcaacaaccagccagaaaactacatggttacctgttctcctggggagttttggatgcaagccacttaccatgttcctgataactgagaacaaaatctggggtcggaagtcttggcccttgaatgagggcattatggcaatcgggattgtgtccatcctcctgagctcgctactgaagaacgatgtccctcttgctggacccctcatagccggcggtatgctgatcgcctgttacgtgatttcagggtctagtgctgacttgtccttagaaaaagcagccgaggtaagctgggaacaggaggcggaacattctggagctagccacaatatcctggtggaggtccaagatgacggcacaatgaagattaaagatgaggaaagagacgataccctcacgatcctgcttaaggccactctgttggcagtttccggcgtgtatccaatgtcaatacctgccaccctattcgtgtggtacttttggcagaaaaagaaacagaggagtggggtcctgtgggacacacccagcccaccggaggtggaacgtgctgttctcgatgacggaatttatcgcatcctgcagcggggtcttttaggcagatctcaagtaggggtgggagtcttccaggatggcgtgtttcataccatgtggcacgttacaaggggtgcagtgctgatgtaccaggggaagcgactcgagccttcctgggcctcagtcaagaaagacttgatcagttatggaggcggctggcggttccaggggagctggaacactggagaggaagtgcaagtaattgcggtcgagcccggtaagaatccaaaaaacgtgcagaccacgcccggcacatttaagactcctgaaggggaggttggagctatagccctggacttcaaaccaggcacctccggttctcccatcgtgaatcgcgaagggaagattgtcggactctacggcaacggcgtggttacaacctcggggacttacgtgagcgcaatcgcccaggctaaggcctcacaagagggacctctgccggagattgaagatgaggtctttaaaaagagaaatcttaccatcatggacctgcacccaggttccggcaaaacaaggcggtatttgcccgcaatagtgcgagaagctatcaagagaaaactacgcacgctgattctcgcccctactagggtagtggcgagtgagatggccgaagcattaaaggggatgccaatccgttaccagaccacagctgttaagtctgagcataccggacgggagattgtcgatctgatgtgccacgccactttcacaatgagacttctgagccccgtgagggtgcctaactataatatgatcataatggacgaagctcattttaccgatccggcatccattgccgcccgcggctacatctcaacgcgagtcggtatgggggaggctgcggcaatcttcatgactgccacacccccaggatctgtagaagcttttcctcagagcaacgccgtgattcaggacgaggaaagagatatccccgagcggagttggaattccggctatgactggataaccgatttcccaggcaaaaccgtttggttcgtgcctagcattaagtctgggaacgacatcgcaaattgtctcaggaaaaacggaaagcgcgtcattcaattgtcacgtaaaacttttgatacagagtaccagaagaccaagaacaatgactgggactatgtggttacaactgatatctccgaaatgggtgccaacttcagagctgaccgggtgatagatcccaggcgctgcctgaaaccagtcattctcaaggacggcccggagcgagtgatcctggcggggcctatgcccgtaacggtggccagtgcagctcagagacggggaaggatcggccgcaatcagaacaaagaaggtgatcaatacgtttacatggggcagccacttaataacgacgaggatcacgcccattggaccgaggcaaagatgctactggacaatattaacacacccgaaggcatcattcctgccttgtttgagccagaaagagagaaaagcgctgccatagatggagaatataggttacggggcgaggcgcgtaagactttcgtcgagctgatgcgccgaggggacctccccgtgtggctgtcgtacaaggtggcatctgaaggatttcagtattccgatagaaggtggtgcttcgacggtgagcggaataaccaggtccttgaagagaatatggatgttgaaatctggaccaaagagggcgagcgcaagaaactgagacctaggtggctcgacgcccggacatacagcgacccgttggctctgcgagaatttaaggagttcgccgctgggagacgctcagtgagtggagatctaattctggaaatcggcaaactcccacaacaccttaccctgagggcacagaacgccttagacaatttggtaatgctgcacaactctgagcagggtgggaaggcttatcggcatgccatggaagagctccccgatactatcgagacgctgatgcttctggcactcattgcggtgttgaccggcggagtcacactgtttttcttatccggcaaagggctaggaaagactagcataggtctgctctgtgtgaccgcctcaagtgctcttctgtggatggccagcgttgaacctcactggatcgcagcttccattatcttggagtttttcctgatggtgctcctgattcccgaaccagaccgtcagagaacacctcaagataatcagcttgcctacgtcgtaatcggcctcctgtttatgatattgaccgtggcagccaacgagatggggctgttagagactacaaagaaagacctaggaatcggctatgttgctgcggaaaaccatcagcacgccacgatgctggatgtggacctccaccccgcatctgcttggaccctttacgccgtcgccactacagtgattaccccaatgatgaggcataccatcgagaatacaactgcaaacattagcctgacggctatcgccaatcaagcggctatattgatgggtctggataaggggtggcctatttccaaaatggacatcggcgtcccgctcctggcccttggatgctactcacaggtgaaccccttaaccctgacagcagccgttctcatgttggtggctcactatgcaattatcggcccagggctgcaggccaaggcgactcgcgaagctcagaaacggaccgccgcaggaataatgaagaatcctacagtagatggcatcgtggccattgacctagatcccgtcgtttacgacgctaagttcgagaaacaactgggtcagatcatgctccttattctgtgtacctctcagatcttgctgatgcgaactacgtgggccctctgcgaaagtataacactggcaaccgggccattaactaccctttgggagggatcgcctggcaagttctggaacacaactattgctgtgagcatggccaatgtctttagaggttcctatctggcgggcgccgggctcgcattctctctaatgaaatcactgggaggcgggaggcgcggaaccggcgctcagggtgagacattgggggaaaagtggaaacggcaactgaaccagctcagcaagtccgagtttaatacgtacaagagaagtggaatcatggaagtggaccgttctgaggccaaagaaggccttaagaggggtgagaccactaaacatgcagtaagccggggcacagctaagctgcgctggttcgtggagcgaaacttggttaaacccgaagggaaggtgatcgatctgggatgtggcagagggggatggtcatattactgcgccggcctcaagaaagtcaccgaggtgaagggttatactaaagggggaccgggccacgaagagccaattcctatggccacatacggctggaatttagtcaagctgcattccgggaaagacgtgtttttcatgcccccagaaaagtgtgatacccttctgtgcgacatcggagagagtagccccaaccctacgatagaggaaggtaggaccctacgggttctcaaaatggtagagccgtggctgcgcggcaatcagttttgtattaagatcttgaacccctacatgccatctgtggtcgaaacactggagcagatgcaaagaaagcacgggggaatgctcgtgaggaatcctctttcccgaaactcaactcacgagatgtattgggttagctgcggcaccggtaatattgtgtcggcggtcaacatgacatctcggatgctgttaaaccgtttcactatggctcatagaaaacccacctacgaacgcgatgtggacctgggggcaggaacaaggcacgtagccgtggagcctgaagttgctaatttggatatcataggccagcggatcgagaacattaagaatgaacataaaagtacctggcactatgacgaggataacccatacaagacttgggcctatcacggctcctacgaggtcaaacccagcgggtcagcatcctctatggtgaatggagtggtcagactcctgacgaagccttgggacgttatcccaatggtgacacagattgccatgaccgatactaccccctttggtcaacagcgcgtattcaaggaaaaagtggacacaaggacgccgcgagctaagcggggcaccactcagatcatggaggtcacagcgaaatggctatgggggtttcttagcagaaacaagaaacctaggatttgtacccgcgaagagttcactcgtaaggtgcggagtaatgccgcaatcggagctgtttttgtggacgaaaaccagtggaattccgccaaggaggcagtcgaggatgaaagattctgggacctggtgcatagggagcgcgaactccacaaacaaggcaagtgcgccacatgcgtatataacatgatgggtaaacgagagaagaaactgggggaattcggaaaggctaagggcagccgggccatatggtacatgtggttgggcgcgagatttctggagttcgaggcactcgggtttatgaatgaagatcattggttctctagggagaactcacttagtggagttgaaggtgagggcctgcacaaattagggtacattctgcgcgacatctccaagatcccaggaggcaatatgtatgccgatgacaccgctggttgggatacaagaattactgaggacgatttgcagaacgaagccaaaataaccgacatcatggagcccgaacatgcactcctggctacgagcatttttaagctaacctaccagaataaagtggtccgggtgcagaggcctgccaagaacgggacagtgatggatgtcatctctcgtcgagaccaacgcggatcgggccaggttggcacttatgggcttaacaccttcacaaatatggaggtgcagctgattagacagatggaatcagagggaatctttctcccaagcgagctggaaactcccaacttggctgagcgggccttagattggctggaaaaacacggtgcagagaggctcaagcgcatggcgatatccggcgacgactgtgtagtgaagccgatcgatgacagattcgccaccgctcttacggccctgaatgatatggggaaagtccggaaggacattcctcaatgggaacccagtaaaggatggaacgattggcagcaggtgccattttgctctcaccatttccaccagctaatcatgaaggacggcagggagattgttgtgccttgtcgaaatcaagatgagctggtcggtcgtgcaagagtgagccagggggctggatggtccctccgcgaaacagcctgcttgggcaaatcatacgcacagatgtggcaactgatgtattttcatcggagggaccttagactggccgcgaacgctatctgtagtgccgtacccgttgattgggtgccagcatctcgcaccacttggagcatacacgcccaccatcagtggatgacaaccgaggacatgctctccgtctggaatcgggtgtggattgaagagaacccctggatggaagataagactcacgtttcaagctgggaggaggtgccttacttaggcaagagggaagaccagtggtgcgggtctctgatcggattgaccgctcgagccacatgggcaacgaatatccaggtcgctattaaccaagtgagacggctgataggtaatgagaactatctcgactacatgacctccatgaaaaggttcaagaatgaaagtgatccagagggcgccctttggtga

SEQ ID NO: 14136 - RNA, 9879 nt, synthetic construct
  misc_feature 1..9879: note = derived and/or modified CDS sequence (opt3) from DENV-1__KC692508__SS-prME
  source 1..9879: mol_type = other RNA
agcgtgaccatgctgctcatgcttctgcccacagccttggctttccacttaactacgagaggcggggaacctcatatgatcgtctccaagcaggaaaggggaaaatctctgctatttaagacctcagctggtgttaacatgtgcaccctcattgccatggacctgggcgaactttgtgaagatactatgacctacaaatgcccacggataacagaagcggaaccggacgatgtggactgttggtgcaatgctaccgatacttgggtaacatatgggacctgtagtcaaacgggagaacaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctttggtggccctataagccaacataattacagaccagggtatttcacccagactgcgggaccgtggcacctcggcaagctggaacttgattttgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagattccgcggggaagacggatgctggtacggcatggaaatcaggcccgttaaggagaaagaagagaatctggtgcgaagtatggtaagcgccggttctggcgaagtggattccttttcacttgggattctgtgtgtcagtatcatgatagaggaggtgatgcggagccgttggtcgagaaagatgttgatgactggaacactcgctgttttcctgctactgattatgggccagctcacctggaacgacctgatcaggctttgcatcatggtgggggccaatgcatccgaccgcatgggaatgggcacaacttacttggctctgatggccacctttaagatgcggcctatgttcgcagtcggtttactctttagaaggctgacgtctcgagaagtgcttctgctaacaattgggctcagcctggttgcctcagtggagttgccaaacagtctggaagagttaggagatggcctcgctatgggcatcatgatgctgaaacttctgaccgagttccaaccccaccagttgtggactaccctcctgtccctaacatttgtcaagactaccctgtctcttgactatgcgtggaaaacgacagccatggtactcagcattgtgtccctgttcccgttgtgtctgtcaaccactagccagaagacaacctggttacctgttctcctggggagttttggatgcaaaccacttactatgttcctgataacagagaacaagatctggggtcgcaagtcttggcccttgaatgagggcattatggcaatcgggattgtgtccatcctcctgagctcgctactgaaaaacgatgtccctcttgctggacccctcatagccggcggtatgctgatcgcctgttacgtgatttcagggtctagtgctgacttgtccttagaaaaggcagccgaggtaagctgggaacaggaggcggaacattctggagctagccacaatatcctggtggaggtccaagatgacggcaccatgaaaattaaggatgaggaacgggacgatacgctcactatcctgcttaaagccaccctgttggcagtttccggcgtgtatccaatgtcaatacctgccacactattcgtgtggtacttttggcagaagaaaaagcagagaagtggggtcctgtgggacacccccagcccaccggaggtggaaagggctgttctcgatgacggaatttatcgtatcctgcagcgcggtcttttaggccggtctcaagtaggggtgggagtcttccaggatggcgtgtttcatacaatgtggcacgttactagaggtgcagtgctgatgtaccaggggaagaggctcgagccttcctgggcctcagtcaaaaaggacttgatcagttatggaggcggctggcgattccaggggagctggaacaccggagaggaagtgcaagtaattgcggtcgagcccggtaaaaatccaaagaacgtgcagacgacacccggcacttttaaaacccctgaaggggaggttggagctatagccctggacttcaagccaggcacatccggttctcccatcgtgaatcgggaagggaagattgtcggactctacggcaacggcgtggttaccacttcggggacctacgtgagcgcaatcgcccaggctaaagcctcacaagagggacctctgccggagattgaagatgaggtctttaagaaacgcaatcttacaatcatggacctgcacccaggttccggcaagacgagaaggtatttgcccgcaatagtgcgggaagctatcaaacgaaagctaagaactctgattctcgcccctacccgcgtagtggcgagtgagatggccgaagcattaaaggggatgccaatcaggtaccagacaaccgctgttaaatctgagcatactggacgtgagattgtcgatctgatgtgccacgccacattcaccatgcggcttctgagccccgtgagagtgcctaactataatatgatcataatggacgaagctcattttacggatccggcatccattgccgccaggggctacatctcaactcgcgtcggtatgggggaggctgcggcaatcttcatgacagccacacccccaggatctgtagaggcttttcctcagagcaacgccgtgattcaggacgaggaacgagatatccccgagagaagttggaactccggctatgactggataaccgatttcccaggcaagactgtttggttcgtgcctagcattaaatctgggaacgacatcgcaaattgtctccggaagaacggaaaaagggtcattcaattgtcacgcaagacatttgataccgagtaccagaagactaaaaataatgactgggactatgtggttactacggatatctccgaaatgggtgccaacttccgtgctgacagagtgatagatccccggaggtgcctgaagccagtcattctcaaagacggcccggagcgcgtgatcctggcggggcctatgcccgtaaccgtggccagtgcagctcagcgaagaggacggatcggcaggaatcagaacaaggaaggtgatcaatacgtttacatggggcagccacttaataacgacgaggagcacgcccattggacagaagcaaaaatgctactggataatattaacactcccgagggcatcattcctgccttgtttgaaccagagcgcgaaaagagcgctgccatagacggagagtatagattaaggggcgaggcgcggaagaccttcgtcgaactgatgcgtcgcggggatctccccgtgtggctgtcgtacaaagtggcatctgagggatttcagtattccgaccgaagatggtgcttcgatggtgaaaggaataaccaggtccttgaggaaaatatggacgttgagatctggacaaaggagggcgaacggaaaaagctgcgccctagatggctcgatgccaggacctacagcgacccgttggctctgcgggagtttaaagagttcgccgctgggcgaagatcagtgagtggagacctaattctggagatcggcaagctcccacaacaccttactctgcgcgcacagaacgccttagataatttggtaatgctgcacaactctgaacagggtgggaaggcttataggcatgccatggaggagctccccgacacgatcgaaaccctgatgcttctggcactcattgcggtgttgacaggcggagtcactctgtttttcttatccggcaaggggctaggaaagaccagcataggtctgctctgtgtgacagcctcaagtgcacttctgtggatggccagcgttgagcctcactggatcgcagcttccattatcttggaatttttcctgatggtgctcctgattcccgagccagatcggcagcgtacccctcaagacaatcagcttgcctacgtcgtaatcggcctcctgtttatgatattgactgtggcagccaacgagatggggctgttagaaacaacgaaaaaggatctaggaatcggctatgttgctgcggagaaccatcagcacgccaccatgctggacgtggatctccaccccgcatctgcttggactctttacgccgtcgccacaaccgtgattaccccaatgatgagacatacaatcgaaaatactacggcaaacattagcctgaccgctatcgccaatcaagcggctatattgatgggtctggacaaagggtggcctatttccaagatggatatcggcgtcccgctcctggcccttggatgctactcacaggtgaaccccttaacactgactgcagccgttctcatgttggtggctcactatgcaattatcggcccagggctgcaggccaaagcgaccagggaggctcagaagcgcacagccgcaggaataatgaagaatcctaccgtagacggcatcgtggccattgatctagaccccgtcgtttacgatgctaaattcgaaaagcaactgggtcagatcatgctccttattctgtgtacttctcagatcttgctgatgcggacgacatgggccctctgcgagagtataaccctggcaactgggccattaaccacactttgggagggatcgcctggcaaattctggaacactaccattgctgtgagcatggccaatatctttcgaggttcctatctggcgggcgccgggctcgcattctctctaatgaagtcactgggaggcgggagaaggggaacaggcgctcagggtgaaacgttgggggagaaatggaagcgccaactgaaccagctcagcaagtccgaatttaatacctacaaacggagtggaatcatggaggtcgacagatctgaagccaaggagggccttaaacgtggtgagactacaaagcatgcagtgagcaggggcaccgctaaactgcggtggttcgtagaacgcaacttggtgaagcccgaggggaaggttattgacctgggatgtggccgagggggatggtcatattactgcgccggcctcaaaaaggtgactgaagtcaaaggttatacaaaagggggaccgggccacgaggaaccaatccctatggccacctacggctggaatttagtgaaactgcattccgggaaggatgtctttttcatgcccccagagaaatgtgacacgcttctgtgcgatataggagagagtagccccaaccctaccattgaagagggtagaacactaagggtgctcaagatggttgaaccgtggctgcggggcaatcagttttgtatcaagattttgaacccctacatgccatctgtagtggagactctggagcagatgcaacgcaaacacgggggaatgctcgtcagaaatcctctttccaggaactcaacccacgaaatgtattgggtgagctgcggcacaggtaatatcgtttcggcggtgaacatgacttctcgaatgctgttaaaccggttcaccatggctcatcgtaagcccacatacgagagagacgtcgatctgggggcaggaacccgccacgtggccgtagaacctgaggtggctaatttggacataatcggccagaggattgaaaacatcaaaaatgagcataagagtacttggcactatgatgaggacaacccatacaaaacgtgggcctatcacggctcctacgaagttaagcccagcgggtcagcatcctctatggtcaatggagtggtgcggctcctgacaaagccttgggatgtcattccaatggttacccagatcgccatgactgacaccacaccctttggtcaacagagagtgttcaaagagaaggtagatacgcgcaccccgagggctaaacgaggcactacacagattatggaagtgaccgcgaagtggctatggagctttcttagtcggaacaaaaagcctagaatctgtactagggaggagttcacacgcaaggtccgttccaatgccgcaataggggctgtgtttgttgacgagaaccagtggaatagcgccaaagaggcagtggaagacgagcggttctgggatctggtccatagagaaagggagctccacaagcaaggaaaatgcgcaacctgcgtgtataacatgatgggcaagcgcgagaagaaactgggtgagttcgggaaagctaaaggatctcgagccatttggtacatgtggttgggcgcgcggtttctggagttcgaagcactcggctttatgaatgaggaccattggttctcaagagaaaacagtctttccggggtagagggagagggtctgcacaagttaggctacatcctgagggatatcagcaaaattccagggggaaatatgtatgccgacgatacagctggctgggacactcgcataaccgaagatgacttgcagaacgaggccaagatcacggatattatggaacccgagcatgcactcctggctacctctatctttaaactaacataccagaataaggttgtgagagtccagcggcctgccaaaaacggtactgtgatggacgtgatttcgaggcgtgatcaacgagggtcaggacaggtcggcacctatggccttaacacattcactaatatggaagttcagctgatccgccagatggagagcgaggggatatttctcccatccgaactggagacccccaacttggctgaaagagccttagactggctggagaagcacggagcagaacggctcaagaggatggcgatcagtggtgatgactgtgtggtaaaaccgattgacgatcgcttcgccacggctcttacagccctgaatgacatgggcaaggtgagaaaagatatccctcaatgggagccctctaaggggtggaacgactggcagcaggtcccattttgcagccaccatttccaccagctaattatgaaagatggacgggagatcgtggttccttgtaggaatcaagacgaactggtgggccgagcacgtgtctcccagggtgctgggtggtcactcagagagaccgcctgcttgggaaagagttacgcacagatgtggcaactgatgtattttcatcgccgggatcttaggctggccgcgaacgctatatgttctgccgtgcccgtagactgggttccagcaagcagaactacatggtccattcacgcccaccatcagtggatgaccactgaagatatgctctcagtgtggaatcgcgtctggatcgaggaaaacccctggatggaggacaagacccacgtgagctcttgggaggaagttccttacttaggcaaacgggaggatcagtggtgcggctccctgatcgggttgacagctagggccacgtgggcaaccaatattcaggtggctataaaccaagtccgaagactgatcggaaatgaaaactatctcgactacatgacaagtatgaagcggttcaaaaatgagagcgacccagagggtgccctttggtga

SEQ ID NO: 14137 - RNA, 9879 nt, synthetic construct
  misc_feature 1..9879: note = derived and/or modified CDS sequence (opt3) from DENV-1__KC692509__SS-prME
  source 1..9879: mol_type = other RNA
agcgtgaccatgctgctcatgcttctgcccactgccttggctttccacttaactacgaggggcggggagcctcatatgatcgtctccaaacaggaaaggggaaaatctctgctatttaagacctcagctggtgttaatatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaagggggtgtcttatgtcatgtgtacaggatccttcaaacttgaaaaggaggtggctgagactcagcacggtaccgttttggtgcaggtaaagtacgaaggcacggacgcgccttgcaaaataccatttagcacacaagatgagaagggggtcacccagaacggacgcctgatcactgcaaatcccattgtgacagacaaagaaaagcctgttaacatcgagaccgagccacccttcggcgaatcgtatatagtggtcggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtgttcacaagcgtagggaagctggtgcatcaggtttttggaacggcatacggcgtcttgttctccggtgtgtcttggaccatgaaaattgggatcggcattctcctgacttggttaggactgaatagccgctcaacaagtctatccatgacctgtatagcggtgggcatggtcacactctacctgggggttatggtgcaggctgatagcggatgcgtgatcaactggaagggcagagagcttaaatgtggttctgggatttttgtaactaacgaagtccacacctggacggagcaatataagttccaggccgactcaccgaagaggttgagtgcagccatcggaaaggcttgggaggaaggcgtgtgcggtatccggagcgccacacgcctggagaatattatgtggaagcagatatccaacgaactcaatcatatcctgttagagaacgatatgaaatttaccgttgtggtcggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtggaagactatggttttggggttttcactaccaacatttggcttaaattgcgtgatagctacacacagatgtgcgaccaccggctcatgtccgctgcaatcaaggattcaaaagccgtgcatgctgacatgggatattggatagagagtgaaaagaatgagacgtggaaactggcccgagcatctttcattgaagtaaagacctgtacttggccaaagagccacacactatggtccaacggcgtcctggagtcagagatgatcattcccaaaatctttggtggccctataagccaacataattacagaccagggtatttcacccagactgcgggaccgtggcacctcggcaagctggaacttgattttgacttgtgcgaggggacaaccgtggtggtcgatgaacactgcggaaacaggggcccctctctgcgcacgactaccgttacaggtaaaatcattcatgagtggtgttgccggtcctgtaccttacctccactcagattcagaggggaagacggatgctggtacggcatggaaatccgccccgtgaaggagaaagaagagaatctggtacgaagtatggtgagcgccggttctggcgaagtcgattccttttcacttgggattctgtgtgtgagtatcatgatagaggaggttatgcggagccgttggtcgagaaagatgttgatgactggaacactcgctgtgttcctgctactgattatgggccagctcacctggaacgacctgatcaggctttgcatcatggtcggggccaatgcatccgaccgcatgggaatgggcacaacttacttggctctgatggccacctttaagatgcggcctatgttcgcagtgggtttactctttagaaggctgacgtctcgagaagttcttctgctaacaattgggctcagcctggtggcctcagtcgagttgccaaacagtctggaagagttaggagatggcctcgctatgggcatcatgatgctgaaacttctgaccgagttccaaccccaccagttgtggactaccctcctgtccctaacatttgtacgcactaccctgtctcttgactatgcgtggaagacgacagccatggtgctcagcattgtttccctgttcccgttgtgtctgtcaaccactagccagaaaacaacctggttacctgtgctcctggggagttttggatgcaagccacttactatgttcctgataacagagaacaaaatctggggtcggaagtcttggcccttgaatgagggcattatggcaatcgggattgtctccatcctcctgagctcgctactgaagaacgatgtgcctcttgctggacccctcatagccggcggtatgctgatcgcctgttacgtaatttcagggtctagtgctgacttgtccttagaaaaagcagccgaggtgagctgggaacaggaggcggaacattctggagctagccacaatatcctggtcgaggttcaagatgacggcaccatgaagattaaagatgaggaaagagacgatacgctcactatcctgcttaaggccaccctgttggcagtgtccggcgtgtatccaatgtcaatacctgccacactattcgtctggtacttttggcagaaaaagaaacagaggagtggggtgctgtgggacacccccagcccaccggagatggaacgtgctgttctcgatgacggaatttatcgcatcctgcagcggggtcttttaggcagatctcaagtaggggtgggagtcttccaggatggcgtgtttcatacaatgtggcacgttactaggggtgcagtgctgatgtaccaggggaagcgactcgagccttcctgggcctcagtcaagaaagacttgatcagttatggaggcggctggcggttccaggggagctggaacaccggagaggaagtgcaagtaattgcggtcgagcccggtaagaatcccaaaaatgtgcagacgacacccggcacttttaagacccctgaaggggaggttggagctatagccctggacttcaaaccaggcacatccggttctcccatcgtgaatcgcgaagggaagattgtcggactctacggcaacggcgtggttaccacttcggggacctacgtgagcgcaatcgcccaggctaaggcctcacaagagggacctctgccggagattgaagatgaggtctttaaaaagagaaatcttacaatcatggacctgcacccaggttccggcaaaacgaggcggtatttgcccgcaatagtgcgagaagctatcaagagaaaactacgcactctgattctcgcccctaccagggtagtggcgagtgagatggccgaagcattaaaggggatgccaatccgttaccagacaaccgctgttaagtctgagcatactggacgggagattgtcgatctgatgtgccacgccacattcaccatgagacttctgagccccgtgagggtgcctaactataatatgatcataatggacgaagctcattttacggatccggcatccattgccgcccgcggctacatctcaactcgagtcggtatgggggaggctgcggcaatcttcatgacagccacaccaccaggatctgtagaggcttttcctcagagcaacgccgtgattcaggacgaggaaagagatatccccgagcggagttggaactccggctatgactggataaccgatttcccaggcaaaactgtttggttcgtgcctagcattaagtctgggaacgacatcgcaaattgtctcaggaaaaacggaaagcgcgtcattcaattgtcacgtaaaacatttgataccgagtaccagaagacaaagaacaatgactgggactatgtggttactacggatatctccgaaatgggtgccaacttcagagctgaccgggtgatagatcccaggcgctgcctgaaaccagtcattctcaaggacggcccggagcgagtgatcctggcggggcctatgcccgtaaccgtggccagtgcagctcagagacggggaaggatcggccgcaatcagaacaaagaaggtgatcaatacgtttacatggggcagccacttaataacgacgaggatcacgcccattggacagaggcaaagatgctactggacaatattaacactcccgaaggcatcattcctgccttgtttgagccagaaagagagaaaagcgctgccatagatggagaatataggttacggggcgaggcgcgtaagaccttcgtcgagctgatgcgccgaggggacctccccgtgtggctgtcgtacaaggtggcatctgaaggatttcagtattccgatagaaggtggtgcttcgacggtgagcggaataaccaggtccttgaagagaatatggatgttgaaatctggacaaaagagggcgagcgcaagaaactgagacctaggtggctcgacgcccggacctacagcgacccgttggctctgcgagaatttaaggagttcgccgctgggagacgctcagtgagtggagatctaattctggaaatcggcaaactcccacaacaccttactctgagggcacagaacgccttagacaatttggtaatgctgcacaactctgagcagggtgggaaggcttatcggcatgccatggaagaactccccgatacgatcgagaccctgatgcttctggcactcattgcggtgttgacaggcggagtcactctgtttttcttatccggcaaagggctaggaaagaccagcataggtctgctctgtgtgacagcctcaagtgcacttctgtggatggccagcgttgaacctcactggatcgcagcttccattatcttggagtttttcctgatggtgctcctgattcccgaaccagaccgtcagagaacccctcaagataatcagcttgcctacgtcgtaatcggcctcctgtttatgatattgactgtggcagccaacgagatggggctgttagagacaacgaagaaagacctaggaatcggctatgttgctgcggaaaaccatcagcacgccaccatgctggatgtggacctccaccccgcatctgcttggactctttacgccgtcgccacaaccgtgattaccccaatgatgaggcatacaatcgagaatactacggcaaacattagcctgaccgctatcgccaatcaagcggctatattgatgggtctggataaggggtggcctatttccaaaatggacatcggcgtcccgctcctggcccttggatgctactcacaggtgaaccccttaacactgactgcagccgttctcatgttggtggctcactatgcaattatcggcccagggctgcaggccaaggcgacccgcgaagctcagaaacggacagccgcaggaataatgaagaatcctaccgtagatggcatcgtggccattgacctagatcccgtcgtttacgacgctaagttcgagaaacaactgggtcagatcatgctccttattctgtgtacttctcagatcttgctgatgcgaacgacatgggccctctgcgaaagtataaccctggcaactgggccattaaccacactttgggagggatcgcctggcaagttctggaacactaccattgctgtgagcatggccaatatctttagaggttcctatctggcgggcgccgggctcgcattctctctaatgaaatcactgggaggcgggaggcgcggaacaggcgctcagggtgagacgttgggggaaaagtggaaacggcaactgaaccagctcagcaagtccgagtttaatacctacaagagaagtggaatcatggaagtcgaccgttctgaggccaaagaaggccttaagaggggtgagactacaaaacatgcagtgagccggggcaccgctaagctgcgctggttcgtagagcgaaacttggtgaaacccgaagggaaggttattgatctgggatgtggcagagggggatggtcatattactgcgccggcctcaagaaagtgactgaggtcaagggttatacaaaagggggaccgggccacgaagaaccaatccctatggccacctacggctggaatttagtgaagctgcattccgggaaagacgtctttttcatgcccccagaaaagtgtgatacgcttctgtgcgacataggagagagtagccccaaccctaccattgaggaaggtaggacactacgggtgctcaaaatggttgagccgtggctgcgcggcaatcagttttgtatcaagattttgaacccctacatgccatctgtagtggaaactctggagcagatgcaaagaaagcacgggggaatgctcgtcaggaatcctctttcccgaaactcaacccacgagatgtattgggtgagctgcggcacaggtaatatcgtttcggcggtgaacatgacttctcggatgctgttaaaccgtttcaccatggctcatagaaaacccacatacgaacgcgatgtcgacctgggggcaggaaccaggcacgtggccgtagagcctgaagtggctaatttggatataatcggccagcggattgagaacatcaagaatgaacataaaagtacttggcactatgacgaggataacccatacaagacgtgggcctatcacggctcctacgaggttaaacccagcgggtcagcatcctctatggtcaatggagtggtgagactcctgacaaagccttgggacgtcattccaatggttacccagatcgccatgactgataccacaccctttggtcaacagcgcgtgttcaaggaaaaagtagacacgaggaccccgcgagctaagcggggcactacacagattatggaggtgaccgcgaaatggctatgggggtttcttagcagaaacaagaaacctaggatctgtactcgcgaagagttcacacgtaaggtccggagtaatgccgcaataggagctgtgtttgttgacgaaaaccagtggaactccgccaaggaggcagtggaggatgaaagattctgggacctggtccatagggagcgcgaactccacaaacaaggcaagtgcgcaacctgcgtgtataacatgatgggtaaacgagagaagaaactgggggagttcggaaaggctaagggcagccgggccatttggtacatgtggttgggcgcgagatttctggagttcgaggcactcgggtttatgaatgaagatcattggttctctagggagaactcacttagtggagtagaaggtgagggcctgcacaaattagggtacatcctgcgcgacatctccaagattccaggaggcaatatgtatgccgatgacacagctggttgggatactagaataaccgaggacgatttgcagaacgaagccaaaatcacggacattatggagcccgaacatgcactcctggctaccagcatctttaagctaacataccagaataaagttgtgcgggtccagaggcctgccaagaacgggactgtgatggatgtgatttctcgtcgagaccaacgcggatcgggccaggtcggcacctatgggcttaacacattcactaatatggaggttcagctgatcagacagatggaatcagagggaatatttctcccaagcgagctggaaacccccaacttggctgagcgggccttagattggctggaaaaacacggtgcagagaggctcaagcgcatggcgatctccggcgacgactgtgtggtaaagccgattgatgacagattcgccacggctcttacagccctgaatgatatggggaaagtgcggaaggacatccctcaatgggaacccagtaaaggatggaacgattggcagcaggtcccattttgctctcaccatttccaccagctaattatgaaggacggcagggagatcgtggttccttgtcgaaatcaagatgagctggtgggtcgtgcaagagtcagccagggggctggatggtccctccgcgaaaccgcctgcttgggcaaatcatacgcacagatgtggcaactgatgtattttcatcggagggaccttagactggccgcgaacgctatatgtagtgccgtgcccgtagattgggttccagcatctcgcactacatggagcattcacgcccaccatcagtggatgaccactgaggacatgctctccgtgtggaatcgggtctggatcgaagagaacccctggatggaagataagacccacgtgtcaagctgggaggaggttccttacttaggcaagagggaagaccagtggtgcgggtctctgatcggattgacagctcgagccacgtgggcaaccaatattcaggtggctatatcccaagtcagacggctgatcggtaacgagaattatctcgactacatgacaagtatgaaaaggttcaagaacgaaagcgatccagagggcgccctttggtga

SEQ ID NO: 14138 - RNA, 9879 nt, synthetic construct
  misc_feature 1..9879: note = derived and/or modified CDS sequence (opt3) from DENV-1__KC692510__SS-prME
  source 1..9879: mol_type = other RNA
agcgtgaccatgctgctcatgcttctgcccaccgccttggctttccacttaactacgagaggaggggaacctcatatgatcgtctccaagcaggaaaggggaaaatctctgctatttaagacctcagctggtgttaatatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggctccccatgtcggcttgggtctcgaaactagaaccgagacatggatgtcctctgaaggggcctggaggcagatccagcgggtggagacttgggccctgcgccaccctggattcaccgttattgcatttttcctggcccatgctatcggcacatcgattacccagaaaggcatcatatttatcctcttaatgctggtgacgccatcaatggccatgagatgcgtcgggattggaaacagggacttcgtggagggtcttagcggcgcgacttgggtagatgttgtgttggaacacgggagttgtgtcacaaccatggcaaagaataagcccactctggacatcgagctactcaaaacagaagtgaccaaccctgccgtgctgcggaaactttgcattgaggctaaaatctccaatacgaccacagattctcgctgtccaactcaaggagaagccaccctggtcgaggagcaggacgcaaactttgtttgccgaagaacattcgtggataggggctggggtaatgggtgtggattgtttggcaagggcagcctcctgacttgcgctaaattcaagtgcgtaaccaagttagaagggaaaatagtgcagtacgagaacctgaagtattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccacggactggattggactttaacgagatggtcctactgacaatgaaagaaaagagctggctcgtgcataaacagtggttcctggatcttccgctgccctggacgtctggcgcatccacctcacaagaaacttggaatcgtcaggacttgctcgtaacatttaagaccgctcacgccaaaaagcaggaggttgtggtcctgggtagccaagaaggggctatgcacacagccttaactggcgcaaccgagatccagacgagtggaaccacaactattttcgccggccatctgaagtgccgcctaaaaatggataagctcaccctgaaagggatgtcttatgtgatgtgtacaggatccttcaaacttgaaaaagaggtcgctgagactcagcacggtaccgtgttggttcaggtgaagtacgaaggcacggacgcgccttgcaagataccatttagcacacaagatgagaaaggggtaacccagaacggaagactgatcactgcaaatcccattgtcacagacaaggaaaaacctgtgaacatcgagaccgagccacccttcggcgaatcgtatatagttgtgggtgccggggagaaggctctcaaactgtcttggtttaagaggggctcctcaattggaaagatgttcgaagccactgcacggggcgcccgacgcatggctatccttggggataccgcctgggactttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagcagatcaacaagtctatccatgacctgtatagcggtgggcatggtgacactctacctgggggtcatggttcaggctgatagcggatgcgtgatcaactggaaaggcagggagcttaagtgtggttctgggatttttgtgactaacgaagtacacacctggacggagcaatataaattccaggccgactcaccgaagcggttgagtgcagccatcggaaaggcttgggaggaaggcgtctgcggtatccgcagcgccacaagactggagaatattatgtggaaacagatatccaacgaactcaatcatatcctgttagagaacgatatgaagtttaccgtggttgtgggcgacgcaaatgggattctggctcagggcaagaagatgatcaggcctcaacccatggaacacaaatactcttggaagtcgtggggcaaagccaagattatcggggcggacatacagaacactaccttcatcattgatggaccagacacacctgagtgtcccgatggccagcgtgcctggaatatctgggaggtcgaagactatggttttggggtgttcactaccaacatttggcttaagttgcgggatagctacacacagatgtgcgaccaccgactcatgtccgctgcaatcaaagattcaaaggccgttcatgctgacatgggatattggatagagagtgagaagaatgagacgtggaagctggccagagcatctttcattgaagtgaaaacctgtacttggccaaagagccacacactatggtccaacggcgtactggagtcagagatgatcattcccaagatctttggtggccctataagccaacataattacaggccagggtatttcacccagactgcgggaccgtggcacctcggcaaactggaacttgattttgacttgtgcgaggggacaaccgtcgtggtggatgaacactgcggaaaccgcggcccctctctgcggacgactaccgtcacaggtaagatcattcatgagtggtgttgcagatcctgtaccttacctccactcaggttccgcggggaggacggatgctggtacggcatggaaatccgacccgttaaagagaaggaagagaatctggtgcggagtatggtaagcgccggttctggcgaagtggattccttttcacttgggattctgtgtgtcagtatcatgatagaggaggtgatgcgtagcagatggtcgaggaaaatgttgatgactggaacactcgctgttttcctgctactgattatgggccagctcacctggaacgacctgatccgcctttgcatcatggtgggggccaatgcatccgaccggatgggaatgggcacaacttacttggctctgatggccacctttaagatgagacctatgttcgcagtcggtttactctttaggcgactgacgtctcgcgaagtgcttctgctaacaattgggctcagcctggttgcctcagtggagttgccaaacagtctggaagagttaggagatggcctcgctatgggcatcatgatgctgaaacttctgaccgagttccaaccccaccagttgtggactaccctcctgtccctaacatttgtcaaaactaccctgtctcttgactatgcgtggaagacgacagccatggtactcagcattgtgtccctgttcccgttgtgtctgtcaaccactagccagaaaacaacctggttacctgttctcctggggagttttggatgcaagccacttactatgttcctgataacagagaacaaaatctggggtcggaagtcttggcccttgaatgagggcattatggcaatcgggattgtgtccatcctcctgagctcgctactgaagaacgatgtccctcttgctggacccctcatagccggcggtatgctgatcgcctgttacgtgatttcagggtctagtgctgacttgtccttagaaaaagcagccgaggtaagctgggaacaggaggcggaacattctggagctagccacaatatcctggtggaggtccaagatgacggcaccatgaagattaaagatgaggaaagagacgatacgctcactatcctgcttaaggccaccctgttggcagtttccggcgtgtatccaatgtcaatacctgccacactattcgtgtggtacttttggcagaaaaagaaacagaggagtggggtcctgtgggacacccccagcccaccggaggtggaacgtgctgttctcgatgacggaatttatcgcatcctgcagcggggtcttttaggcagatctcaagtaggggtgggagtcttccaggatggcgtgtttcatacaatgtggcacgttactaggggtgcagtgctgatgtaccaggggaagcgactcgagccttcctgggcctcagtcaagaaagacttgatcagttatggaggcggctggcggttccaggggagctggaacaccggagaggaagtgcaagtaattgcggtcgagcccggtaagaatcccaagaatgtgcagacgacacccggcacttttaagacccctgaaggggaggttggagctatagccctggacttcaaaccaggcacatccggttctcccatcgtgaatcgcgaagggaagattgtcggactctacggcaacggcgtggttaccacttcggggacctacgtgagcgcaatcgcccaggctaaggcctcacaagagggacctctgccggagattgaagatgaggtctttaaaaagagaaatcttacaatcatggacctgcacccaggttccggcaaaacgaggcggtatttgcccgcaatagtgcgagaagctatcaagagaaaactacgcactctgattctcgcccctaccagggtagtggcgagtgagatggccgaagcattaaaggggatgccaatccgttaccagacaaccgctgttaagtctgagcatactggacgggagattgtcgatctgatgtgccacgccacattcaccatgagacttctgagccccgtgagggtgcctaactataatatgatcataatggacgaagctcattttacggatccggcatccattgccgcccgcggctacatctcaactcgagtcggtatgggggaggctgcggcaatcttcatgacagccacaccaccaggatctgtagaggcttttcctcagagcaacgccgtgattcaggacgaggaaagagatatccccgagcggagttggaactccggctatgactggataaccgatttcccaggcaaaactgtttggttcgtgcctagcattaagtctgggaacgacatcgcaaattgtctcaggaaaaacggaaagcgcgtcattcaattgtcacgtaaaacatttgataccgagtaccagaagacaaagaacaatgactgggactatgtggttactacggatatctccgaaatgggtgccaacttcagagctgaccgggtgatagatcccaggcgctgcctgaaaccagtcattctcaaggacggcccggagcgagtgatcctggcggggcctatgcccgtaaccgtggccagtgcagctcagagacggggaaggatcggccgcaatcagaacaaagaaggtgatcaatacgtttacatggggcagccacttaataacgacgaggatcacgcccattggacagaggcaaagatgctactggacaatattaacactcccgaaggcatcattcctgccttgtttgagccagaaagagagaaaagcgctgccatagatggagaatataggttacggggcgaggcgcgtaagaccttcgtcgagctgatgcgccgaggggacctccccgtgtggctgtcgtacaaggtggcatctgaaggatttcagtattccgatagaaggtggtgcttcgacggtgagcggaataaccaggtccttgaagagaatatggatgttgaaatctggacaaaagagggcgagcgcaagaaactgagacctaggtggctcgacgcccggacctacagcgacccgttggctctgcgagaatttaaggagttcgccgctgggagacgctcagtgagtggagatctaattctggaaatcggcaaactcccacaacaccttactctgagggcacagaacgccttagacaatttggtaatgctgcacaactctgagcagggtgggaaggcttatcggcatgccatggaagaactccccgatacgatcgagaccctgatgcttctggcactcattgcggtgttgacaggcggagtcactctgtttttcttatccggcaaagggctaggaaagaccagcataggtctgctctgtgtgacagcctcaagtgcacttctgtggatggccagcgttgaacctcactggatcgcagcttccattatcttggagtttttcctgatggtgctcctgattcccgaaccagaccgtcagagaacccctcaagataatcagcttgcctacgtcgtaatcggcctcctgtttatgatattgactgtggcagccaacgagatggggctgttagagacaacgaagaaagacctaggaatcggctatgttgctgcggaaaaccatcagcacgccaccatgctggatgtggacctccaccccgcatctgcttggactctttacgccgtcgccacaaccgtgattaccccaatgatgaggcatacaatcgagaatactacggcaaacattagcctgaccgctatcgccaatcaagcggctatattgatgggtctggataaggggtggcctatttccaaaatggacatcggcgtcccgctcctggcccttggatgctactcacaggtgaaccccttaacactgactgcagccgttctcatgttggtggctcactatgcaattatcggcccagggctgcaggccaaggcgacccgcgaagctcagaaacggacagccgcaggaataatgaagaatcctaccgtagatggcatcgtggccattgacctagatcccgtcgtttacgacgctaagttcgagaaacaactgggtcagatcatgctccttattctgtgtacttctcagatcttgctgatgcgaacgacatgggccctctgcgaaagtataaccctggcaactgggccattaaccacactttgggagggatcgcctggcaagttctggaacactaccattgctgtgagcatggccaatatctttagaggttcctatctggcgggcgccgggctcgcattctctctaatgaaatcactgggaggcgggaggcgcggaacaggcgctcagggtgagacgttgggggaaaagtggaaacggcaactgaaccagctcagcaagtccgagtttaatacctacaagagaagtggaatcatggaagtcgaccgttctgaggccaaagaaggccttaagaggggtgagactacaaaacatgcagtgagccggggcaccgctaagctgcgctggttcgtagagcgaaacttggtgaaacccgaagggaaggttattgatctgggatgtggcagagggggatggtcatattactgcgccggcctcaagaaagtgactgaggtcaagggttatacaaaagggggaccgggccacgaagaaccaatccctatggccacctacggctggaatttagtgaagctgcattccgggaaagacgtctttttcatgcccccagaaaagtgtgatacgcttctgtgcgacataggagagagtagccccaaccctaccattgaggaaggtaggacactacgggtgctcaaaatggttgagccgtggctgcgcggcaatcagttttgtatcaagattttgaacccctacatgccatctgtagtggaaactctggagcagatgcaaagaaagcacgggggaatgctcgtcaggaatcctctttcccgaaactcaacccacgagatgtattgggtgagctgcggcacaggtaatatcgtttcggcggtgaacatgacttctcggatgctgttaaaccgtttcaccatggctcatagaaaacccacatacgaacgcgatgtcgacctgggggcaggaaccaggcacgtggccgtagagcctgaagtggctaatttggatataatcggccagcggattgagaacatcaagaatgaacataaaagtacttggcactatgacgaggataacccatacaagacgtgggcctatcacggctcctacgaggttaaacccagcgggtcagcatcctctatggtcaatggagtggtgagactcctgacaaagccttgggacgtcattccaatggttacccagatcgccatgactgataccacaccctttggtcaacagcgcgtgttcaaggaaaaagtagacacgaggaccccgcgagctaagcggggcactacacagattatggaggtgaccgcgaaatggctatgggggtttcttagcagaaacaagaaacctaggatctgtactcgcgaagagttcacacgtaaggtccggagtaatgccgcaataggagctgtgtttgttgacgaaaaccagtggaactccgccaaggaggcagtggaggatgaaagattctgggacctggtccatagggagcgcgaactccacaaacaaggcaagtgcgcaacctgcgtgtataacatgatgggtaaacgagagaagaaactgggggagttcggaaaggctaagggcagccgggccatttggtacatgtggttgggcgcgagatttctggagttcgaggcactcgggtttatgaatgaagatcattggttctctagggagaactcacttagtggagtagaaggtgagggcctgcacaaattagggtacatcctgcgcgacatctccaagattccaggaggcaatatgtatgccgatgacacagctggttgggatactagaataaccgaggacgatttgcagaacgaagccaaaatcacggacattatggagcccgaacatgcactcctggctaccagcatctttaagctaacataccagaataaagttgtgcgggtccagaggcctgccaagaacgggactgtgatggatgtgatttctcgtcgagaccaacgcggatcgggccaggtcggcacctatgggcttaacacattcactaatatggaggttcagctgatcagacagatggaatcagagggaatatttctcccaagcgagctggaaacccccaacttggctgagcgggccttagattggctggaaaaacacggtgcagagaggctcaagcgcatggcgatctccggcgacgactgtgtggtaaagccgattgatgacagattcgccacggctcttacagccctgaatgatatggggaaagtgcggaaggacatccctcaatgggaacccagtaaaggatggaacgattggcagcaggtcccattttgctctcaccatttccaccagctaattatgaaggacggcagggagatcgtggttccttgtcgaaatcaagatgagctggtgggtcgtgcaagagtcagccagggggctggatggtccctccgcgaaaccgcctgcttgggcaaatcatacgcacagatgtggcaactgatgtattttcatcggagggaccttagactggccgcgaacgctatatgtagtgccgtgcccgtagattgggttccagcatctcgcactacatggagcattcacgcccaccatcagtggatgaccactgaggacatgctctccgtgtggaatcgggtctggatcgaagagaacccctggatggaagataagacccacgtgtcaagctgggaggaggttccttacttaggcaagagggaagaccagtggtgcgggtctctgatcggattgacagctcgagccacgtgggcaaccaatattcaggtggctataaaccaagtcagacggctgatcggtaatgagaactatctcgactacatgacttccatgaaaaggttcaagaatgaaagtgatccagagggcgccctttggtga

SEQ ID NO: 14139 - RNA, 9879 nt, synthetic construct
  misc_feature 1..9879: note = derived and/or modified CDS sequence (opt3) from DENV-1__KC692511__SS-prME
  source 1..9879: mol_type = other RNA
agcgtgaccatgctgctcatgcttctgcccacagccttggctttccacttaactacgagaggcggggagcctcatatgatagtctccaagcaggaaagaggcaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggcaccacatgtgggcttgggtctcgagactagaaccgaaacatggatgtcctctgagggggcatggaaacagatccagaaggttgaaaactgggccctgaggcaccctggattcactgtgattgctctgtttctcgcacatgccatcggcacctcgattacacagaagggcatcatattcatcttactgatgcttgtcaccccatcaatggctatgcggtgcgtggggattggaaatcgcgattttgtagagggtttgagcggcgccacgtgggttgacgtggtcctggagcacgggagttgtgtgactacaatggcgaaaaacaagcccaccctagatatcgaactcctgaaaactgaggtgacaaatcctgcagtccttagaaagctgtgcattgaagccaaaatctccaacaccacgaccgactctaggtgtccaacacaaggagaggctactttggttgaggaacaagatgccaatttcgtgtgccggcgcacctttgtagaccgaggctggggtaacgggtgtggactcttcggcaagggcagcctgttaacatgcgcaaagtttaaatgcgtgactaagctggaggggaaaatagtccagtacgaaaatctcaagtattccgtgattgttaccgtgcacacaggagatcagcatcaagtcggtaacgagaccactgaacacggcacgatcgctacaattactccccaagcccctacctcagagatccagcttaccgactacggggcgctgacattggactgtagtccaagaaccggactagatttcaatgaaatggtgctgctcactatgaaagaaaagagctggctggtacataaacagtggtttcttgacctgccgttgccctggacatctggcgcctccacgtcacaagagacctggaacaggcaggatctcctggttactttcaagacagcacacgctaagaaacaggaagtggtcgtgttaggtagccaagagggggccatgcacaccgctctgacaggcgccactgaaatccagaccagtggaacgaccacaatttttgcaggccatctaaagtgccggctcaaaatggacaagctgactcttaaagggatgtcttatgtcatgtgtaccggatccttcaagttggagaaggaagtggccgagacacagcacggtactgttctggtgcaggtaaaatacgagggcaccgatgctccttgcaagataccattcctcacgcaagacgaaaaaggggtcacacagaatggacgtctgatcaccgcgaaccccattgtgactgataaggagaaacctgttaatatcgaaacagagccaccctttggcgagagctatatagtggtcggtgcaggggaaaaggcccttaagctgtcgtggttcaaaaagggatcttccattggaaaaatgtttgaggctaccgcccgcggcgcaagaaggatggccatcttgggggacactgcttgggatttcggatcaatcggtggcctctttaccagtgtggggaagctgattcatcagatcttcggaacagcctacggcgtattatttagcggtgtgtcctggacgatgaaaattgggataggcatcctgctaacctggctcggactgaactctcggagcacttcacttagtatgacatgtattgcagttggcatggtcaccttgtacctgggggtgatggtgcaggcggactccggatgcgtcatcaactggaagggccgagaactcaagtgtggtagcgggatcttcgttacaaatgaggtgcacacttggaccgaacaatataaatttcaggctgattctccgaagcgcctgtcagccgcaattggaaaagcctgggaggagggcgtgtgcggtataagaagtgctacgaggttagaaaacatcatgtggaagcagattagcaatgagctgaactacatccttttggaaaatgacatgaaattcacagtagtcgtgggcgacattaacgggatcctcgcccagggaaagaaaatgatacggcctcaacccatggagcataagtattcctggaagtcttggggcaaagcaaagatcattggggctgatatccagaataccacttttattatcgacggaccagatacccctgaatgtcccaacgaccagcgcgcctggaatatatgggaggttgaggattacggcttcggtatttttacaactaacatctggctgaaactaagagactcgcacacccagatgtgcgatcacaggctgatgagcgcggccattaaggactccaaagctgtgcatgcagatatggggtattggatcgaatcagagaagaatgaaacatggaagctcgcccgtgctagtttcatagaggtcaaaacgtgtatctggccaaagtctcacaccctgtggagcaacggagtgcttgaatccgagatggttattcccaaaatctacggcggtcctatttcacaacataattatcggccaggctacttcactcagacagccgggccgtggcacttgggaaagctggagttagactttgatctctgcgaaggcaccactgtggtagtcgacgagcactgcgggtaccgaggacccagcctgagaacaaccacggtgactggcaaaatcatacatgaatggtgttgcaggtcttgtacccttcctccactgcgcttccggggtgaggatgggtgctggtatggaatggagattagacccgtgaaggaaaaggaggaaaacttggtcaggtccatggttagtgcaggcagcggtgaggtggactctttttccctcggcatcctgtgtgtatcaatcctaattgaagaggtgatgcgcagtcgatggagccggaaaatgctgatgacagggaccctcgcggtcttcctgcttttgatcatgggacagctgacttggaatgacttaattcgtctctgcataatggtgggcgccaacgcttcggatagaatggggatgggaacaacctacctggcccttatggcaacatttaagatgaggcctatgttcgctgttggcctgctatttcgccggctcacttccagagaggtgctgttgctgaccgtcggtttatctctcgtggccagcgttgaactgccaaactcacttgaggaactgggggacggattggcaatgggcatcatgatgctcaaactgctaacggatttccaaccccaccagctgtggacaacccttctcagtctgacttttattaggacctccttgtctctggactatgcctggaagacaatggctatggcgttaagcatcgtgtccctcttcccgctgtgtctttcaactaccagccagaaaacgacatggctgcctgtcttgctcggcagttttgggtgcaagccactgaccatgttcctaattactgagaataagatctggggacgaaaatcttggcccataaacgaaggtatcatggccgtaggcattgtgtccatcctgcttagctcgctcctgaagaatgatgttcctttggcagggcccttaattgctggaggcatgctgatcgcctgttacgtgatatcaggttctagtgccgacctctccctggagaaagctgcagaggtcagctgggaagaggaagccgagcattctgggacaagccacaacattcttgtggaagtacaggatgacggaaccatgaagatcaaagatgaggagcgcgacgatactctgacaatcttgctaaaggcgaccctgctcgctgtgtccggcgtctatccaatgtcaattcctgccacgctgtttgtttggtacttctggcagaaaaagaagcagcggagtggcgtgctttgggacactcccagcccaccggaagtggagagagcagtcttagatgacgggatatataggatcctgcagcgtggactcttgggtcgctctcaggtgggcgttggggtattccaagacggagtgtttcataccatgtggcacgtcacacggggcgccgtgctgatgtaccagggtaaaagactcgaaccttcctgggcttcagttaagaaagatctgattagttacgggggaggctggaggttccagggcagctggaataccggggaggaggtgcaggtcatcgcagtggaacccggaaagaaccccaaaaatgtacaaacaactcccggtacctttaagacgcctgagggcgaagtcggggccattgcgcttgacttcaagccaggaacatccggctctcccatcgtgaaccgagagggtaaaatagttgggctgtatggaaatggcgtggtcactacctcgggcacatacgtgagcgctatcgcccaggcaaaggccacccaggaagggcctttgccggagattgaggatgaagtttttaaaaagcggaacctaactatcatggacctgcacccaggatcaggtaaaacccgcagatatctccccgctattgtgagggaggccatcaagcggaagttacgaacactgatacttgcacctacgagagtcgtggcttccgaaatggccgaggcgctgaaaggcatgccaattcgctaccaaactaccgccgtaaagagtgaacatacagggagggagatcgtggatctcatgtgccacgcaaccttcactatgcgtttgctgtctcccgttcgggtccctaattataacatgatcattatggacgaggctcattttacagatccggccagcatcgctgcaagaggatacatatccaccagggtgggcatgggtgaagccgccgctattttcatgacggcgactcccccagggtcagtggaggcatttcctcagtctaatgccgtcatccaggacgaggaacgcgatattcccgaacgaagctggaacagtggatatgactggatcacagatttcccaggcaaaaccgtatggtttgtgccttccataaagagcggcaatgacattgctaactgtctcaggaaaaacgggaagcgggttatccagctgtctaggaagaccttcgacactgagtaccagaaaacgaagaataacgattgggactacgtggtcaccacagatatctcagagatgggagccaatttccgcgcagaccgtgtgattgatcccagacggtgccttaaaccagttatcctaaaggaaggtccggagagggtgattctggccggccctatgcccgtcactgtggcttccgcggcccagcgccgagggagaataggacggaaccagaataaagaaggcgaccagtatatctacatgggtcaaccattgaacaatgatgaggaccacgcacattggacggaggctaagatgttactggataacattaatacccccgaagggatcatccctgccctctttgagccagaaagggagaagagtgcagccattgacggcgaatatcgcctgagaggagaggctaggaaaacattcgtagagcttatgcggcgtggcgatctgcccgtgtggctcagctacaaggttgcctcggaagggtttcagtattctgaccgccgatggtgcttcgatggagagagaaacaatcaggtcttggaagagaacatggacgtggaaatatggactaaagagggtgagaggaagaaactgcggcctcgctggctagacgcgagaacctactccgatccgctggcactcagggaatttaaggagttcgccgctggccggcgaagcgtgtcaggggaccttatcctggaaattggaaaattaccacagcacttgacactgagagcccaaaatgctctcgataacctggtcatgcttcacaatagtgagcagggcggtaaggcatatcgccatgccatggaggagctgcccgacaccatcgagactctcatgttgctggctttaattgccgttctaacagggggcgtgaccctgtttttcctctctggaaagggccttgggaaaacatccatcggactgttgtgtgtaatggcaagctcagcgctgctctggatggccagtgtggaacctcactggatagctgccagcatcattctggagtttttccttatggtcctcctgatccccgaaccagataggcagcggactcctcaggacaaccaattggcatacgtggttattggtctgttatttatgatcctaaccgtggctgccaacgagatgggcctgctcgagacaaccaagaaagatcttgggataggacatgtcgcagtagaaaatcaccaccatgccactatgctggacgtggatttgcgtcccgcttccgcgtggacactgtacgccgttgcaacgaccgtgattactccaatgatgagacacacaatcgagaacaccaccgctaatatttctctcacagccatcgccaaccaggcagctatactgatgggccttgacaagggttggcctatcagcaaaatggatattggggtcccgttactggccctcggctgctattcccaggtgaatcccttgactctgacggcggctgtcctaatgctggtggcccattacgcaatcattggaccaggcctccaagccaaggctaccagggaagcacagaagcgcacagccgcggggatcatgaaaaaccctactgttgacggaatagtgaccattgatcttgaccccgtagtgtatgacgctaagttcgagaaacagctgggccagatcatgttgctgatcctctgtacatcacaaattctgttaatgcggaccacttgggccctttgcgaatctatcacgctggcaacaggtccactcaccactctatgggaggggagtcctggaaagttttggaataccacaatagccgtctcgatggctaacattttccgaggcagctacctggccggtgcaggcttggctttctccctgatgaaatctctcgggggaggcagaagggggactggagcccagggcgagacccttggtgaaaagtggaagcgccagctgaatcagttgtcaaaaagcgagtttaacacatataagaaatccgggatcatggaagttgatcggagtgaggcgaaggaaggactgaaaagaggcgagacgaccaagcacgccgtgtctcgtggtactgcaaagctcaggtggttcgtcgagcggaatttagtgaaacccgaaggcaaggtaattgacctggggtgtggacgcggcgggtggagctactattgcgctggacttaaaaaggtgacagaggttaaaggctacaccaagggtgggccgggacatgaggagccaatccctatggccacttacggctggaacctggtgaaactacactcaggcaaggatgtctttttcacacccccagaaaagtgtgacaccctcctgtgcgatataggggagtccagtcccaatcctacgatcgaggaaggacgaaccttgagagtgctgaaaatggtcgagccgtggctcaggggtaaccaattttgtattaagatccttaatccctatatgccaagcgtggttgaaacactggagcagatgcagcggaaacacggcgggatgttagtacgcaaccctctgtctagaaattccactcatgagatgtactgggtgtcatgcggaaccggcaacattgtcagcgcagtgaacatgacatcgaggatgttgctcaatcgattcactatggctcaccggaagcccacctatgaacgtgacgttgatctgggtgccgggacaagacatgtggccgtcgagcctgaagtggcgaacctagacatcattggacagcgcatcgagaatatcaaaaacgaacacaagtctacctggcactacgatgaggacaatccatataagacttgggcttaccatggcagttatgaggtaaaaccctccggcagcgcatcatccatggtgaacggggttgtcaggcttctgacgaagccttgggatgtgattccaatggtgacacaaatcgccatgaccgacactaccccctttggacagcagcgggtcttcaaagaaaaggttgacacaagaacgccgcgcgctaaaaggggtaccgcccaaatcatggaggtgactgcaaagtggctctggggctttctgtctcgaaataagaaacctcggatttgtacaagagaagagttcaccaggaaggtacgcagcaacgccgctataggggcggtgtttgtcgatgaaaatcagtggaacagtgccaaagaggcagtggaggacgaacgtttctgggatttggttcaccgggagagagaactgcataagcagggaaaatgcgctacttgcgtgtacaatatgatgggcaagagggagaagaaactcggtgaatttgggaaggccaaaggatcccgcgcaatctggtacatgtggcttggcgcccgattcctggagttcgaggctttaggctttatgaacgaagaccactggttcagccgggaaaattctctgtcaggggtcgaaggagagggtttgcataagctcggctatattctgagagatatcagtaaaattccagggggaaacatgtacgccgacgatacagcgggctgggacaccaggatcacagaggatgacctacagaatgaagcaaagataactgatatcatggagcccgaacacgcccttctggctacctccatttttaaactcacgtatcaaaacaaggtggtacgcgttcagagacctgccaagagcggtaccgtgatggacgtcatctctcggagggatcagcgtgggtcgggacaggtgggcacatacggcctgaacactttcaccaatatggaggtgcaattgattcgacagatggaatcagaggggatctttagcccatccgagttagaaacacccaacctggccaaaaaggtcctcgactggcttgagaaacacggagctgaacgcctgaagagaatggccataagtggtgacgattgtgttgtgaaaccgattgacgatcggttcgctactgccctaaccgcactgaatgacatgggcaaggtaaggaaggatatccctcagtgggagccctctaaagggtggaacgactggcagcaagtgccattttgcagccatcacttccatcagctcatcatgaaggatggacgcgaaattgtcgtgccttgtagaaatcaggacgagttggttggccgggcgagggtgtcccagggtgccgggtggtcactgcgagagacggcttgccttggaaaaagttatgcccaaatgtggcagctgatgtactttcaccgtagagatctccgcttagcagctaacgccatatgttctgcagtccccgtggactgggtaccaacaagccggaccacttggtccatccacgcccatcaccagtggatgacaaccgaagatatgctgtcagtttggaatagggtgtggattgaggaaaacccctggatggaggacaagactcatgtcagctcttgggaagaggtgccttatttgggcaaaagagaggaccaatggtgcggctccctgatcgggctcaccgcgcgcgctacatgggccacgaatattcaggttgcaatcaaccaggtgcggaggcttataggaaatgaaaactacctggattacatgaccagtatgaagcgattcaagaatgagagcgacccagaaggtgccctatggtga

SEQ ID NO: 14140 - RNA, 9879 nt, synthetic construct
  misc_feature 1..9879: note = derived and/or modified CDS sequence (opt3) from DENV-1__KC692512__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagactttgtggagggtttgagcggcgcgacttgggtagatgttgtgctggaacacgggagttgtgtcacaaccatggcaaagaataaacccactctagacatcgagctcctgaagacagaagtgaccaaccctgccgtgcttaggaaactgtgcattgaggctaagatctccaatacgaccacagattctcggtgtccaactcaaggagaagccaccttggtcgaggagcaggacgcaaacttcgtttgccgccgaacatttgtggatagaggctggggtaatgggtgtggactcttcggcaaaggcagcctgttaacttgcgctaagtttaagtgcgtaaccaaactggaagggaagatagtgcagtacgagaacctcaaatattccgtcattgtgacagttcacaccggagaccagcatcaagtgggtaatgaaactacggagcacggcacaatcgccaccattactccccaggcgcctacctcagaaatccagcttacagattacggggccctgaccttggactgtagtccaaggactggactagacttcaacgagatggtcctgctcacaatgaaggagaaaagctggctggtgcataagcagtggtttcttgatctgccgttgccctggacgtctggcgcatccacctcacaagaaacttggaatcggcaggacctcctggtaacattcaaaaccgctcacgccaagaagcaggaggttgtggtcttaggtagccaagaaggggctatgcacacagccctgactggcgcaaccgagatccagacgagtggaaccacaactatttttgccggccatctaaaatgccgtctcaagatggataaactgacccttaaggggatgtcttatgtgatgtgtacaggatccttcaaattggaaaaggaggtcgctgagactcagcacggtaccgtgctggttcaggtgaagtacgaaggcacggacgcgccttgcaaaataccattcagcacacaagatgagaagggggtaacccagaacggacgcctcatcactgcaaatcccattgtcacagacaaagaaaagcctgtgaacatcgagaccgagccaccctttggcgaatcgtatatagttgtgggtgccggggagaaagctctgaagctttcttggttcaagagaggctcctcaattggaaaaatgtttgaagccactgcaaggggcgcccggcgaatggctatcctgggggataccgcctgggacttcggaagtatcggtggcgtctttacaagcgtggggaagttggtacatcaggtgttcggaacggcatacggcgttctcttttccggtgtctcttggaccatgaaaattgggatcggcattctgttaacttggctgggactaaatagccgctcaacaagtctctccatgacctgtatagcggtgggcatggtgacactgtaccttggggtcatggttcaggctgatagcggatgcgtgatcaactggaagggcagagagttgaaatgtggttctgggattttcgtgactaacgaagtacacacctggacggagcaatataagtttcaggccgactcaccgaagaggctgagtgcagccatcggaaaagcttgggaggaaggcgtctgcggtatccggagcgccacacgcctcgagaatattatgtggaagcagatatccaacgaactgaatcatatcttactggagaacgatatgaaattcaccgtggttgtgggcgacgcaaatgggattcttgctcagggaaagaaaatgatcagacctcaacccatggaacacaagtactcttggaaatcgtggggcaaggccaagattatcggggcggacatacagaacactacctttatcattgatggaccagacacacctgagtgtcccgatggccagagggcctggaatatctgggaggtcgaagactatggtttcggggtgtttactaccaacatttggttgaaactccgtgatagctacacacagatgtgcgaccaccggctgatgtccgctgcaatcaaggattcaaaagccgttcatgctgacatgggatattggatagagagtgaaaagaatgagacgtggaaactagcccgagcatctttcattgaagtgaagacctgtacttggccaaagagccacacactgtggtccaacggcgtactcgagtcagagatgatcattcccaaaatcttcggtggccctataagccaacataattacagaccagggtattttacccagactgcgggaccgtggcacctgggcaagcttgaattggatttcgacctgtgcgaggggacaaccgtcgtggtggatgaacactgcggaaacaggggcccctctttacgcacgactaccgtcacaggtaaaatcattcatgagtggtgttgccggtcctgtaccctccctccactgagatttaggggggaggacggatgctggtacggcatggaaatccgccccgttaaggagaaagaagagaatcttgtgcgaagtatggtaagcgccggttctggcgaagtggattccttctcactggggattttgtgtgtcagtatcatgatagaggaggtgatgcggagccgttggtcgagaaagatgctcatgactggaacactggctgtttttctactgctcattatgggccagctgacctggaacgaccttatcaggttgtgcatcatggtgggggccaatgcatccgaccgcatgggaatgggcacaacttacctggctttaatggccaccttcaagatgcggcctatgtttgcagtcggtctcctgttcagaaggcttacgtctcgagaagtgctgctactcacaattgggctgagcttggttgcctcagtggagctgccaaacagtttagaagagctcggagatggcctggctatgggcatcatgatgcttaaactgttgaccgaatttcaaccccaccagctctggactaccctgctatccctgacattcgtcaagactaccctttctctcgactatgcgtggaaaacgacagccatggtactgagcattgtgtccttgtttccgctgtgtttatcaaccactagccagaagacaacctggctccctgttctgcttgggagtttcggatgcaaaccactgactatgtttttgataacagagaacaagatctggggtcgcaagtcttggcccctcaatgagggcattatggcaatcgggattgtgtccatcctgctaagctcgctgcttaaaaacgatgtccctctcgctggacccctgatagccggcggtatgttgatcgcctgttacgtgatttcagggtctagtgctgacttatccctggaaaaggcagccgaggtaagctgggaacaggaggcggaacattctggagctagccacaatatcctcgtggaggtccaagatgacggcaccatgaaaattaaggatgaggaacgggacgatacgctgactatccttctgaaagccaccttgctagcagtttccggcgtgtatccaatgtcaatacctgccacactgttcgtgtggtacttctggcagaagaaaaagcagagaagtggggtcctctgggacacccccagcccaccggaggtggaaagggctgttctggatgacggaatttatcgtatccttcagcgcggtttactgggccggtctcaagtaggggtgggagtctttcaggatggcgtgttccatacaatgtggcacgttactagaggtgcagtgctcatgtaccaggggaagaggttggagccttcctgggcctcagtcaaaaaggacctgatcagttatggaggcggctggcgatttcaggggagctggaacaccggagaggaagtgcaagtaattgcggtcgagcccggtaaaaatccaaagaacgtgcagacgacacccggcactttcaaaacccctgaaggggaggttggagctatagccctcgactttaagccaggcacatccggttctcccatcgtgaatcgggaagagaagattgtcgggctgtacggaaacggcgtggttaccacttcgggcacctacgtgagcgcaatcgcccaggctaaagcctcacaagaggggcctcttccggaaattgaggatgaagtcttcaagaaacgcaatctgacaatcatggacttgcacccaggatccggtaagacgagaaggtatctacccgcaatagtgcgggaggctatcaaacgaaagctgagaactctcattttagcccctacccgcgtagtggcgagtgaaatggccgaggcactgaagggcatgccaatcaggtaccagacaaccgctgttaaatctgagcatactgggcgtgaaattgtcgatcttatgtgccacgccacatttaccatgcggctgctcagccccgtgagagtgcctaactataatatgatcataatggacgaggctcatttcacggatccggcatccattgccgccaggggatacatctcaactcgcgtcggcatgggtgaagctgcggcaatctttatgacagccacccccccagggtctgtagaggctttccctcagagcaacgccgtgattcaggacgaagagcgagatatccccgagagaagttggaattccggatatgactggataaccgattttccaggcaagactgtttggttcgtgcctagcattaaatctggcaacgacatcgcaaattgtttgcggaagaacgggaaaagggtcattcaactgtcacgcaagacattcgataccgaataccagaagacaaaaaacaatgactgggactatgtggttactacggatatctccgagatgggagccaactttcgtgctgacagagtgatagatccccggaggtgcctcaagccagtcattctgaaagacggtccggaacgcgtgatccttgcgggccctatgcccgtaaccgtggccagtgcagctcagcgaagagggcggatcggaaggaatcagaacaaggagggcgatcaatacgtttacatgggtcagccactaaataacgacgaggatcacgcccattggacagaagcaaaaatgctgttggacaatattaacactcccgaggggatcattcctgccttattcgaaccagagcgcgaaaagagcgctgccatagatggcgagtatagactgaggggagaggcgcggaagacctttgtcgaactcatgcgtcgcggcgacctgcccgtgtggctttcgtacaaagtggcatctgaggggttccagtattccgatcgaagatggtgctttgacggagaaaggaataaccaggtcctggaggaaaatatggatgttgagatctggacaaaggagggtgaacggaaaaagctccgccctagatggttggacgccaggacctacagcgacccgctggctctacgggagttcaaagaatttgccgctggccgaagatcagtgagtggggatctgattctcgagatcggaaagcttccacaacacctgactttacgcgcacagaacgccttggacaatctggtaatgctccacaactctgaacagggcggtaaagcttataggcatgccatggaggagctgcccgatacgatcgaaacccttatgctgctcgcattgattgcggtgctgacagggggcgtcactttattctttctatccggaaagggcctggggaagaccagcataggactcctttgtgtgacagcctcaagtgctctgttgtggatggccagcgttgagcctcactggatcgcagcttccattatcctggaattctttctcatggtgctgcttattcccgagccagaccggcagcgtacccctcaagataatcagctcgcctacgtcgtaatcggtctgttgttcatgatactgactgtggcagccaacgagatgggcttactagaaacaacgaaaaaggacctggggatcggacatgttgctgcggagaaccaccagcactctaccatgctcgatgtggaccttcatcccgccagcgcatggactctgtatgctgtcgccacaaccgtgattaccccaatgatgagacacacaatcgaaaatactacggccaacatttccttgaccgcaatcgctaatcaagccgcgatactgatgggcctcgataaaggttggcctatttcaaagatggacatcggggtcccgctgcttgctttaggctgctactctcaggtgaaccccctgacactcactgccgcagttttgatgctggtggcccattacgctattatcggaccaggcctacaggcaaaagccaccagggaggcgcagaagcgcacagctgccgggataatgaagaatcctaccgtagatggaatcgtggcaattgacctggatcccgtcgtttatgacgccaaatttgaaaagcaactcggccagatcatgcttctgattttgtgtactagtcagatcctgctcatgcggacgacatgggctctgtgcgagtcgataaccttagccactggtccacttaccacactgtgggaggggagccctggaaaattctggaacactaccattgcagtgtccatggctaatatcttccgaggctcttacctcgccggtgcgggcctagccttttcactgatgaagagcttggggggaggcagaagggggacaggagcacagggcgaaacgctgggtgagaaatggaagcgccaactcaaccagctttccaagagtgaattcaatacctataaacggtctgggatcatggaggtcgacagaagcgaagctaaggagggactgaaacgtggcgagactacaaagcacgccgtgtcaaggggtaccgcaaaattgcggtggtttgtagaacgcaacctggtgaagcccgagggcaaggttattgatctcgggtgtggacgaggcgggtggtcctactattgcgctggattaaaaaaggtgactgaagtcaaaggctacacaaagggtgggccgggacatgaggaaccaatccctatggccacctatggctggaatctggtgaaacttcacagtggcaaggacgtcttctttatgcccccagagaaatgtgatacgctgctatgcgacataggggagagctctcccaaccctaccattgaagagggaagaacactcagggtgctgaagatggttgaaccgtggttgcggggtaatcagttctgtatcaagattctgaacccctacatgccatccgtagtggagactctcgagcagatgcaacgcaaacacggcgggatgcttgtcagaaatcctctgtcaaggaacagcacccatgaaatgtactgggtgtcgtgcggaacaggcaatatcgtttctgccgtgaacatgactagtcgaatgttactgaaccggtttaccatggcgcaccgtaagcccacatatgagagagatgtcgacttgggtgctgggacccgccatgtggcagtagaacctgaggtggccaatctcgatataatcggacagaggattgaaaacatcaaaaatgagcaccggtccacttggcactacgacgaggataacccatataagacgtgggcttaccatggcagctatgaagttaaaccctcaggctccgcctctagcatggtcaatggggtggtgagactgctaacaaagccttgggacgtcattccaatggttacccagatcgcaatgactgataccacacccttcggacaacagcgcgtgtttaaggagaaagtagacacgaggaccccgcgagccaagcggggtactacacagattatggaagtgaccgctaaatggctttggggcttcctgagtagaaacaagaaacctaggatctgtactcgcgaggaatttacacgtaaggtccggtccaatgcggccataggggcagtgttcgttgacgagaaccagtggaatagcgctaaggaggccgtggaagatgagagattttgggacctcgtccacagggaacgcgagctgcataaacaaggaaagtgcgcaacctgcgtgtacaacatgatgggcaaacgagaaaagaaattgggtgagttcgggaaggccaagggatctcgggctatttggtatatgtggctgggcgccagattcctcgagtttgaagcgcttggcttcatgaatgaggatcactggttttcaagggaaaacagtctgtccggggtagagggagagggtttacataaactgggctacatcttgcgcgacatcagcaagattccagggggaaatatgtacgcagatgacacagccggctgggatactagaataaccgaagacgatctccagaacgaggctaaaatcacggacattatggaacccgagcacgccctgctagcaacctctatcttcaagcttacatatcagaataaagttgtgcgggtccagaggcctgctaagaacggtactgtgatggatgtgatttcgcgtcgagaccaacgcgggtcaggacaggtcggcacctacggcctgaacacatttactaatatggaagttcagctcatcagacagatggagagcgaggggatattcctgccatccgaattggagacccccaacttagccgaacgggctctggattggctcgagaaacacggagccgaaaggcttaagcgcatggcaatcagtggtgacgactgtgtggtaaagccgattgatgacagatttgcgacggccctgacagctctaaatgatatgggcaaagtgcggaaggacatccctcaatgggagccctctaaagggtggaacgattggcagcaggtcccattctgcagccatcactttcatcagctgattatgaaggacggaagggagatcgtggttccttgtcgaaatcaagatgaactcgtgggccgtgccagagtctcccagggtgcagggtggtcattgcgcgagaccgcttgcctgggaaaaagttatgcccagatgtggcaacttatgtacttccaccggagggacctgagactcgcagccaacgcgatatgttctgctgtgcccgtagattgggttccagccagccgcactacatggtccattcacgcacatcaccagtggatgaccactgaagacatgttatcagtgtggaatcgggtctggatcgaggaaaacccctggatggaggataagacccatgtgagctcttgggaggaagttccttatctgggcaagagggaggaccagtggtgcggctccttgatcgggctgacagcccgagctacgtgggccaccaatattcaggtggcaataaaccaagtcagacggctcatcggaaatgaaaactaccttgactatatgactagtatgaaaaggtttaagaatgagagcgatccagagggtgctctgtggtga

SEQ ID NO: 14141 - RNA, 9879 nt, synthetic construct
  misc_feature 1..9879: note = derived and/or modified CDS sequence (opt3) from DENV-1__KC692513__SS-prME
  source 1..9879: mol_type = other RNA
agcgtgaccatgctgctcatgcttctgcccactgccttggctttccacttaactacgagaggcggggagcctcatatgatcgtctccaagcaggaaagaggaaaatctctgctgtttaagacctcagttggtgtgaacatgtgcacactcattgcaatggacctgggcgagctttgtgaagatactatgacctacaaatgcccacggattacagaggccgaaccggacgatgtagactgttggtgcaatgcgaccgatacttgggtgacatatgggacctgtagtcaaacgggagagcaccgccgagacaagcgtagcgtcgctctggcaccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaggaacaagatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagaaaagagctggctggtacataaacagtggtttcttgacctgccgttgccctggacgtctggcgcctccacccctcaagagacttggaataggcaggatctcctggttacattcaagaccgcacacgctaagaaacaggaagtggtcgtgttaggttcacaagagggggccatgcacacagctctgactggcgccaccgaaatccagacgagcggaaccacaactatttttgcaggccatctaaagtgccggctcaaaatggacaagctgacccttaaagggatgagttatgtcatgtgtacaggatctttcaagttggagaaggaagtggccgagactcagcacggtaccgttctggtgcaggtaaaatacgagggcacggatgctccatgcaagatacccttcctcacacaagacgaaaaaggggtcacccagaacggacgtctgatcactgcgaatcctattgtgacagataaggagaaaccagttaacatcgaaaccgagcccccgtttggcgagtcctatatagtggtcggtgcaggggaaaaggcccttaagctgagctggttcaaaaagggctcgtctattggaaaaatgtttgaggctactgcccgcggcgcaagaaggatggccatcttgggggacaccgcttgggatttcggatccatcggtggcctctttacatcagtggggaagctgattcatcaggtattcggaacggcctacggcgtgttatttagtggtgttagctggaccatgaaaatcgggattggcatactgctaacttggctcggactaaattcccggtctacaagcctttcaatgacctgtatcgcagtcggcatggtgacattgtacctgggggtgatggtccaggcggacagtggatgcgttattaactggaagggccgagaactcaagtgtggttccgggatcttcgtgactaacgaggtgcacacctggacggaacaatataaatttcaggctgatagccctaagcgcctgtctgccgcaatcggaaaagcctgggaggagggcgtatgcggtattagatcagctacaaggttagaaaatataatgtggaagcagatcagtaacgagctgaattacattcttttggaaaacgacatgaaattcaccgtcgtggttggcgacatcaatgggattctcgcccagggaaagaaaatgatccggccccaaccaatggagcataagtatagctggaagtcctggggcaaagcaaagataatcggggctgatattcagaacactacctttatcattgacggacctgatacacccgaatgtccagacgatcagcgcgcctggaatatctgggaggtggaggactacggcttcggtatatttactaccaacatttggctgaaactaagagattctcacacacagatgtgcgaccacaggctgatgtcggcggccatcaaggatagcaaagctgtccatgcagacatggggtattggattgaatccgagaagaatgaaacgtggaagctcgcccgtgcttcattcatcgaggtgaaaacctgtatatggcccaagagtcacactctgtggtctaacggagttcttgaaagcgagatggtgatccctaaaatttacggcggtccaatctcccaacataattatcggccgggctacttcacacagaccgccgggccctggcacttgggaaagctggagttagattttgacctctgcgaaggcactacagtagtcgtggatgagcactgcgggtaccgaggaccttcactgagaaccacgactgtgaccggcaaaattatccatgaatggtgttgcaggagctgtacacttccacccctgcgcttccggggtgaggacgggtgctggtatggaatggagataagacctgtcaaggaaaaggaggaaaacttggttaggtctatggtgtccgcaggcagtggtgaggtagacagcttttctctcggcattctgtgtgtgtccatcctaatcgaagaggtcatgcgctcacgatggagtcggaaaatgctgatgaccgggactctcgcggtgttcctgcttttgattatgggacagctgacatggaatgatttaatccgtctctgcattatggttggcgccaacgctagcgacagaatggggatgggaaccacatacctggcccttatggcaacttttaagatgaggccaatgttcgctgtgggcctgctatttcgccggctcacctcgagagaggtcctgttgctgacggtgggtttatccctcgttgcctctgtggaactgcccaatagccttgaggaactgggggatggattggcaatgggcataatgatgctcaaactgctaacagacttccaaccgcaccagctgtggaccactcttctctcactgacctttatcaggacaagtttgtccctggattatgcctggaagactatggctatggcgttatctattgtcagcctcttccctctgtgtctttccaccacgtcacagaaaacaacctggctgccagtattgctcggcagctttgggtgcaagcccctgactatgttcctaatcacagagaacaagatttggggacgaaaaagttggcctatcaacgaaggtataatggccgtgggcatcgtttctattctgctttccagcctcctgaagaatgacgtgcccttggcagggccattaatcgctggaggcatgctgattgcctgttacgtcatctcgggttcatctgccgatctcagtctggagaaagctgcagaggtgtcctgggaagaggaagccgagcatagcgggacctctcacaacatacttgtagaagtgcaggacgatggaactatgaagattaaagacgaggagcgcgatgacacactgaccatcttgctaaaggcgacgctgctcgctgtcagcggcgtttatcctatgtccatccccgccactctgtttgtgtggtacttctggcagaaaaagaagcagcggtcaggcgtgctttgggataccccaagtccgcctgaagtcgagagagcagtgttagacgacgggatttataggatactgcagcgtggactcttgggtcgcagccaggttggcgtaggggtgttccaagatggagtctttcatacaatgtggcacgtgacccggggcgccgttctgatgtaccagggtaaaagactcgaaccctcttgggcttccgtgaagaaagacctgatctcatacgggggaggctggaggttccagggcagttggaatacaggggaggaggtccaggtgattgcagtagaaccaggaaagaaccccaaaaatgtccaaactacccctggtacgtttaagacaccagagggcgaagtgggggccatcgcgcttgatttcaagcccggaactagcggctcccctattgttaaccgagagggtaaaatcgtggggctgtatggaaatggcgtcgtgaccacatctggcacctacgtttcggctatagcccaggcaaaggccactcaggaagggccgttgccagagatcgaggacgaagtgtttaaaaagcggaacctaaccattatggatctgcaccccggaagcggtaaaacacgcagatatctccctgctatcgtcagggaggccattaagcggaagttacgaacgctgatccttgcaccaactagagtggtagcttcagaaatggccgaggcgctgaaaggcatgcccatacgctaccaaaccacagccgtgaagtccgaacataccgggagggagattgttgacctcatgtgccacgcaactttcacaatgcgtttgctgagtcctgtccgggtgccgaattataacatgatcatcatggatgaggctcattttaccgaccccgcctctattgctgcaagaggatacatcagcacgagggtgggcatgggtgaagccgccgctatattcatgactgcgacaccacctgggtccgtcgaggcatttccccagtcaaatgccgtaattcaggatgaggaacgcgacatcccagaacgatcttggaacagcggatatgattggattaccgacttccctggcaaaaccgtgtggtttgttcccagtatcaagtccggcaatgacatagctaactgtctcaggaaaaatgggaagcgggtgattcagctgagcaggaagactttcgatacagagtaccagaaaaccaagaacaacgactgggattacgtcgtgacaactgacatctctgagatgggagccaatttccgcgcagatcgtgttatcgacccaagacggtgccttaaaccggtgattctaaaggaaggtcctgagagggtcatcctggccggccccatgccagtgacggtagcttcagcggcccagcgccgagggagaattggacggaaccagaataaagaaggcgatcagtatatatacatgggtcaacccttgaacaatgacgaggatcacgcacattggaccgaggctaagatgttactggacaacatcaatacacctgaagggattatcccagccctctttgagcccgaaagggagaagtccgcagccatcgatggcgaatatcgcctgagaggagaggctaggaaaactttcgtggagcttatgcggcgtggcgacctgcctgtttggctcagttacaaggtcgccagcgaagggtttcagtattcggatcgccgatggtgcttcgacggagagagaaacaatcaggtgttggaagagaacatggacgtggaaatttggaccaaagagggtgagaggaagaaactgcggccgcgctggctagatgcgagaacatactctgacccactggcactcagggaatttaaggagttcgccgctggccggcgatccgtcagcggggatcttatactggaaatcggaaaattaccccagcacttgaccctgagagcccaaaatgctctcgacaacctggttatgcttcacaattcagagcagggcggtaaggcatatcgccatgccatggaggaactgcctgatactattgagacgctcatgttgctggctttaatcgccgtgctaaccgggggcgtaacactgtttttcctcagtggaaagggccttgggaaaacttctattggactgttgtgtgtgatggcatccagcgcgctgctctggatggcctcagtcgaaccccactggatcgctgccagtataatcctggagtttttccttatggtgctcctgattccagaacctgacaggcagcggacaccccaagataaccaattggcatacgttgtgatcggtctgttatttatgattctaaccgtcgctgccaatgagatgggcctgctcgagaccactaagaaagaccttgggatcggacatgtagcagtggaaaaccaccaccatgccacaatgctggatgttgacttgcgtccagctagcgcgtggacgctgtacgccgtggcaaccactgtcataacacctatgatgagacacaccattgagaacaccacagctaatatctccctcactgccattgccaaccaggcagctatcctgatgggccttgataagggttggccgatatctaaaatggacatcggggtgcccttactggccctcggctgctatagccaggtcaatccattgacgctgaccgcggctgtgctaatgctggttgcccattacgcaattatcggacctggcctccaagccaaggctacaagggaagcacagaagcgcactgccgcggggattatgaaaaaccccaccgtggatggaatcgtaacaatagaccttgacccagtggtctatgatgctaagttcgagaaacagctgggccagattatgttgctgatcctctgtacctcccaaatcctgttaatgcggactacgtgggccctttgcgaatcaattacactggcaaccggtcctctcactaccctatgggaggggtctcccggaaagttttggaatacaactatcgccgttagtatggctaacatattccgaggctcgtacctggccggtgcaggcttggctttcagcctgatgaaatccctcgggggaggcagaagggggaccggagcccagggcgagacacttggtgaaaagtggaagcgccagctgaatcagttgtctaaatcagagtttaacacgtataagaaaagcgggattatggaagtggaccggtccgaggcgaaggaaggactgaaaagaggcgagaccactaagcacgccgtcagtcgtggtacagcaaagctcaggtggttcgtggagcggaatttagtaaaaccggaaggcaaggtgatcgatctggggtgtggacgcggcgggtggtcttactattgcgctggacttaaaaaggttaccgaggtgaaaggctacactaagggtgggccaggacatgaggagcctattcccatggccacatacggctggaacctggtcaaactacacagcggcaaggacgtgtttttcaccccacccgaaaagtgtgatacgctcctgtgcgacatcggggagtcatcccctaatccgaccatagaggaaggacgaacattgagagtcctgaaaatggtggagccctggctcaggggtaaccaattttgtatcaagattcttaatccatatatgcctagtgttgtagaaactctggagcagatgcagcggaaacacggcgggatgttagtgcgcaaccccctgagcagaaattctacccatgagatgtactgggtctcctgcggaacaggcaacatcgtgtcagcagttaatatgactagcaggatgttgctcaaccgattcaccatggctcaccggaagcctacatatgaacgtgatgtggacctgggtgccgggaccagacatgtcgccgtggagccagaagtagcgaacctagatattatcggacagcgcattgagaatatcaaaaacgaacacaagtcgacttggcactacgacgaggataatccctataagacgtgggcttaccatggctcttatgaggtgaaacctagtggctccgcaagctcaatggttaacggggtcgtgaggcttctgacaaagccatgggacgtgatacccatggtcacccaaattgccatgactgacaccacaccgtttggacagcagcgggttttcaaagaaaaggtggatacgagaacccctcgcgctaaaaggggtactgcccaaatcatggaggtaacagcaaagtggctctggggctttctgtcccgaaataagaaaccacggatctgtaccagagaagagttcactaggaaggtgcgctctaacgccgctattggggcggtctttgtggacgaaaatcagtggaacagcgccaaagaggcagttgaggatgaacgtttctgggacttggtgcaccgggagagagaactgcataagcagggaaaatgcgctacatgcgtctacaatatgatgggcaagagggagaagaaactcggtgaatttgggaaggccaaaggaagtcgcgcaatatggtacatgtggcttggcgcccgattcctggagttcgaggctttaggctttatgaacgaagatcactggttctcccgggagaatagcctgtctggggtggaaggagagggtttgcataagctcggctatatcctgagagacatttcaaaaatccccgggggaaacatgtacgccgatgacaccgcgggctgggatacaaggattactgaggacgatctacagaatgaagcaaagatcaccgacataatggagcctgaacacgcccttctggctacgagtatctttaaactcacctatcaaaacaaggtagttcgcgtgcagagaccagccaagtccggtacagtcatggatgtgattagccggagggaccagcgtgggtctggacaggtgggcacttacggcctgaataccttcacaaacatggaggtccaattgatccgacagatggaatcggaggggatattttcacccagcgagttagaaactccgaacctggccaaaaaggttctcgactggcttgagaaacacggagctgaacgcctgaagagaatggccatctccggtgatgactgtgtggtaaaacctatagatgaccggttcgctaccgccctaacggcactgaatgatatgggcaaggtgaggaaggacattccccagtgggagccaagtaaagggtggaacgattggcagcaagtccctttttgctctcatcacttccatcagctcatcatgaaggacggacgcgaaatcgtggttccctgtagaaatcaggatgagttggtgggccgggcgagggtcagccagggtgccgggtggtccctgcgagagacagcttgccttggaaaatcatatgcccaaatgtggcagctgatgtactttcaccgtagagacctccgcttagcagctaacgccatttgtagtgcagtgccagtagattgggttcccacctctcggactacatggagcatacacgcccatcaccagtggatgaccactgaagacatgctgtccgtgtggaatagggtctggatcgaggaaaacccttggatggaggacaagacccatgtgtcaagctgggaagaggttccatatttgggcaaaagagaggatcaatggtgcggctctctgattgggctcacagcgcgcgctacgtgggccaccaatatccaggtggcaattaaccaggtccggaggcttatcggatccgaaaattacctggactacatgacaagtatgaagcgattcaagaacgagagcgatccggaaggtgccctatggtga

SEQ ID NO: 14142 - RNA, 9879 nt, synthetic construct
  misc_feature 1..9879: note = derived and/or modified CDS sequence (opt3) from DENV-1__KC692514__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaggcagatccagcgggtggagacttgggctctgcgccaccctggattcaccgttattgcatttttcctggcccatgctatcggcacatcgattacccagaaaggcatcatatttatcctcttaatgctggtgacgccatcaatggccatgagatgcgtcgggattggaaacagggacttcgtggagggtcttagcggcgcgacttgggtagatgttgtgttggaacacgggagttgtgtcacaaccatggcaaagaataagcccactctggacatcgagctactcaaaacagaagtgaccaaccctgccgtgctgcggaagctttgcattgaggctaaaatctccaatacgaccacagattctcgctgtccaactcaaggagaagccaccctggtcgaggagcaggacgcaaactttgtttgccgaagaacattcgtggataggggctggggtaatgggtgtggattgtttggcaagggcagcctcctgacttgcgctaaattcaagtgcgtaaccaagttagaagggaaaatagtgcagtacgagaacctgaagtattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccacggactggattggactttaacgagatggtcctactgacaatgaaagagaagagctggctcgtgcataaacagtggttcctggatcttccgctgccctggacgtctggcgcatccacctcacaagaaacttggaatcgtcaggacttgctcgtaacatttaagaccgctcacgccaaaaagcaggaggttgtggtcctgggtagccaagaaggggctatgcacacagccttaactggcgcaaccgagatccagacgagtggaaccacaactattttcgccggccatctgaagtgccgcctaaaaatggataagctcaccctgaaagggatgtcttatgtgatgtgtacaggatccttcaagcttgaaaaagaggtcgctgagactcagcacggtaccgtgttggttcaggtgaagtacgaaggcacggacgcgccttgcaagataccatttagcacacaagatgagaaaggggtaacccagaacggaagactgatcactgcaaatcccattgtcacagacaaggaaaaacctgtgaacatcgagaccgagccacccttcggcgaatcgtatatagttgtgggtgccggggagaaggctctcaaactgtcttggtttaagaggggctcctcaattggaaagatgttcgaagccactgcacggggcgcccgacgcatggctatccttggggataccgcctgggactttggaagtatcggtggcgtcttcacaagcgtggggaaactggtacatcaggtgtttggaacggcatacggcgttttgttctccggtgtctcttggaccatgaagattgggatcggcattctcctgacttggttaggactgaatagcagatcaacaagtctatccatgacctgtatagcggtgggcatggtgacactctacctgggggtcatggttcaggctgatagcggatgcgtgatcaactggaaaggcagggagcttaagtgtggttctgggatttttgtgactaacgaagtacacacctggacggagcaatataaattccaggccgactcaccgaagcggttgagtgcagccatcggaaaggcttgggaggaaggcgtctgcggtatccgcagcgccacaagactggagaatattatgtggaaacagatatccaacgaactcaatcatatcctgttagagaacgatatgaagtttaccgtggttgtgggcgacgcaaatgggattctggctcagggaaaaaagatgatcaggcctcaacccatggaacacaaatactcttggaagtcgtggggcaaagccaagattatcggggcggacatacagaacactaccttcatcattgatggaccagacacacctgagtgtcccgatggccagcgtgcctggaatatctgggaggtcgaagactatggttttggggtgttcactaccaacatttggcttaagttgcgggatagctacacacagatgtgcgaccaccgactcatgtccgctgcaatcaaagattcaaaggccgttcatgctgacatgggatattggatagagagtgaaaaaaatgagacgtggaagctggccagagcatctttcattgaagtgaaaacctgtacttggccaaagagccacacactatggtccaacggcgtactggagtcagagatgatcattcccaagatctttggtggccctataagccaacataattacaggccagggtatttcacccagactgcgggaccgtggcacctcggcaaactggaacttgattttgacttgtgcgaggggacaaccgtcgtggtggatgaacactgcggaaaccgcggcccctctctgcggacgactaccgtcacaggtaagatcattcatgagtggtgttgcagatcctgtaccttacctccactcaggttccgcggggaggacggatgctggtacggcatggaaatccgacccgttaaagagaaggaagagaatctggtgcggagtatggtaagcgccggttctggcgaagtggattccttttcacttgggattctgtgtgtcagtatcatgatagaggaggtgatgcgtagcagatggtcgaggaaaatgttgatgactggaacactcgctgttttcctgctactgattatgggccagctcacctggaacgacctgatccgcctttgcatcatggtgggggccaatgcatccgaccggatgggaatgggcacaacttacttggctctgatggccacctttaagatgagacctatgttcgcagtcggtttactctttaggcgactgacgtctcgcgaagtgcttctgctaacaattgggctcagcctggttgcctcagtggagttgccaaacagtctggaagagttaggagatggcctcgctatgggcatcatgatgctgaagcttctgaccgaattccaaccccaccagttgtggactaccctcctgtccctaacatttgtcaaaactaccctgtctcttgactatgcgtggaagacgacagccatggtactcagcattgtgtccctgttcccgttgtgtctgtcaaccactagccagaaaacaacctggttacctgttctcctggggagttttggatgcaagccacttactatgttcctgataacagagaacaaaatctggggtcggaagtcttggcccttgaatgagggcattatggcaatcgggattgtgtccatcctcctgagctcgctactgaagaacgatgtccctcttgctggacccctcatagccggcggtatgctgatcgcctgttacgtgatttcagggtctagtgctgacttgtccttagaaaaagcagccgaggtaagctgggaacaggaggcggaacattctggagctagccacaatatcctggtggaggtccaagatgacggcaccatgaagattaaagatgaggaaagagacgatacgctcactatcctgcttaaggccaccctgttggcagtttccggcgtgtatccaatgtcaatacctgccacactattcgtgtggtacttttggcagaaaaagaaacagaggagtggggtcctgtgggacacccccagcccaccggaggtggaacgtgctgttctcgatgacggaatttatcgcatcctgcagcggggtcttttaggcagatctcaagtaggggtgggagtcttccaggatggcgtgtttcatacaatgtggcacgttactaggggtgcagtgctgatgtaccaggggaagcgactcgagccttcctgggcctcagtcaagaaagacttgatcagttatggaggcggctggcggttccaggggagctggaacaccggagaggaagtgcaagtaattgcggtcgagcccggtaagaatccaaaaaacgtgcagacgacacccggcacttttaagacccctgaaggggaggttggagctatagccctggacttcaaaccaggcacatccggttctcccatcgtgaatcgcgaagggaagattgtcggactctacggcaacggcgtggttaccacttcggggacctacgtgagcgcaatcgcccaggctaagacatcacaagagggacctctgccggagattgaagatgaggtctttaaaaagagaaatcttacgatcatggacctgcacccaggttccggcaaaactaggcggtatttgcccgccatagtgcgagaagcaatcaagagaaaactacgcaccctgattctcgctcctacaagggtagtggccagtgagatggcggaagccttaaaggggatgccaatccgttaccagaccactgcagttaagtctgagcatacaggacgggagattgtcgatctgatgtgccacgctaccttcacgatgagacttctgagccccgtgagggtgcctaactataatatgatcataatggacgaagcccattttactgatccggcttccattgcagcccgcggctacatctcaacacgagtcggtatgggggaggccgctgcgatcttcatgaccgcaacccccccaggatctgtagaagcctttcctcagagcaacgctgtgattcaggacgaggaaagagatatccccgagcggagttggaattccggctatgactggataactgatttcccaggcaaaacagtttggttcgtgcctagcattaagtctgggaacgacatcgccaattgtctcaggaaaaacggaaagcgcgtcattcaattgtcacgtaaaacctttgatacagagtaccagaagactaagaacaatgactgggactatgtggttacgaccgatatctccgaaatgggtgcaaacttcagagccgaccgggtgatagatcccaggcgctgcctgaaaccagtcattctcaaggacggcccggagcgagtgatcctggctgggcctatgcccgtaacagtggcgagtgccgcacagagacggggaaggatcggccgcaatcagaacaaagaaggtgatcaatacgtttacatggggcagccacttaataacgacgaggatcacgctcattggactgaggccaagatgctactggacaatattaacacccccgaaggcatcattcctgcattgtttgagccagaaagagagaaaagcgccgctatagatggagaatataggttacggggcgaggcccgtaagacattcgtcgagctgatgcgccgaggggacctccccgtgtggctgtcgtacaaggtggcgtctgaaggatttcagtattccgatagaaggtggtgcttcgacggtgagcggaataaccaggtccttgaagagaatatggatgttgaaatctggaccaaagagggcgagcgcaagaaactgagacctaggtggctcgacgcacggacttacagcgacccgttggccctgcgagaatttaaggagttcgctgccgggagacgctcagtgagtggagatctaattctggaaatcggcaaactcccacaacaccttacgctgagggctcagaacgcattagacaatttggtaatgctgcacaactctgagcagggtgggaaggcctatcggcatgctatggaagagctccccgataccatcgagacactgatgcttctggccctcattgcagtgttgactggcggagtcaccctgtttttcttatccggcaaagggctaggaaagacaagcataggtctgctctgtgtgaccgcgtcaagtgcccttctgtggatggctagcgttgaacctcactggatcgccgcatccattatcttggagtttttcctgatggtgctcctgattcccgaaccagaccgtcagagaactcctcaagataatcagcttgcttacgtcgtaatcggcctcctgtttatgatattgacagtggccgcaaacgagatggggctgttagagacgaccaagaaagacctaggaatcggctatgttgccgctgaaaaccatcagcacgcgactatgctggatgtggacctccaccccgcctctgcatggacactttacgctgtcgccaccaccgtgattacaccaatgatgaggcatactatcgagaatacgaccgccaacattagcctgacagcaatcgctaatcaagccgcgatattgatgggtctggataaggggtggcctatttccaaaatggacatcggcgtcccgctcctggctcttggatgctactcacaggtgaaccccttaactctgaccgccgcagttctcatgttggtggcccactatgctattatcggcccagggctgcaggcaaaggccacacgcgaagcgcagaaacggaccgctgccggaataatgaagaatcctactgtagatggcatcgtggcaattgacctagatcccgtcgtttacgacgccaagttcgagaaacaactgggtcagatcatgctccttattctgtgtacgtctcagatcttgctgatgcgaacaacctgggctctctgcgaaagtataactctggccaccgggccattaacaactctttgggagggatcgcctggcaagttctggaacaccacaattgcagtgagcatggctaatatctttagaggttcctatctggccggcgcggggctcgccttctctctaatgaaatcactgggaggcgggaggcgcggaacgggcgcacagggtgagaccttgggggaaaagtggaaacggcaactgaaccagctcagcaagtccgagtttaatacttacaagagaagtggaatcatggaagtcgaccgttctgaggctaaagaaggccttaagaggggtgagacaaccaaacatgccgtgagccggggcactgcaaagctgcgctggttcgtagagcgaaacttggtgaaacccgaagggaaggttattgatctgggatgtggcagagggggatggtcatattactgcgctggcctcaagaaagtgacagaggtcaagggttataccaaagggggaccgggccacgaagagccaatccctatggccacgtacggctggaatttagtgaagctgcattccgggaaagacgtctttttcatgcccccagaaaagtgtgatacccttctgtgcgacataggagagagtagccccaaccctacaattgaggaaggtaggactctacgggtgctcaaaatggttgagccgtggctgcgcggcaatcagttttgtatcaagattttgaacccctacatgccatctgtagtggaaaccctggagcagatgcaaagaaagcacgggggaatgctcgtcaggaatcctctttcccgaaactcaacacacgagatgtattgggtgagctgcggcactggtaatatcgtttcggccgtgaacatgacctctcggatgctgttaaaccgtttcacaatggcgcatagaaaacccacctacgaacgcgatgtcgacctgggggctggaactaggcacgtggcagtagagcctgaagtggccaatttggatataatcggccagcggattgagaacatcaagaatgaacataaaagtacgtggcactatgacgaggataacccatacaagacatgggcttatcacggctcctacgaggttaaacccagcgggtcagcctcctctatggtcaatggagtggtgagactcctgaccaagccttgggacgtcattccaatggttactcagatcgcaatgaccgatacaacgccctttggtcaacagcgcgtgttcaaggaaaaagtagacaccaggactccgcgagccaagcggggcacaacccagattatggaggtgactgctaaatggctatgggggtttcttagcagaaacaagaaacctaggatctgtacacgcgaagagttcacccgtaaggtccggagtaatgcggccataggagcagtgtttgttgacgaaaaccagtggaattccgctaaggaggccgtggaggatgaaagattctgggacctggtccatagggagcgcgaactccacaaacaaggcaagtgcgcaacatgcgtgtataacatgatgggtaaacgagagaagaaactgggggaattcggaaaggccaagggcagccgggctatttggtacatgtggttgggcgccagatttctggagttcgaggcgctcgggtttatgaatgaagatcattggttctctagggagaactcacttagtggagtagaaggtgagggcctgcacaaattagggtacatcctgcgcgacatctccaagattccaggaggcaatatgtatgcagatgacactgccggttgggataccagaataacggaggacgatttgcagaacgaagctaaaatcaccgacattatggagcccgaacatgccctcctggcaacaagcatctttaagctaacttaccagaataaagttgtgcgggtccagaggcctgctaagaacgggaccgtgatggatgtgatttctcgtcgagaccaacgcggatcgggccaggtcggcacatatgggcttaacactttcaccaatatggaggttcagctgatcagacagatggaatcagagggaatatttctcccaagcgagctggaaacgcccaacttggccgagcgggctttagattggctggaaaaacacggtgccgagaggctcaagcgcatggcaatctccggcgacgactgtgtggtaaagccgattgatgacagattcgcgacagcccttaccgctctgaatgatatggggaaagtgcggaaggacatccctcaatgggaacccagtaaaggatggaacgattggcagcaggtcccattttgctctcaccatttccaccagctaattatgaaggacggcagggagatcgtggttccttgtcgaaatcaagatgagctggtgggtcgtgccagagtcagccagggggcaggatggtccctccgcgaaactgcttgcttgggcaaatcatacgcccagatgtggcaactgatgtattttcatcggagggaccttagactggcagccaacgcgatatgtagtgctgtgcccgtagattgggttccagcctctcgcacaacctggagcattcacgcacaccatcagtggatgactaccgaggacatgctctccgtgtggaatcgggtctggatcgaagagaacccctggatggaagataagacacacgtgtcaagctgggaggaggttccttacttaggcaagagggaagaccagtggtgcgggtctctgatcggattgacggcccgagctacctgggccactaatattcaggtggcaataaaccaagtcagacggctgatcggtaatgagaactatctcgactacatgacatccatgaaaaggttcaagaatgaaagtgatccagagggcgctctttggtga

SEQ ID NO: 14143 - RNA, 9879 nt, synthetic construct
  misc_feature 1..9879: note = derived and/or modified CDS sequence (opt3) from DENV-1__KC692515__SS-prME
  source 1..9879: mol_type = other RNA
agcgtgaccatgctgctcatgcttctgcccactgccttggctttccacttaactacgaggggaggggagcctcatatgatcgtctccaagcaggaaaggggaaagtctctgttatttaagacctcagccggtgttaacatgtgcactctcattgccatggacctgggagagctttgtgaagatactatgacctacaagtgcccacggataacagaggcggaaccggacgatgtggactgttggtgcaatgctaccgatacttgggtaacctatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagactttgtggagggtttgagcggcgcgacttgggtagatgttgtgctggaacacgggagttgtgtcacaaccatggcaaagaataaacccactctagacatcgagctcctgaagacagaagtgaccaaccctgccgtgcttaggaaactgtgcattgaggctaagatctccaatacgaccacagattctcggtgtccaactcaaggagaagccaccttggtcgaggagcaggacgcaaacttcgtttgccgccgaacatttgtggatagaggctggggtaatgggtgtggactcttcggcaaaggcagcctgttaacttgcgctaagtttaagtgcgtaaccaaactggaagggaagatagtgcagtacgagaacctcaaatattccgtcattgtgacagttcacaccggagaccagcatcaagtgggtaatgaaactacggagcacggcacaatcgccaccattactccccaggcgcctacctcagaaatccagcttacagattacggggccctgaccttggactgtagtccaaggactggactagacttcaacgagatggtcctgctcacaatgaaggagaaaagctggctggtgcataagcagtggtttcttgatctgccgttgccctggacgtctggcgcatccacctcacaagaaacttggaatcggcaggacctcctggtaacattcaaaaccgctcacgccaagaagcaggaggttgtggtcttaggtagccaagaaggggctatgcacacagccctgactggcgcaaccgagatccagacgagtggaaccacaactatttttgccggccatctaaaatgccgtctcaagatggataaactgacccttaaggggatgtcttatgtgatgtgtacaggatccttcaaattggaaaaggaggtcgctgagactcagcacggtaccgtgctggttcaggtgaagtacgaaggcacggacgcgccttgcaaaataccattcagcacacaagatgagaagggggtaacccagaacggacgcctcatcactgcaaatcccattgtcacagacaaagaaaagcctgtgaacatcgagaccgagccaccctttggcgaatcgtatatagttgtgggtgccgggggcaaagctctgaaactttcttggttcaagagaggatcctcaattggcaaaatgtttgaggccactgcaagaggggcacggcgaatggctatcctgggagataccgcctgggacttcggtagtatcggcggggtctttacaagcgtgggaaagttggtacatcaggtgttcggcacggcatacggtgttctcttttccggggtctcttggaccatgaaaattggcatcggcattctgttaacttggctgggcctaaatagccgctcaacaagtctctccatgacctgtatagcggtggggatggtgacactgtaccttggagtcatggttcaggctgatagcggctgcgtgatcaactggaagggtagagaattgaaatgtgggtctggaattttcgtgactaacgaggtacacacctggacggaacaatataagtttcaggccgactcaccgaagaggctgagtgcagccatcggcaaggcttgggaggagggtgtctgcggcatccggagcgccacacgcctcgaaaatattatgtggaagcagatatccaacgagctgaatcatatcttactggaaaacgatatgaaattcaccgtggttgtgggggacgcaaatggcattcttgctcagggcaagaaaatgatcagacctcaacccatggagcacaagtactcttggaaatcgtgggggaaggccaagattatcggagcggacatacagaacactacctttatcattgatggcccagacacacctgaatgtcccgatggtcagagggcctggaatatctgggaggtcgaggactatgggttcggagtgtttactaccaacatttggttgaaactccgtgatagctacacacagatgtgcgaccaccggctgatgtccgctgcaatcaaggattcaaaagccgttcatgctgacatgggctattggatagaaagtgagaagaatgaaacgtggaaactagcccgagcatctttcattgaggtgaagacctgtacttggccaaagagccacacactgtggtccaacggtgtactcgaatcagagatgatcattcccaaaatcttcggcgggcctataagccaacataattacagaccaggatattttacccagactgcgggcccgtggcacctggggaaacttgagttggatttcgacctgtgcgaaggaacaaccgtcgtggtggatgagcactgcggcaacaggggtccctctttacgcacgactaccgtcacagggaaaatcattcatgaatggtgttgccggtcctgtaccctccctccactgagatttaggggagaggacggctgctggtacggtatggagatccgccccgttaaggaaaaagaggaaaatcttgtgcgaagtatggtaagcgccggctctggggaggtggattccttctcactgggaattttgtgtgtcagtatcatgatagaagaggtgatgcggagccgttggtcgagaaagatgctcatgactggcacactggctgtttttctactgctcattatggggcagctgacctggaacgaccttatcaggttgtgcatcatggtgggagccaatgcatccgaccgcatgggcatgggtacaacttacctggctttaatggccaccttcaagatgcggcctatgtttgcagtcgggctcctgttcagaaggcttacgtctcgagaggtgctgctactcacaattggactgagcttggttgcctcagtggaactgccaaacagtttagaggaactcggcgatggcctggctatggggatcatgatgcttaaactgttgaccgagtttcaaccccaccagctctggactaccctgctatccctgacattcgtcaagactaccctttctctcgactatgcgtggaaaacgacagccatggtactgagcattgtgtccttgtttccgctgtgtttatcaaccactagccagaagacaacctggctccctgttctgcttggaagtttcggttgcaaaccactgactatgtttttgataacagaaaacaagatctggggccgcaagtcttggcccctcaatgaggggattatggcaatcggaattgtgtccatcctgctaagctcgctgcttaaaaacgatgtccctctcgctggccccctgatagccggtgggatgttgatcgcctgttacgtgatttcaggatctagtgctgacttatccctggagaaggcagccgaagtaagctgggagcaggaagcggagcattctggcgctagccacaatatcctcgtggaagtccaagatgacggcaccatgaaaattaaggatgaggagcgggacgatacgctgactatccttctgaaagccaccttgctagcagtttccggggtgtatccaatgtcaatacctgccacactgttcgtgtggtacttctggcagaagaaaaagcagagaagtggagtcctctgggacacccccagcccaccggaagtggagagggctgttctggatgacggtatttatcgtatccttcagcgcggcttactggggcggtctcaagtaggagtgggcgtctttcaggatggtgtgttccatacaatgtggcacgttactagaggggcagtgctcatgtaccagggaaagaggttggaaccttcctgggcctcagtcaaaaaggacctgatcagttatggcggcgggtggcgatttcagggaagctggaacaccggtgaggaggtgcaagtaattgcggtcgaacccggcaaaaatccaaagaacgtgcagacgacacccgggactttcaaaacccctgagggagaagttggcgctatagccctcgactttaagccaggtacatccgggtctcccatcgtgaatcgggaggaaaagattgtcggactgtacggcaacggcgtggttaccacttcggggacctacgtgagcgcaatcgcccaggctaaagcctcacaagagggacctcttccggagattgaagatgaggtcttcaagaaacgcaatctgacaatcatggacttgcacccaggttccggcaagacgagaaggtatctacccgcaatagtgcgggaagctatcaaacgaaagctgagaactctcattttagcccctacccgcgtagtggcgagtgagatggccgaagcactgaaggggatgccaatcaggtaccagacaaccgctgttaaatctgagcatactggacgtgagattgtcgatcttatgtgccacgccacatttaccatgcggctgctcagccccgtgagagtgcctaactataatatgatcataatggacgaagctcatttcacggatccggcatccattgccgccaggggctacatctcaactcgcgtcggtatgggggaggctgcggcaatctttatgacagccacacccccaggatctgtagaggctttccctcagagcaacgccgtgattcaggacgaagaacgagatatccccgagagaagttggaactccggctatgactggataaccgattttccaggcaagactgtttggttcgtgcctagcattaaatctgggaacgacatcgcaaattgtttgcggaagaacggaaaaagggtcattcaactgtcacgcaagacattcgataccgagtaccagaagactaagaataatgactgggactatgtggttactacggatatctccgaaatgggtgccaactttcgtgctgacagagtgatagatccccggaggtgcctcaagccagtcattctgaaagacggcccggagcgcgtgatccttgcggggcctatgcccgtaaccgtggccagtgcagctcagcgaagaggacggatcggcaggaatcagaacaaggaaggtgatcaatacgtttacatggggcagccactaaataacgacgaggatcacgcccattggacagaggcaaaaatgctgttggacaatattaacactcccgaaggcatcattcctgccttattcgagccagaacgcgaaaagagcgctgccatagatggagaatatagactgaggggcgaggcgcggaagacctttgtcgagctcatgcgtcgcggggacctgcccgtgtggctttcgtacaaagtggcatctgaaggattccagtattccgatcgaagatggtgctttgacggtgagaggaataaccaggtcctggaagagaatatggatgttgaaatctggacaaaggagggcgagcggaaaaagctccgccctagatggttggacgccaggacctacagcgacccgctggctctacgggagttcaaagagtttgccgctgggcgaagatcagtgagtggagatctgattctcgaaatcggcaaacttccacaacacctgactttacgcgcacagaacgccttggacaatctggtaatgctccacaactctgagcagggtgggaaggcttataggcatgccatggaagaactgcccgatacgatcgagacccttatgctgctcgcattgattgcggtgctgacaggcggagtcactttattctttctatccggcaaggggctgggaaagaccagcataggtctcctttgtgtgacagcctcaagtgctctgttgtggatggccagcgttgaacctcactggatcgcagcttccattatcctggagttctttctcatggtgctgcttattcccgaaccagaccggcagcgtacccctcaagataatcagctcgcctacgtcgtaatcggcctgttgttcatgatactgactgtggcagccaacgagatggggttactagagacaacgaaaaaggacctgggaatcggccatgttgctgcggaaaaccaccagcactctaccatgctcgatgtggaccttcatcccgccagcgcatggactctgtatgctgtcgccacaaccgtgattaccccaatgatgagacacacaatcgagaatactacggccaacatttccttgaccgcaatcgctaatcaagccgcgatactgatgggtctcgataaagggtggcctatttcaaagatggacatcggcgtcccgctgcttgctttaggatgctactctcaggtgaaccccctgacactcactgccgcagttttgatgctggtggcccattacgctattatcggcccagggctacaggcaaaagccaccagggaagcgcagaagcgcacagctgccggaataatgaagaatcctaccgtagatggcatcgtggcaattgacctggatcccgtcgtttatgacgccaaatttgagaagcaactcggtcagatcatgcttctgattttgtgtacaagtcagatcctgctcatgcggacgacatgggctctgtgcgaatcgataaccttagccactgggccacttaccacactgtgggagggaagccctggcaaattctggaacactaccattgcagtgtccatggctaatatcttccgaggttcttacctcgccggcgcggggctagccttttcactgatgaaatccttgggaggcgggagaaggggaacaggcgcacagggtgagacgctgggggaaaaatggaagcgccaactcaaccagcttagcaagagtgagttcaatacctataaacggtctggaatcatggaagtcgacagaagcgaggctaaggaaggcctgaaacgtggtgagactacaaagcacgccgtgtcaaggggcaccgcaaaattgcggtggtttgtagagcgcaacctggtgaagcccgaagggaaggttattgatctcggatgtggccgagggggatggtcctactattgcgctggcctaaagaaggtgactgaggtcaaaggttacacaaaagggggaccgggccatgaggaaccaatccctatggccacctatggctggaatctggtgaaacttcacagtgggaaggacgtcttctttatgcccccagaaaaatgtgatacgctgctatgcgacataggagagagctctcccaaccctaccattgaggaaggtagaacactcagggtgctgaagatggttgagccgtggttgcggggcaatcagttctgtatcaagattctgaacccctacatgccatccgtagtggaaactctcgagcagatgcaacgcaaacacgggggaatgcttgtcagaaatcctctgtcaaggaacagcacccatgagatgtactgggtgtcgtgcggcacaggtaatatcgtttctgccgtgaacatgacaagtcgaatgttactgaaccggtttaccatggcgcaccgtaagcccacatatgaaagagatgtcgacttgggggctggaacccgccatgtggcagtagagcctgaagtggccaatctcgatataatcggccagaggattgagaacatcaaaaatgaacaccggtccacttggcactacgacgaggataacccatataagacgtgggcttaccatggcagctatgaggttaaaccctcagggtccgcctctagcatggtcaatggagtggtgagactgctaacaaagccttgggacgtcattccaatggttacccagatcgcaatgactgataccacacccttcggtcaacagcgcgtgtttaaggaaaaagtagacacgaggaccccgcgagccaagcggggcactacacagattatggaggtgaccgctaaatggctttgggggttcctgagtagaaacaagaaacctaggatctgtactcgcgaagagtttacacgtaaggtccggtccaatgcggccataggagcagtgttcgttgacgaaaaccagtggaatagcgctaaggaggccgtggaggatgaaagattttgggacctcgtccacagggagcgcgaactgcataaacaaggcaagtgcgcaacctgcgtgtacaacatgatgggtaaacgagagaagaaattgggggagttcggaaaggccaagggctctcgggctatttggtatatgtggctgggcgccagattcctcgagtttgaggcgcttgggttcatgaatgaagatcactggttttcaagggagaacagtctgtccggagtagaaggtgagggcttacataaactggggtacatcttgcgcgacatcagcaagattccaggaggcaatatgtacgcagatgacacagccggttgggatactagaataaccgaggacgatctccagaacgaagctaaaatcacggacattatggagcccgaacacgccctgctagcaacctctatcttcaaacttacatatcagaataaagttgtgcgggtccagaggcctgctaagaacgggactgtgatggatgtgatttcgcgtcgagaccaacgcggatcaggccaggtcggcacctacgggctgaacacatttactaatatggaggttcagctcatcagacagatggaaagcgagggaatattcctgccatccgagttggaaacccccaacttagccgagcgggctctggattggctcgaaaaacacggtgccgagaggcttaagcgcatggcaatcagtggcgacgactgtgtggtaaagccgattgatgacagatttgcgacggccctgacagctctaaatgatatggggaaagtgcggaaggacatccctcaatgggaaccctctaaaggatggaacgattggcagcaggtcccattctgcagccatcactttcatcagctgattatgaaggacggcagggagatcgtggttccttgtcgaaatcaagatgagctcgtgggtcgtgccagagtctcccagggggcaggatggtcattgcgcgaaaccgcttgcctgggcaaaagttatgcccagatgtggcaacttatgtacttccaccggagggacctgagactcgcagccaacgcgatatgttctgctgtgcccgtagattgggttccagccagccgcactacatggtccattcacgcacatcaccagtggatgaccactgaggacatgttatcagtgtggaatcgggtctggatcgaagagaacccctggatggaagataagacccatgtgagctcttgggaggaggttccttatctgggcaagagggaagaccagtggtgcgggtccttgatcggactgacagcccgagctacgtgggccaccaatattcaggtggcaataaaccaagtcagacggctcatcggtaatgagaactaccttgactatatgacaagtatgaaaaggtttaagaatgaaagcgatccagagggcgctctgtggtga

SEQ ID NO: 14144 - RNA, 9879 nt, synthetic construct
  misc_feature 1..9879: note = derived and/or modified CDS sequence (opt3) from DENV-1__KC692516__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaagcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttgggattttcactaccaacatctggcttaaattgcgtgatagctacacacagatgtgcgaccaccggctcatgtccgctgcaataaaggattcaaaagccgtgcatgctgacatgggatattggattgagagtgaaaagaatgagacgtggaaactggcccgagcatctttcatcgaagttaagacctgtacttggccaaagagccacacactatggtccaacggcgtgctggagtcagagatgattatccccaaaatatacggtggccctatcagccaacataattatagaccagggtactttacccagactgcgggaccgtggcacctcggcaagctggaacttgatttcgacttgtgcgaggggacaaccgtagtcgtggatgaacactgcggaaacaggggcccctctctgcgcacgactaccgtgacaggtaaaattatccatgagtggtgttgccggtcctgtaccttacctccactcagatttaggggggaggacggatgctggtacggcatggaaattcgccccgtcaaggagaaagaagagaatctggttcgaagtatggtgagcgccggttctggcgaagtagataacttctcccttgggatcctgtgtgtgtcaataatgattgaggaggtcatgcggagtcgttggagcagaaagatgttgatgactggaacactcgctgtgtttctgctactgatcatgggccagctcacctggaatgacctgatcaggctttgcattatggttggggccaacgcatcggaccgcatgggaatgggcacaacttatttggctctgatggccaccttcaagatgcggcctatgtttgcagtgggtttactcttcagaaggctgacgtcccgagaagtccttctgctaacaatcgggctctctctggtggccagcttggagctgccaaactcattagaagagctcggagatggcctggctatgggcattatgatgcttaaactgttgaccgaatttcaaccccaccagctctggactaccctgctaagtctgacattcgttaagactaccctttccctcgactacgcgtggaaaacgacagccatggtgctgtctatagtcagcttgtttccgctgtgtttatccaccacttcacagaagacaacctggctccctgtactgcttgggagcttcggatgcaaaccactgactatgtttttgatcacagagaataagatttggggtcgcaagagttggcccctcaacgagggcatcatggcaattgggatcgtgtctatactgctatccagcctgcttaaaaatgatgttcctctcgctggacccctgatcgccggcggtatgttgattgcctgttatgtgatctcggggtcatctgctgacttaagtctggaaaaggcagccgaggtctcctgggaacaggaggcggaacatagcggagcttctcacaacattctcgtggaggtacaagatgacggcaccatgaaaatcaaggatgaggaacgggacgatacgctgactatacttctgaaagccaccttgctagcagtgagcggcgtctacccaatgtccattcctgccacactgttcgtttggtatttctggcagaagaaaaagcagagatcaggggtgctctgggacacccccagtccaccggaggtggaaagggctgtcctggatgacggaatctaccgtatccttcagcgcggtttactgggccggagccaagtgggggttggagtatttcaggatggcgtgttccatacaatgtggcacgtcactagaggtgcagtgctcatgtatcaggggaagaggttggagccttcttgggcctgcgttaaaaaggacctgatttcctacggaggcggctggcgatttcaggggctctggaataccggagaggaagtgcaagtcatagcggtggagcccggtaaaaacccaaagaatgtacagacgacacccggcactttcaaaacccctgaaggggaggtcggagctatcgccctggactttaagccaggcacatcaggtagtcccattgtgaaccgggaagggaagatcgttggactttacggcaatggcgtggtcaccactagcgggacctatgtgtccgcaattgcccaggctaaagcctctcaagagggacctctgccggagatcgaagatgaggttttcaagaaacgcaacttgacaataatggacctacacccaggttcgggcaagacgagaaggtacctgcccgcaatcgtgcgggaagctattaaacgaaagctcagaactttaatcctggcccctacccgcgtcgtggcgagcgagatggccgaagcacttaaggggatgccaattaggtatcagacaaccgctgtaaaatcagagcatactggacgtgagatcgtggatctgatgtgtcacgccacatttaccatgcggctcttgtcccccgttagagtccctaattacaacatgataattatggacgaagctcatttcacggatccggcaagtatcgccgccaggggctatatctctactcgcgtgggtatgggggaggctgcggcaatttttatgacagccacccccccaggaagcgtggaagctttccctcagtccaatgccgtcatccaggacgaggaacgagatatacccgagagatcatggaactctggctacgactggattaccgattttccaggcaagactgtatggttcgtgcctagcatcaaaagtgggaatgacattgcaaactgcctgcggaagaacggaaaaagggttatccaactctcccgcaagacattcgataccgagtatcagaagacaaaaaataacgactgggactacgtggtcactacggatataagcgaaatgggtgccaattttcgtgctgacagagtgattgatccccggaggtgcctgaagccagttatccttaaagacggcccggagcgcgtgatcctagcggggcctatgcccgtcaccgtggcctctgcagctcagcgaagaggacggattggcaggaaccagaataaggaaggtgatcaatacgtatatatggggcagccactgaacaatgacgaggatcacgcccattggacagaggcaaaaatgttgttagacaacatcaatactcccgaaggcattatacctgccctgttcgagccagaacgcgagaagtcagctgccatcgatggagaatacagactcaggggcgaggcgcggaagacctttgtggagctgatgcgtcgcggggaccttcccgtttggctgtcctataaagtcgcaagtgaaggattccagtacagcgatcgaagatggtgttttgacggtgagaggaacaatcaggtgctcgaagagaacatggatgtggaaatttggacaaaggagggcgagcggaaaaagttgcgccctagatggctggacgccaggacctattcggacccgctagctctgcgggaattcaaagagtttgccgctgggcgaagatctgtctccggagatctcatccttgaaatcggcaagctgccacaacacttaactttgcgcgcacagaatgccctggacaacctcgttatgctgcacaatagcgagcagggtgggaaagcttacaggcatgccatggaagagcttcccgatacgattgagaccctgatgctcttggcactgatagcggtgttaacaggcggagtaactctattctttctgtcaggcaaggggctcggaaagaccagtatcggtcttctgtgcgtgacagcctcttccgctttgctgtggatggccagcgtcgaacctcactggattgcagcttcaatcattctcgagttctttctgatggtgcttctcatccccgaaccagaccggcagcgtacccctcaagataaccagctggcctatgttgtgataggcttgctgttcatgatcttaactgtcgcagccaacgagatggggctactggagacaacgaaaaaggacctcggaattggccatgtagctgcggaaaatcaccagcacgccaccatgcttgatgtggacctgcatcccgcaagtgcttggactttgtacgccgttgccacaaccgtgatcaccccaatgatgagacacacaattgagaacactacggcaaatatcagcctgaccgctatagccaaccaagcggctattctcatgggtctggataaagggtggcctatctccaagatggacattggcgtcccgcttttagccctgggatgttactctcaggtgaatcccctcacattgactgcagccgtcctgatgctagtggctcattatgcaatcataggcccagggctgcaggccaaagcgaccagggaagctcagaagcgcacagccgcaggaatcatgaagaaccctaccgttgatggcattgtggccatcgacctcgatcccgtagtgtacgacgctaaatttgagaagcaacttggtcagattatgctgttgatcctgtgcactagccagatactcctgatgcggacgacatgggccttatgtgaatccattacccttgcaactgggccactgaccacactctgggagggatcacctggcaaattctggaatactaccatcgctgtctctatggccaacatcttccgaggtagttatctagcgggcgccgggctggcattttcgttgatgaagagcctgggaggcgggagaaggggaacaggcgctcagggtgagacgctcggggaaaaatggaagcgccaacttaatcagctgtccaagtctgagttcaacacctacaaacggtcaggaattatggaagttgacagaagcgaggccaaggaaggcttgaaacgtggtgagactacaaagcacgcagtgtccaggggcaccgctaaactgcggtggtttgtcgagcgcaatctcgtgaagcccgaagggaaggtaatcgatttaggatgcggccgagggggatggagttattactgtgccggcctgaaaaaggtgactgaggttaaaggttatacaaaggggggaccgggccatgaagagccaatacctatggccacctacggctggaaccttgtgaaactgcactctgggaaggacgtcttctttatgcccccagaaaaatgcgatacgctactctgtgacattggagagagctcacccaatcctaccatcgaggaaggtagaacactgagggtgttgaagatggtcgagccgtggctgcggggcaaccagttctgcattaagatcctcaatccctacatgccatccgtggttgaaactcttgagcagatgcaacgcaaacacgggggaatgctggtaagaaaccctttaagtaggaatagcacccatgagatgtattgggtgtctcgaggcacaggtaacatagtctccgcggtgaacatgacttcacggatgctgttgaatcgttttaccatggctcacagaaagcccacatacgaacgcgatgttgacctcggggcaggaaccaggcatgtggccgtcgagcctgaagtggctaacctggatatcattggccagcggatcgagaatattaaaaacgaacacaagagcacttggcactatgacgaggataatccatacaaaacgtgggcctatcatggctcgtacgaggtaaagccctctgggagtgcatccagcatggtgaacggagttgtcagactacttacaaagccttgggacgtgatcccaatggtgacccagattgccatgactgataccacacccttcggtcaacagcgcgtctttaaagaaaaggttgacacgaggaccccgcgagctaaacggggcactacacagatcatggaggtgaccgcgaagtggctgtgggggttcctctcaagaaataaaaagcctaggatatgtactcgcgaagagtttacacgtaaggtacggtccaacgccgcaattggagctgtgttcgtcgacgaaaaacagtggaattctgccaaggaggcagtggaggatgaaagattttgggacctggttcacagggagcgcgaattgcataaacaaggcaagtgcgccacctgcgtgtataacatgatgggtaaacgagagaagaagctgggggaattcggaaaagctaagggcagccgggccatctggtacatgtggctcggcgcgagattccttgagtttgaggcactggggttcatgaatgaagatcactggtttagtagggagaactccttaagcggagtcgaaggtgagggcctgcataaattggggtacatcctccgcgacatttctaagataccaggaggcaatatgtatgccgatgacacagctggttgggatactagaatcaccgaggacgatctgcagaacgaagccaaaattacggacatcatggagcccgaacacgcactacttgctacctcaattttcaagctgacataccagaataaagtggtacgggttcagaggcctgccaagaacgggactgtgatggatgtcatcagtcgtcgagaccaacgcggatccggccaggtgggcacctatgggctcaacacatttactaatatggaggtgcagctgataagacagatggaaagcgagggaatcttcttgccatctgagttagaaacccccaacctggctgagcgggtcctcgattggcttgaaaagcacggtgccgagaggctgaaacgcatggcaatttcgggcgacgactgtgttgtgaagccgatcgatgacagatttgcgacggccctaacagctctgaatgatatggggaaagtacggaaggacattcctcaatgggaaccctcaaaaggatggaacgattggcagcaggtgccattctgcagccatcactttcatcagctcatcatgaaggacggcagggagatagtcgtgccttgtcgaaatcaagatgagttggttggtcgtgccagagtgtcccagggggcaggatggagtctgcgcgaaaccgcttgccttggcaagtcttacgcccagatgtggcaactgatgtatttccaccggagggacctcagattagcagccaacgcgatttgtagcgctgtccccgtggattgggtaccaacttcccgcacaacctggtcaatccacgcccatcaccagtggatgactaccgaggacatgctgagtgtttggaatcgggtgtggatcgaagagaacccctggatggaagataaaacacatgtctctagctgggaggaggtgccttacttgggcaagagggaagaccagtggtgcgggtccctgattggactcacggcacgagccacctgggctactaatatacaggttgccatcaaccaagtgagacggcttattggtaatgagaactatctggactacatgacatcaatgaaaaggtttaagaatgaaagcgatccagagggcgcactatggtga

SEQ ID NO: 14145 - RNA, 9879 nt, synthetic construct
  misc_feature 1..9879: note = derived and/or modified CDS sequence (opt3) from DENV-1__KC692517__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactatcgaacacggcacgattgccacaatcaccccccaggcgcctacttcagagatccagcttaccgactacggggccctgacattggactgtagtccaaggaccggactagatttcaacgaaatggtcctgctcactatgaaggagaaaagctggctggtgcataagcagtggtttcttgacctgccgttgccctggacatctggcgcatccacgcctcaagagacctggaatcggcaggatctcctggtaactttcaaaacagctcacgccaagaagcaggaagttgtggtcttaggttcacaagagggggctatgcacaccgccctgacaggcgcaactgaaattcagaccagcggaacgaccacaatatttgccggccatctaaaatgccgtctcaagatggacaaactgactcttaaggggatgagttatgtgatgtgtaccggatctttcaaattggagaaggaagtcgctgagacacagcacggtactgtgctggttcaggtgaagtacgagggcaccgatgcgccatgcaaaatccccttctccacgcaagacgaaaagggggtaacacagaacggacgcctcattaccgcaaatcctatcgtcactgataaagagaagagcgtgaacatagaaacagagccaccctttggcgagtcgtatattgttgtgggtgtcggggaaaaagccctgaagctttcttggttcaagaaaggctcctcaatcggaaagatgtttgaggctaccgccagaggcgcaaggcggatggccatcctgggggacactgcttgggatttcggaagtattggtggcgtgtttaccagcgtagggaaattggtgcatcaggttttcggaacagcctacggcgtcctcttttccggtgtgtcttggacgatgaagatcgggattggcatactgttaacctggctgggactaaatagccgatcaactagtctctccatgacatgtatcgcagtgggcatggtcaccctgtaccttggggttatggtgcaggcggacagcggatgcgtgattaactggaaaggccgcgaattgaagtgtggttctgggatcttcgtaacaaacgaggtccacacttggaccgaacaatataagtttcaggctgattcaccgaaaagactgagtgccgcaatcggaaaggcctgggaggagggcgtgtgcggtattaggagcgctacgcggctcgaaaatataatgtggaaacagatctccaacgagctgaatcatattttactggaaaacgacatgaagttcacagttgtggtcggcgacgccaatgggatccttgcacagggaaaaaagatgattcgccctcaacccatggagcacaaatactcttggaagtcgtggggcaaggctaaaatcataggggccgatatccagaacaccacttttattatcgacggaccagatacccctgaatgtcccgacggccagagagcgtggaatatttgggaggtggaggattatggtttcgggatctttacaactaacatatggttgaagctcagggacagctacacccagatgtgcgatcaccgtctgatgtccgccgctattaaagactcaaaggcagttcatgccgatatgggatattggatcgaaagtgagaaaaatgaaacatggaagctagctcgggcctctttcattgaggtgaagacgtgtacctggccaaaaagccacactctgtggtccaacggcgtactcgaatcagagatgatcatacccaagatctacggtggccctattagccaacataattatcgaccagggtacttcacacagaccgcaggaccgtggcacctgggcaaacttgagttggactttgatctgtgcgaagggactacagtcgtggtggacgagcactgcggaaacagaggcccctctttaaggaccacgactgtcaccggtaagatcattcatgaatggtgttgccgctcctgtacactccctccactgcggttcagaggggaggatggatgctggtacggcatggagatcaggcccgttaaagaaaaggaggaaaatcttgtgcgcagtatggtaagcgcgggttctggcgaggtggactccttttcactggggatattgtgtgtcagtattatgatcgaagaggtgatgcgaagccggtggtcgcgtaagatgctcatgaccggaactctggccgttttcctactgctcatcatgggccagctgacatggaacgaccttattagattgtgcatcatggtgggggctaatgcctccgataggatgggaatgggcaccacatatctggcattaatggctacttttaaaatgcgccctatgttcgccgtcggtctcctgtttcggagacttacctctagggaggtgctgctactcacgattgggctgagcttggttgcatcagtggaactgccaaacagtttagaggaactcggagacggcctggccatgggcataatgatgcttaagctgttgacagagttccaaccccaccagctctggaccactctgctatccctgacctttgtcaaaacaactctttctctcgattacgcttggaagaccacggcgatggtactgagcatcgtgtccttgttcccgctgtgtttatcaacaaccagccagaaaactacatggctccctgttctgcttgggagttttggatgcaacccactgaccatgttcttgattactgaaaataagatctggggtcgaaagtcttggcccctcaacgagggcattatggccatcgggatagtgtccatcctgctaagctcgctgcttaaaaatgacgtccctctcgcaggacccctgattgctggcggtatgttgatcgcctgttatgtgatttcagggtctagtgccgatttatccctggagaaggctgcagaagtaagctgggagcaggaagccgagcattctggagcgagccacaacatcctcgtggaagtccaagacgatggcacaatgaaaataaaggacgaggagcgcgatgacaccctgacgattcttctgaaagctactttgctagccgtttccggcgtgtacccaatgtcaatccctgcaaccctgtttgtgtggtatttctggcagaagaaaaagcagcggagtggggtcctctgggatacacccagcccaccgaaggtggaaagagccgttctggacgatggaatctacaggattcttcagcgtggtttactgggccgctctcaagtaggggtgggagtcttccaggacggcgtgtttcataccatgtggcacgttacacggggtgctgtgctcatgtatcaggggaaaagattggagccttcctgggcatcagtcaagaaagacctgataagttacggaggcggctggaggttccaggggagctggaatactggagaagaggtgcaagtaatcgccgtcgagcccggtaagaacccaaaaaatgtgcagaccacgcccggcacatttaagactcctgaaggggaggttggagcgattgctctcgatttcaagccaggcacctccggttctcccatcgtgaaccgagaagggaaaattgtcggactgtacggcaatggcgtggttacaacctcggggacttatgtgagcgccatcgcacaggccaaggcttcacaagagggacctcttccggaaatagaggacgaggtctttaaaaagcggaacctgaccatcatggatttgcacccaggttccggcaaaacacgcagatacctacccgccattgtgagggaagcaatcaagcggaagctgcgaacgctcattttagctcctactagagtagtggccagtgagatggcggaagccctgaaagggatgccaatccgctatcagaccacagcagttaagtctgagcataccggaagggaaatagtcgaccttatgtgccacgctactttcacaatgcgtctgctcagccccgtgcgggtgcctaattacaacatgattatcatggatgaggcccattttaccgacccggcttccatcgcagccagaggctatatttcaacgagggtcggtatgggggaggccgctgcgatcttcatgactgcaacacccccaggatctgtagaagcctttcctcagagcaatgctgtgatacaggatgaggaacgcgacattcccgagcgaagttggaactccggctacgattggatcaccgacttcccaggcaaaaccgtttggtttgtgcctagcattaagtctgggaatgatatcgccaactgtttgagaaaaaacggaaagcgggtcatacaactgtcaaggaagactttcgacacagaatatcagaaaaccaagaataacgactgggattacgtggttacaactgacatttccgagatgggtgcaaatttccgcgccgatcgtgtgatcgaccccagacggtgcctcaaaccagtcatcctgaaggatggcccggagagggtgattcttgctgggcctatgcccgtaacggtggcgagtgccgcacagcgccgaggaagaatcggccggaaccagaataaagaaggtgaccaatacgtttatatggggcagccactaaacaatgatgaggaccacgctcattggaccgaagccaagatgctgttggataacattaatacacccgagggcataatccctgcattatttgagccagaaagggagaagagcgccgctattgacggagaataccgcctgagaggcgaggccaggaaaactttcgtcgaactcatgcggcgtggggatctgcccgtgtggctttcgtataaggtggcgtctgagggatttcagtactccgaccgccgatggtgcttcgatggtgagagaaacaatcaggtcctggaagagaacatggacgttgaaatctggaccaaagagggcgaaaggaagaaactccggcctcgctggttggacgcaagaacatatagcgatccgctggccctaagggagtttaaggagttcgctgccgggcggcgatcagtgagtggagacctgatcctcgaaattggcaaacttccacaacacctgaccttaagagctcagaatgcattggataacctggtaatgctccacaattctgagcagggtgggaaggcctaccgccatgctatggaagagctgcccgacactatagaaacgcttatgctgctcgccttgatcgcagtgctgaccggcggagtcacattatttttcctatccggcaaggggctgggaaaaactagcattggtctcctttgtgtgaccgcgtcaagtgccctgttgtggatggctagcgttgagcctcactggatcgccgcatccattatcctggagtttttcctcatggtgctgcttatacccgaaccagataggcagcggacacctcaagacaaccagctcgcttatgtcgtaatcggcctgttgtttatgattctgaccgtggccgcaaacgagatggggttactagaaactacaaagaaagatctgggaatcggctacgttgccgctgagaatcatcagcacgcgacgatgctcgacgtggatcttcgtcccgcctctgcatggaccctgtacgctgtcgccactacagtgattaccccaatgatgagacacaccatcgagaacacaactgccaatataagcttgacggcaattgctaaccaagccgcgatcctgatgggtctcgacaaggggtggcctatttccaaaatggatatcggcgtcccgctgcttgctttaggatgctattcacaggtgaatcccctgaccctcacagccgcagttttgatgctggtggcccattacgctataatcggcccagggctacaggcaaaggccactagggaagcgcagaagcgcaccgctgccggaattatgaaaaaccctacagtagacggcatcgtggcaattgatctggaccccgtcgtttatgacgccaagttcgagaaacaactcggtcagatcatgcttctgatattgtgtacctctcagattctgctcatgcggactacgtgggctctgtgcgaaagtatcacattagccaccgggccacttactaccctgtgggagggatcgcctggcaagttttggaatacaactatcgcagtgagcatggctaacattttccgaggttcctacctcgccggcgcggggctagccttctctctgatgaaatcattgggaggcgggagaaggggaaccggcgcacagggtgaaacactgggggagaagtggaagcgccaactcaatcagcttagcaaatccgagtttaacacgtataagcggagtggaatcatggaagtcgatagatctgaggctaaagaaggcctgaagcgtggtgagaccactaaacacgccgtgagcaggggcacagcaaagttgcggtggttcgtagaacgcaatctggtgaagcccgaggggaaagttatagacctcggatgtggccgagggggatggtcatactattgcgctggcttaaagaaagtgaccgaggtcaagggttacactaaagggggaccgggccatgaagagccaattcctatggccacatacggctggaacctggtgaagcttcactccgggaaagatgtctttttcatgcccccagaaaagtgtgacaccctgctatgcgatatcggagagagtagccccaatcctacgattgaagagggtagaaccctcagggtgctgaagatggttgagccgtggttgcggggcaaccagttttgtatcaaaatactgaatccctatatgccatctgtagtggaaacactcgagcagatgcaacgcaagcatgggggaatgcttgtcagaaaccctctgtccaggaattcaactcacgaaatgtactgggtgagctgcggcaccggtaacatcgtttcggccgtgaacatgacatctcgaatgttactgaatcggttcactatggcgcaccgtaaacccacctatgagagagacgtcgatttgggggctggaacacgccatgtggcagtagagcctgaagtggccaacctcgacattatcggccagaggattgagaatatcaagaacgaacacaaaagtacctggcattacgatgaggacaatccatataagacttgggcttaccacggctcctatgaagttaagcccagcgggtcagcctcctctatggtcaacggagtggtgcggctgctaacgaaaccttgggatgtcattccaatggttacacagatcgcaatgaccgacactaccccctttggtcaacagagagtgttcaaggagaaagtagacacacgcacgccgagggccaagcgaggcaccactcagataatggaggtgacagctaaatggctttgggggtttctgagccggaataagaagcctagaatttgtaccagggaagagttcactcgcaaagtccgtagtaacgcggccatcggagcagtgtttgttgatgaaaatcagtggaactccgctaaggaggccgtggaagacgagcggttctgggatctcgtccacagagagagggaactgcataaacaaggcaagtgcgcaacatgcgtgtacaatatgatgggtaaacgcgagaagaagttgggggaatttggaaaagccaagggcagccgagctatctggtacatgtggctgggcgcccggttcctcgagttcgaagcgcttgggtttatgaacgaggaccactggttctctagagagaattcactgagtggagtagaaggtgagggcttacataaactggggtatattttgagggatatatccaagatcccaggaggcaacatgtacgcagacgataccgccggttgggacacacgcattactgaagatgacctccagaatgaggctaaaatcaccgatattatggagcccgaacacgccctgctagcaacgagcatctttaagcttacctatcagaacaaagttgtgagagtccagcggcctgctaagaacgggacagtgatggacgtgatatctaggcgtgatcaacgaggatcgggccaggtcggcacttacgggctgaataccttcacaaacatggaggttcagctcgtgcgccagatggaatcagagggaatctttctgccaagcgaattggagactcccaatttagccgagagagtactggactggctcgaaaagcatggtgtggagcggcttaaaaggatggctatttccggcgacgattgtgtcgtgaagccgatcgacgatcgcttcgccaccgcactgacggcgctaaacgacatggggaaagttagaaaggatattcctcaatgggaacccagtaaaggatggaatgactggcagcaggtgccattttgctctcaccacttccatcagctgatcatgaaggatggccgggagatagtcgtgccttgtaggaaccaagacgaactcgtaggtcgagcccgtgttagccagggggctggatggtccttgagagagacagcctgcctgggcaagtcatatgcacagatgtggcaacttatgtactttcaccgccgggatctgaggctcgctgccaatgcaatttgtagtgccgtgcccgtcgactgggtgccaacctctagaactacatggagcatccatgcgcaccaccagtggatgaccactgaggatatgttatccgtttggaaccgcgtgtggatcgaagagaatccctggatggaagacaaaacccatgtctcaagctgggaggaagtgccttatctgggcaagcgggaggaccagtggtgcgggtctttgattggactgacagctagggccacgtgggcaaccaacatacaggtagccatcaatcaagtgcgaagactcattggtaacgagaattaccttgattacatgacttccatgaaacggttcaagaacgaaagtgacccagagggcgctctgtggtga

SEQ ID NO: 14146 - RNA, 9879 nt, synthetic construct
  misc_feature 1..9879: note = derived and/or modified CDS sequence (opt3) from DENV-1__KC762649__SS-prME
  source 1..9879: mol_type = other RNA
agcgtgaccatgctgctcatgcttatgcccacagcactggctttccacttgactacgagaggaggggaacctcatatgatcgtctccaagcaggaaagaggaaaatctttactgtttaagacctcagccggtgttaacatgtgcacattaattgccatggacctcggcgaactgtgtgaagatactcttacctacaaatgcccacggattacagaagcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcgcctcgattacacagaagggcatcatattcatcttactgatgcttgtgaccccatcaatggcgatgcgctgcgtcgggattggaagcagagattttgtggagggtttgagtggcgcaacgtgggtagacgttgtgctggagcacgggtcctgtgtcactacaatggccaaggataaacccaccctagacatcgaactcctgaagactgaggtgacaaaccctgctgtgcttaggaaactgtgcattgaagccaagatctctaataccacgaccgatagccggtgtccaacacaaggagaggcaactttggtcgaagaacaggacgctaacttcgtttgccgccgaacctttgtggatagaggctggggtaatgggtgtggactcttcggcaaaggctccctgataacatgcgccaagtttaagtgcgtatcaaaattagaggggaagattgtgcagtacgaaaacctgaaatatagtgtcatcgtgactgttcacaccggagaccagcatcaagtgggtaatgagagcacagaacacggcaccactgcgacgattacaccccaggcccctaccactgagatccagctcaccgactacggggcacttacactggattgttctccaaggaccggattggacttcaacgaaatggtcctactgactatgaaggagaaatcctggctcgtgcataagcagtggtttctggatcttccgctgccctggacatcaggcgctagcacgagtcaagagacctggaatcggcaggacttgctcgtaactttcaaaacagcccacgctaagaagcaggaagttgtggtcctgggttctcaagagggggccatgcacaccgcattaacaggcgccactgaaatccagacctccggaacgaccacaatttttgctggccatctgaaatgccgtctaaagatggataaactcactctgaaggggatgagctatgtgatgtgtaccggatcgttcaaacttgagaaggaagtcgcggagacacagcacggtactgtgttggttcagataaagtacgagggcaccgacgcaccttgcaaaatcccattctctacgcaagatgaaaagggggtgacacagaacggacgcctgattaccgccaatcccatcgtaactgacaaagagaagcctgtcaacatagaagctgagccaccctttggcgagtcctatattgtgatcggtgccggggaaaaagcactcaagctgtcatggttcaagaaaggcagtagcatcggaaagatgtttgaggccacagctagaggcgccaggcggatggcaattcttggggataccgcgtgggacttcggatccatcggtggcgtttttacttctgtggggaaactggtccatcagattttcggaaccgcttacggcgtgttgtttagcggtgtatcatggacaatgaagatagggatcggcgtgctcctgacgtggttaggactgaatagtcgatccaccagcctatctatgacttgtattgccgttggcctcgtcacactgtaccttggggtgatggtgcaggcagattcaggatgcgtcatcaactggaaaggccgcgaattgaagtgtggtagtgggatcttcgttaccaatgaggtgcacacatggactgaacaatataagtttcaggccgacagcccgaaaagactgtccgctgccattggaaaggcatgggaggagggcgtgtgcggtataaggtctgctacccggctcgaaaacatcatgtggaaacagatttcgaacgagctgaatcatatcttactggaaaacgacatgaagttcacggtagtcgtgggcgatgttgccgggattcttgcgcagggcaaaaagatgatccgccctcaacccatggagcacaaatacagctggaagtcctggggcaaggccaaaataatcggggctgacgtgcagaatacaacctttattatcgatggaccaaacactcctgaatgtcccgacgatcagagagcatggaatatttgggaggtcgaggactatggcttcggtatctttaccacaaacatatggttgaagctcagggattcatacactcaggtgtgcgaccaccgtctgatgagtgccgctattaaagattctaaggccgttcatgcagacatggggtattggatcgaaagcgagaaaaatgaaacctggaagctagcgcgggcctccttcattgaggtgaagacatgtatctggccaaaatcacacacgctgtggagcaacggagtactcgaatctgagatgataatccccaagatttacggcggtcctatctcccaacataattatcgaccaggctacttcacccagactgctgggccgtggcacctgggaaaacttgagttggattttgacctgtgcgaaggcacaaccgtcgtggtggatgagcactgcgggaacagaggacccagtttaaggactacaaccgtcacgggcaagattatccatgaatggtgttgccgcagctgtactctccctccactgcggttcagaggtgaggacgggtgctggtacggaatggagataaggcccgttaaagaaaaggaggaaaatcttgtgaagtctatggtatccgccggctcaggtgaggtggacagttttagcctgggcttgctctgtatttcgatcatgatcgaagaggtcatgcgctcccgatggtctcggaaaatgctgatgaccgggacactagcagtgttctttctgctcattatgggacagctgacctggaacgatcttatccgtttgtgcattatggttggcgctaatgccagcgacagaatggggatgggaactacatatctggcattaatggccaccttcaagatgaggcctatgtttgctgtgggcctcctgttccgccggcttacatcaagagaggtcctgctactcactataggtctgagtttggtggcgtccgttgaactgccaaactctttagaggaactcggggatggactggccatgggcatcatgattcttaaactgttgaccgactttcaaagccaccagctctgggcaacgctgctatccctgacattcatcaagaccactttttcacttcattacgcttggaaaaccatggccatggtgctcagcattgtcagtctgttccccttgtgtctgtctacaacttcccagaagaccacgtggttaccggtactcctgggcagccttgggtgcaagcctctgacaatgtttttgatcgccgagaataaaatatggggaaggaagtcgtggccactcaacgaaggtatcatggctgtgggcattgtttcaatcctgctatctagtctgcttaaaaacgatgtgcccctcgcagggcctctgattgccggaggcatgttgatcgcgtgttatgtcatatccggtagctctgctgacttaagcctggagaaggccgcagaggtgtcctgggaagaggaagccgagcactcaggggctagtcataatattctcgtagaagtgcaggatgacggaaccatgaaaatcaaggatgaggagcgagacgatactctgacaatccttctgaaagcaaccttgctagccgtcagcggcgtttaccccctgtctattccagcgactctcttcgtgtggtatttctggcaaaagaagaaacagcgctccggcgtgctgtgggacacaccttcacccccagaagtcgagcgggctgtgcttgatgacgggatatacagaatcatgcagaggggattactgggtcgtagtcaggttggcgtaggggtgtttcaagaaaacgtcttccacaccatgtggcacgtgacgcgcggagccgttctcatgtatcagggcaagcggttggagccgagctgggcatccgtgaaaaaggacctgatttcttacggtgggggatggagactccagggctcgtggaatactggcgaggaagtccaggtgatcgccgtagagcctgggaaaaaccccaagaatgtccaaaccgctccaggaatttttaagacacccgaaggtgaggtgggcgccatcgcactggatttcaaacctgggaccagcggatcaccaatagttaacagggaaggcaagatcgtgggtctttacgggaatggagtcgtgacaacttccggcacctatgttagtgctattgcccaggcgaaagcctctcaggagggccccctgcctgagatcgaagacgaggtgtttcgaaagcggaacttgacgattatggatctacatccggggagcggaaaaacacgcagatacctgccagcaatcgtcagggaagctataaagcggaagctccgaactttaattctggcccccaccagagtggtagcttccgagatggcagaagcccttaaaggtatgcctatccgctatcaaacaaccgccgtgaagtcagagcacactggcaaagagatcgttgacctgatgtgccatgctaccttcacaatgaggctcttgtctccagtccgtgtgcccaattacaacatgattatcatggatgaagcgcactttacggaccctagcagtatagcagcccgggggtatatttccactagagtgggaatgggcgaggctgccgcaatcttcatgaccgccacaccgcccggtagcgtcgaggcttttccacagtctaatgcggtaattcaggatgaggaaagggacatccctgagcgctcatggaactccgggtacgagtggataaccgatttccccggaaagactgtgtggtttgttccaagtattaaaagcggcaatgacatcgccaactgtctgcgaaagaatggcaagagagtgatccagctctcgcggaaaacattcgataccgaatatcaaaagacgaaaaacaacgactgggactacgtcgtgactacagatatttctgagatgggggcaaatttcagggctgaccgcgttatcgatcctcgtagatgcctgaagcccgtgattcttaaagacggaccagaacgggtcatactagccggtccgatgcctgtgaccgtagcatccgccgctcagaggcgcggccgagtggggagaaaccataataaggagggagatcagtacatctatatgggccagcccctgaacaatgacgaggatcacgcccactggaccgaagcgaagatgttgttagacaacattaatactccagagggtatcatccccgcactgtttgaacctgagcgggagaaaagcgccgctattgatggggagtacaggctccgcggcgaggccagaaagacattcgttgaactgatgaggcggggagaccttccagtctggctgtcatataaagtggctagtgagggctttcaatactctgatcgtcgctggtgcttcgacggggaacgaaacaatcaggtgctcgaggaaaacatggatgtcgagatatggaccaaggagggagaaaggaaaaagttgaggccccggtggctggacgcacgcacatattccgaccctctagccctgagagagtttaaagagttcgctgccggtaggcggagcgtttcaggcgatctcatccttgagattgggaagctgccgcagcatttaactcagcgagcacaaaatgcgttggacaacctggtgatgctccacaatagtgaacagggaggcagagcctaccgccatgctatggaggagctgccagatacgatcgaaacccttatgctgctcgccttgattgcagtactgacaggtggggtgactttatttttcctaagcggcaggggactgggcaagacctccatcgggctcctttgtgtcatggcttctagcgtgctgttgtggatggcctccgttgagccccactggatagcagcctcaatcattctggaatttttcctcatggtgctgcttatccctgagcccgaccggcagcgtacaccacaggataaccaactcgcttatgtcgtaattggactgttgtttatgatcctgaccgtggcggccaatgagatgggtttactagaaactacgaaaaaggacctgggcatagggcacgttgcagtggagaaccatcaccatgctgccatgctcgatgtcgaccttcaccctgcctctgcatggaccctgtacgctgtggccacaactattatcacccccatgatgagacatacaattgaaaacaccactgcgaatatcagtttgacagctatagccaaccaggcagccatcctgatgggactcgataaaggctggccaatttcgaagatggacatcggtgtccctctgcttgctttagggtgctacagccaggtgaatccgctgacgctcaccgcagccgttttgatgctggtggcgcactatgctattatcggccccggactacaagccaaagcaactagggaggcccagaagcgcacagctgccggcataatgaagaacccaaccgtagatgggattgtggcaatcgacctggatcctgtcgtttacgacgctaaattcgaaaagcagctcggacagatcatgcttctgattttgtgtacctcccaaatcctgctcatgcggacaacttgggccctgtgcgagtctataacgttagcgaccggcccccttacaactctgtgggagggttcaccagggaaattttggaataccacaattgccgtgagcatggcaaacatcttccgaggatcctatctcgctggcgccggtctagcattcagtctgatgaagtctttgggcgggggaagaaggggcaccggggctcagggagaaactctgggcgagaaatggaagcgccagctcaatcagcttagcaagtcagaatttaacacgtacaaacggtccggtattatggaggtcgacagaagtgaagccaaggaggggctgaaacgtggagagacaaccaagcacgccgtgagcaggggcactgcgaaattgcggtggttcgtagaacgcaatctggtgaagcctgagggtaaggttatcgatctcggctgtgggcgaggaggctggtcttattactgcgctgggctgaaaaaggtgaccgaagtcaaaggatatacaaagggcggtcccgggcatgaggaaccgataccaatggcaacttacggatggaacctagtgaaacttcactccggcaaggacgtctttttcatccctcccgagaaatgtgataccctgctatgcgacattggcgagtcaagcccaaatcccacaatcgaagaggggagaacgctcagggtgctgaagatggttgaaccttggttgcggggaaaccaattttgtattaagatcctgaatccgtacatgccctcggtagtggagaccctcgagcagatgcagcgcaaacatggtggcatgcttgtcagaaacccactgtctaggaatagtactcacgaaatgtattgggtgtcctgcgggacaggaaacattgttagcgccgtgaatatgacctcacgaatgttactgaaccggttcactatggctcaccgtaagcctacatacgagagagatgtcgacttgggcgccggtacccgccatgtggcagtagaacccgaggtggccaacctcgatatcatagggcagaggattgaaaatatcaaacacgagcataagtccacgtggcactatgacgaggataacccttacaaaacctgggcttatcatggatcttacgaagttaagccaagcggcagtgcgtccagcatggtcaatggcgtggtgaagctgctaacaaaaccctgggacgtcatccctatggttactcaaattgccatgaccgatacaactccatttgggcagcagcgggtgttcaaggagaaagtagacaccagaacacccaaggcaaaacgcggaaccactcaaataatggaagtgacggctaggtggctttggggttttctgtctcgaaacaagaagccgcggatctgtacaagagaggagttcaccaggaaagtccgctcaaatgccgcaattggcgccgtgtttgttgacgagaaccagtggaatagtgctaaggaggccgtggaagatgagcgtttctgggacctcgtccaccgggaaagagagctgcacaaacaggggaagtgcgcgacttgcgtgtataacatgatgggaaaaagggaaaagaagttgggcgagtttggtaaagcaaaggggtcccgcgccatctggtacatgtggctgggagctcgattcctcgagttcgaagcccttggctttatgaatgaggatcattggttcagccgggaaaactctctgtcgggcgtagagggggagggattacacaaactgggttacattttgagagacatctcaaagatacctggcgggaatatgtatgcagatgacaccgctggatgggatacaaggatcacggaagacgatctccagaacgaggccaaaattaccgacatcatggaaccagagcatgctctgctagccaaggcaatttttaaacttacttaccaaaataaggttgtgcgcgtccagagacccgcgaagaacggcacagtgatggatgtgatcagccggagggaccagcgtggttccgggcaggtcggaacctatggcctgaatactttcacaaacatggaagcccaactcatacgacagatggagagtgagggcatattttctcctagcgaactggagaccccaaacttggctgaacgcgttttagattggctggagaaatacggggtggaaagactcaagcggatggccatctccggagacgactgtgtagtgaaacccatcgatgacaggttcgcaacagctcttactgccctgaatgatatgggtaaggtccgcaaagacattccgcagtgggagccttcaaagggctggaacgattggcagcaagtgcccttttgcagtcaccacttccatcagctaataatgaaggacgggagagagatcgttgtgccatgtcggaatcaggatgaactggtcggaagggcacgagtgtctcagggcgccggttggagcctccgtgagaccgcgtgcttggggaaatcctatgctcaaatgtggcagctgatgtactttcacagacgcgaccttcggctggccgcaaacgccatttgttcagctgtacctgttgattgggtgcccacgagcaggaccacatggtctatccatgcccaccatcagtggatgactaccgaagacatgctctccgtctggaatagagtgtggattgaggaaaacccatggatggaggataagacacacatcagtagctgggaggacgttccctatttaggaaaacgcgaagaccaatggtgcggctcgctgataggcttgactgcacgggctacctgggccacgaatatccaggtggcgattaaccaggtcaggcgactgatcgggaatgagaactacctcgattacatgacatccatgaagagattcaaaaatgaatctgaccctgagggagctctttggtga

SEQ ID NO: 14147 - RNA, 9879 nt, synthetic construct
  misc_feature 1..9879: note = derived and/or modified CDS sequence (opt3) from DENV-1__KC762625__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaatatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctagacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtatcaaaattagaggggaagattgtgcagtacgaaaacctgaaatatagtgtcatcgtgaccgttcacacaggagaccagcatcaagtgggtaatgagagcaccgaacacggcactacggccacaattacaccccaggcgcctactaccgagatccagctcacagactacggggcccttaccctggattgttctccaaggactggattggacttcaacgaaatggtcctactgacaatgaaggagaaatcctggctcgtgcataagcagtggtttctggatcttccgctgccctggacgtcaggcgcaagcaccagtcaagagacttggaatcggcaggacttgctcgtaacattcaaaaccgctcacgccaagaagcaggaagttgtggtcctgggttctcaagagggggctatgcacacagccttaactggcgcaaccgaaatccagacgtccggaaccacaactatttttgccggccatctgaaatgccgtctaaagatggataaactcaccctgaaggggatgagctatgtgatgtgtacaggatcgttcaaacttgagaaggaagtcgctgagactcagcacggtaccgtgttggttcagataaagtacgagggcacggacgcgccttgcaaaatcccattctctacacaagatgaaaagggggtgacccagaacggacgcctgattactgcaaatcccatcgtaacagacaaagagaagcctgtcaacatagaagccgagccaccctttggcgagtcctatattgtgatcggtgctggggaaaaagccctcaagctgtcatggttcaagaaaggcagtagcatcggaaagatgtttgaggcaaccgccagaggcgctaggcggatggccattcttggggatactgcatgggacttcggatccatcggtggcgtttttacctctgtggggaaactggtccatcagattttcggaacagcgtacggcgtgttgtttagcggtgtatcatggacgatgaagatagggatcggcgtgctcctgacctggttaggactgaatagtcgatccactagcctatctatgacatgtattgctgttggcctcgtcaccctgtaccttggggtgatggtgcaggccgattcaggatgcgtcatcaactggaaaggccgcgaattgaagtgtggtagtgggatcttcgttacaaatgaggtgcacacttggaccgaacaatataagtttcaggcagacagcccgaaaagactgtccgccgctattggaaaggcctgggaggagggcgtgtgcggtataaggtctgcaacgcggctcgaaaacatcatgtggaaacagatttcgaacgagctgaatcatatcttactggaaaacgacatgaagttcacagtagtcgtgggcgatgttgctgggattcttgcccagggcaagaagatgatccgccctcaacccatggagcacaaatacagctggaagtcctggggcaaggcgaaaataatcggggccgacgtgcagaataccacttttattatcgatggaccaaacacccctgaatgtcccgacgatcagagagcttggaatatttgggaggtcgaggactatggcttcggtatctttacaactaacatatggttgaagctcagggattcatacacccaggtgtgcgaccaccgtctgatgagtgcagccattaaagattctaaggctgttcatgccgacatggggtattggatcgaaagcgagaaaaatgaaacatggaagctagcacgggcgtccttcattgaggtgaagtcatgtatctggccaaaaagccacacgctgtggtctaacggagtactcgaatccgagatgataatccccaagatttacggcggtcctatcagtcaacataattatcgaccaggctacttcacccagactgccgggccgtggcacctgggaaaacttgagttggattttgacctgtgcgaaggcacaaccgtcgtggtggatgagcactgcgggaacagaggacccagcttaaggactacaaccgtcacgggcaagattatccatgaatggtgttgccgctcttgtactctccctccactgcggttcagaggtgaggacgggtgctggtacggaatggagataaggcccgttaaagaaaaggaggaaaatcttgtgaagtccatggtatcagctggcagtggtgaggtggacagcttttcgctgggcttgctctgtatttccatcatgatcgaagaggtcatgcgctctcgatggagccggaaaatgctgatgaccgggacactagccgtgttctttctgctcattatgggacagctgacctggaacgatcttatccgtttgtgcattatggttggcgcaaatgcttcagacagaatggggatgggaactacatatctggccttaatggcaaccttcaagatgaggcctatgtttgccgtgggcctcctgttccgccggcttacaagtagagaggtcctgctactcactataggtctgtccttggtggcttctgttgaactgccaaacagcttagaggaactcggggatggactggcgatgggcatcatgattcttaaactgttgaccgactttcaatcccaccagctctgggccacgctgctatcactgacattcatcaagaccacttttagccttcattacgcatggaaaaccatggctatggtgctcagtattgtctctctgttccccttgtgtctgtccacaactagccagaagaccacgtggttaccggtactcctgggctcgcttgggtgcaagcctctgacaatgtttttgatcgccgagaataaaatatggggaaggaagtcatggccactcaacgaaggtatcatggccgtgggcattgtttctatcctgctaagttccctgcttaaaaacgatgtgcccctcgctgggcctctgattgcaggaggcatgttgatcgcctgttatgtcataagcggttctagcgcggacttatccctggagaaggctgccgaggtgtcatgggaagaggaagcagagcacagtggggccagccataatattctcgtagaagtgcaggatgacggaaccatgaaaatcaaggatgaggagcgagacgatactctgacaatccttctgaaagctaccttgctagcagtctctggcgtttaccccctgtccattccagccactctcttcgtgtggtatttctggcaaaagaagaaacagcgctcaggcgtgctgtgggacacacctagtcccccagaagtcgagcgggcggtgcttgatgacgggatatacagaatcatgcagaggggattactgggtcgtagccaggttggcgtaggggtgtttcaagaaaacgtcttccacaccatgtggcacgtgacgcgcggagctgttctcatgtatcagggcaagcggttggagccgtcctgggcctctgtgaaaaaggacctgatttcgtacggtgggggatggagactccagggcagctggaatactggcgaggaagtccaggtgatcgcagtagagcctgggaaaaaccccaagaatgtccaaaccgccccaggaacatttaagacccccgaaggtgaggtgggcgctattgccctggatttcaaacctgggacatcaggatccccaatcgttaacagggaaggcaagatagtgggtctttacgggaatggagtcgtgactaccagtggcacgtatgtttctgcaatcgctcaggccaaagcgagccaggagggccccctgcctgagattgaagacgaggtgtttcgaaagcggaacttgacaatcatggatctacatccggggtccggaaaaactcgcagatacctgccagccattgtcagggaagcaatcaagcggaagctccgaaccttaatactggctcccacaagagtggtagcctcagagatggctgaagcacttaaaggtatgcctattcgctatcaaaccactgccgtgaagtctgagcacaccggcaaagagatcgttgacctgatgtgccatgccacattcacgatgaggctcttgagcccagtccgtgtgcccaattacaacatgatcattatggatgaagctcactttactgaccctagttccatcgcggcacgggggtatataagcaccagagtgggaatgggcgaggccgctgccattttcatgacagcaaccccgcccggttctgtcgaagcctttccacagtcaaatgctgtaatccaggatgaggaaagggacattcctgagcgctcctggaacagtgggtacgagtggatcactgatttccccggaaagacagtgtggtttgttccaagcataaaatcgggcaatgacattgcgaactgtctgcgaaagaatggcaagagagtgatccagctctctcggaaaaccttcgatacggaatatcaaaagactaaaaacaacgactgggactacgtcgtgacaaccgatatctccgagatgggggccaatttcagggcagaccgcgttattgatcctcgtagatgcctgaagcccgtgatccttaaagacggaccagaacgggtcattctagctggtccgatgcctgtgaccgtagccagcgcagcccagaggcgcggccgagtggggagaaaccataataaggagggagatcagtacatatatatgggccagcccctgaacaatgacgaggatcacgctcactggactgaagccaagatgttgttagacaacatcaatacaccagagggtattatccccgcgctgtttgaacctgagcgggaaaaatcagcagccatcgatggggagtacaggctccgcggcgaggctagaaagaccttcgttgaactgatgaggcggggagaccttccagtctggctgagttataaagtggcctctgagggctttcaatactccgatcgtcgctggtgcttcgacggggaacgaaacaatcaggtgctcgaggaaaacatggatgtcgagatttggacaaaggagggagaaaggaaaaagttgaggccccggtggctggacgctcgcacttatagcgaccctctagcactgagagagtttaaagagttcgccgctggtaggcggtcagttagtggcgatctcatacttgagatcgggaagctgccgcagcatttaacgcagcgagcccaaaatgcattggacaacctggtgatgctccacaatagcgaacagggaggcagagcgtaccgccatgccatggaggagctgccagataccattgaaacacttatgctgctcgctttgatcgccgtactgactggtggggtgaccttatttttcctatccggcaggggactgggcaagacatctattgggctcctttgtgtcatggcaagctccgtgctgttgtggatggcttcagttgagccccactggatcgccgcatctataatcctggaatttttcctcatggtgctgcttattcctgagcccgaccggcagcgtaccccacaggataaccaactcgcctatgtcgtaatcggactgttgtttatgattctgactgtggctgcgaatgagatgggtttactagaaacgaccaaaaaggacctgggcatcgggcacgttgccgtggagaaccatcaccatgcagctatgctcgatgtcgaccttcaccctgccagtgcctggacactgtacgcagtggctactaccataattacacccatgatgagacataccatcgaaaacactacagccaatatttcgttgacggcgatcgctaaccaggccgcaatactgatgggactcgataaaggctggccaatcagcaagatggacattggtgtccctctgcttgccttagggtgctactcccaggtgaatccgctgaccctcactgctgcagttttgatgctggtggcccactatgcgatcattggccccggactacaagctaaagccacaagggaggcacagaagcgcaccgccgctggcatcatgaagaacccaaccgtagatgggatagtggccattgacctggatcctgtcgtttacgacgcaaaattcgaaaagcagctcggacagatcatgcttctgatcttgtgtacatctcaaattctgctcatgcggactacgtgggctctgtgcgagtcaatcaccttagccacaggcccccttactaccctgtgggagggtagcccagggaaattttggaatacaaccatagcggtgtccatggccaacattttccgaggaagttatctcgcaggcgctggtctagccttctctctgatgaaaagcctaggcgggggaagaaggggcactggggcacagggagaaacgctgggcgagaaatggaagcgccagctcaatcagctttcaaagtccgaatttaacacatacaaacggagtggtatcatggaggtcgacagaagcgaagctaaggaggggctgaaacgtggagagaccactaagcacgccgtgtctaggggcaccgccaaattgcggtggttcgtagaacgcaatctggtgaagcctgagggtaaggttattgatctcggctgtgggcgaggaggctggtcctattactgcgcggggttgaaaaaggtgacagaagtcaaaggatatactaagggcggtcccgggcatgaggaaccgatcccaatggctacctacggatggaacctggtgaaacttcactcaggcaaggacgtctttttcatacctcccgagaaatgtgatacactgctatgcgacatcggcgagagctcgccaaatcccacgattgaagaggggagaaccctcagggtgctgaagatggttgaaccttggttgcggggaaaccaattttgtatcaagattctgaatccgtacatgccctctgtagtggagactctcgagcagatgcagcgcaaacatggtggcatgcttgtcagaaacccactgagtagaaattccacacacgaaatgtattgggtgagctgcgggaccggaaacatcgtttcagcagtgaatatgacttcccgaatgttactgaaccggttcacaatggcccaccgtaagcctacctacgagagagatgtcgacttgggcgctggtacgcgccatgtggccgtagaacccgaggtggcaaacctcgatattatcgggcagaggatagaaaatattaaacacgagcataagtctacctggcactatgacgaggataacccttacaaaacatgggcctatcatggaagctacgaagttaagccaagtggctccgctagctctatggtcaatggcgtggtgaagctgctaactaaaccctgggacgtcatccctatggttacccaaatcgcgatgacagatactaccccatttgggcagcagcgggtgttcaaggagaaagtagacacaagaacccccaaggccaaacgcggaactacgcaaattatggaagtgacagcaaggtggctttggggttttctgtcacgaaacaagaagccgcggatatgtaccagagaggagttcactaggaaagtccgcagtaatgctgccatcggcgcagtgtttgttgacgagaaccagtggaactccgccaaggaggctgtggaagatgagcgtttctgggacctcgtccaccgggaaagagagctgcacaaacaggggaagtgcgcaacctgcgtgtataacatgatgggaaaaagggaaaagaagttgggcgagtttggtaaagcgaaggggagccgcgcaatttggtacatgtggctgggagcccgattcctcgagttcgaagctcttggctttatgaatgaggatcattggttctctcgggaaaactcgctgtcaggcgtagagggggagggattacacaaactgggttacatcttgagagacattagcaagatccctggcgggaatatgtatgccgatgacacagcaggatgggatacgaggataaccgaagacgatctccagaacgaggctaaaatcactgacattatggaaccagagcatgccctgctagctaaggccatctttaaacttacataccaaaataaggttgtgcgcgtccagagacccgcaaagaacggcaccgtgatggatgtgatttcccggagggaccagcgtggtagtgggcaggtcggaacttatggcctgaatacattcaccaacatggaagcgcaactcatccgacagatggagtctgagggcatatttagcccttccgaactggagacaccaaacttggccgaacgcgttttagattggctggagaaatacggggtggaaagactcaagcggatggctatttcaggagacgactgtgtagtgaaacccatcgatgacaggttcgccactgcacttaccgctctgaatgatatgggtaaggtccgcaaagacatcccgcagtgggagcctagtaagggctggaacgattggcagcaagtgcccttttgctctcaccacttccatcagctaattatgaaggacgggagagagatagttgtgccatgtcggaatcaggatgaactggtcggaagggcccgagtgagccagggcgcaggttggtccctccgtgagacggcctgcttggggaaatcatatgcgcaaatgtggcagctgatgtactttcacagacgcgaccttcggctggctgccaacgcaatctgtagcgccgtacctgttgattgggtgcccacctctaggacaacttggtccattcatgctcaccatcagtggatgaccacagaagacatgctcagtgtctggaatagagtgtggatcgaggaaaacccatggatggaggataagactcacattagctcgtgggaggacgttccctatttaggaaaacgcgaagaccaatggtgcggctccctgatcggcttgaccgcccgggcaacgtgggctacaaatatacaggtggccatcaaccaggtcaggcgactgattgggaatgagaactacctcgattacatgacctctatgaagagattcaaaaatgaatcagaccctgagggagcgctttggtga

SEQ ID NO: 14148 - RNA, 9879 nt, synthetic construct
  misc_feature 1..9879: note = derived and/or modified CDS sequence (opt3) from DENV-1__KC762635__SS-prME
  source 1..9879: mol_type = other RNA
agcgtgaccatgctgctcatgcttatgcccacagcactggctttccacttgactacgagaggcggggaacctcatatgatcgtctccaagcaggaaagaggaaaatctttactgtttaagacctcagccggtgttaacatgtgcacactgattgccatggacctcggcgaactgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagcgggtggaaacttgggctctgcgccaccctggattcaccgttattgcactgtttctcgcccatgctatcggcacatcgattacccagaaaggcatcatattcatcttactgatgcttgtgacgccatcaatggccatgagatgcgtcgggattggaagcagggattttgtggagggtttgagtggcgcgacttgggtagacgttgtgctggagcacgggtcctgtgtcacaaccatggcaaaggataagcccactctagacatcgaactcctgaaaacagaggtgaccaaccctgccgtgcttcggaagctgtgcattgaagctaaaatctctaatacgaccacagatagccgctgtccaactcaaggagaggccaccttggtcgaagaacaagacgcaaacttcgtttgccgaagaacatttgtggataggggctggggtaatgggtgtggactcttcggcaagggctccctgataacttgcgctaaatttaagtgcgtaaccaagttagaggggaaaattgtgcagtacgaaaacctgaagtattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccacggacaggattggacttcaacgaaatggtcctactgacgatgaaagagaagtcttggctcgtgcataaacagtggtttctggatcttccgctgccctggacctccggcgcatcaactagccaagagacatggaatcgtcaggacttgctcgtaaccttcaagacagctcacgccaaaaagcaggaagttgtggtcctgggtagtcaagagggggctatgcacactgccttaaccggcgcaacggaaatccagacctctggaacaactaccatttttgccggccatctgaagtgccgcctaaaaatggataagctcacactgaaagggatgtcctatgtgatgtgtactgggagcttcaaacttgagaaagaagtcgctgagacccagcacggtacggtgttggttcagataaagtacgagggcacagacgcgccttgcaagatcccattctcgacccaagatgaaaaaggggtgactcagaacggaagactgattacagcaaatcccatcgtaaccgacaaggagaaacctgtcaacatagaagccgagccaccctttggcgagtcttatattgtgatcggtgctggggaaaaggccctcaaactgtcctggttcaagaagggctcaagtatcggaaaaatgtttgaggcaactgccaggggcgctcggcgaatggccattcttggggataccgcatgggacttcggaagcatcggtggcgtttttacatccgtggggaagctggtccatcagattttcggaacggcgtacggcgtgttgttttctggtgtaagctggaccatgaaaatagggatcggcgtgctcctgacttggttaggactaaattcacgcagtacatccctaagcatgacctgtattgctgttggcctcgtcacactgtaccttggggtgatggtgcaggccgattctggatgcgtcatcaactggaagggcagagaattgaaatgtggttcagggatcttcgttactaatgaggtgcacacctggacggaacaatataagtttcaggcagacagtccgaagaggctgagcgccgctattggaaaagcctgggaggagggcgtgtgcggtatacggtccgcaacacgcctcgaaaacatcatgtggaagcagatttctaacgagctgaatcatatcttactggaaaacgacatgaaattcaccgtagtcgtgggcgatgttgctgggattcttgcccagggaaagaaaatgatcagacctcaacccatggagcacaagtactcgtggaaaagctggggcaaggcgaagataatcggggccgacgtgcagaatactacctttattatcgatggaccaaacacacctgaatgtcccgacgatcagagggcttggaatatttgggaggtcgaggactatggcttcggtatctttactaccaacatatggttgaaactccgtgattcctacacacaggtgtgcgaccaccggctgatgtcagcagccattaaggatagtaaagctgttcatgccgacatggggtattggatcgaatctgagaagaatgaaacgtggaaactagcacgagcgagcttcattgaggtgaagacctgtatctggccaaagtcccacactctgtggtcaaacggagtactcgaaagcgagatgataatccccaaaatttacggcggtcctatctctcaacataattatagaccaggctacttcacacagaccgccgggccgtggcacctgggaaaacttgagttggattttaacctgtgcgaaggcactacagtcgtggtggacgagcactgcgggaataggggaccctccttacgcaccacgactgtcaccggcaaaattatccatgaatggtgttgccggagttgtacactccctccactgagattcaggggtgaggatgggtgctggtacggaatggagatacgccccgttaaggaaaaagaggaaaaccttgtgaagtccatggtatctgctggctccggtgaggtggactcatttagtctgggcttgctctgtattagcatcatgatcgaagaggtcatgcgatcgcggtggtcccgtaagatgctgatgaccgggactctagccgtgttctttctgctcattatgggacagctgacatggaatgaccttatcagattgtgcattatggttggcgcaaacgcttctgataggatggggatgggaaccacatatctggccttaatggcaactttcaaaatgcgccctatgtttgccgtgggcctcctgttccggagacttaccagcagggaggtcctgctactcacgataggtctgtcattggtggctagtgttgaactgccaaattccttagaggaactcggggacggactggcgatgggcatcatgattcttaagctgttgacagattttcaatctcaccagctctgggccaccctgctaagcctgactttcatcaaaaccacattttcccttcattacgcatggaagactatggctatggtgctctcaattgtcagcctgttccccttgtgtctgagtaccacgtctcagaaaacaacctggttaccggtactcctgggctcccttgggtgcaagcctctgactatgtttttgatcgccgagaacaagatatggggacgaaaaagctggccactcaacgaaggtatcatggccgtgggcattgtttcgatcctgctatcatctctgcttaagaatgacgtgcccctcgctgggcctctgattgcaggaggcatgttgatcgcctgttatgtcataagtggttccagcgcggatttatctctggagaaagctgccgaggtgagctgggaagaggaagcagagcactccggggcctcacataacattctcgtagaagtgcaggacgatggaacaatgaagatcaaagacgaggagcgcgatgacaccctgactatccttctgaaggctacattgctagcagtcagtggcgtttaccccctgagcattccagccaccctcttcgtgtggtatttctggcagaagaagaagcagcggtctggcgtgctgtgggatacgccttcacccccagaagtcgagagagcggtgcttgacgatgggatatacaggatcatgcagcgtggattactgggtcgcagccaggttggcgtaggggtgtttcaagaaaatgtcttccacactatgtggcacgtgacccggggagctgttctcatgtatcagggcaaaagattggagccgagttgggccagcgtgaagaaagacctgatttcctacggtgggggatggaggctccagggctcttggaacacaggcgaggaagtccaggtgatcgcagtagagcctgggaagaatcccaaaaacgtccaaaccgccccaggaacatttaagactcccgaaggtgaggtgggcgctattgccctggacttcaagcctgggacctcgggaagcccaatcgttaatcgagaaggcaaaatagtgggtctttacgggaacggagtcgtgacgacatcaggcacttatgtttccgcaatcgctcaggccaaggcgagtcaggagggccccctgcctgagattgaagatgaggtgtttcggaaacgcaatttgaccatcatggacctacatccggggtctggaaagacaagaaggtacctgccagccattgtccgggaagcaatcaaacgaaagctcagaaccttaatactggctcccactcgcgtggtagccagcgagatggctgaagcacttaagggtatgcctattaggtatcaaaccacagccgtgaaatccgagcacacgggcaaggagatcgttgatctgatgtgccatgccactttcaccatgcgtctcttgtcaccagtccgggtgcccaactacaatatgatcattatggacgaagctcactttacagatccttctagcatcgcggcaagagggtatataagtaccagggtgggaatgggcgaggccgctgccattttcatgactgcaacaccgcccggttccgtcgaagcctttccacagagcaacgctgtaatccaggacgaggaacgcgatattcctgagcgatcttggaactcagggtacgagtggatcaccgacttccccggaaaaacggtgtggtttgttccatccataaagagtggcaacgatattgcgaattgtctgaggaagaatggcaagcgggtgatccagctcagcaggaagactttcgacacagaatatcagaagaccaagaacaatgattgggactacgtcgtgaccactgacatctcggagatgggggccaacttccgcgcagatcgtgttattgaccctagacggtgcctgaaacccgtgatccttaaggatggaccagaaagggtcattctagctggtccgatgcctgtgacagtagcctctgcagcccagcgccgaggcagagtggggcggaatcataacaaagagggagaccagtacatatatatgggccagcccctgaataacgatgaggaccacgctcactggaccgaagccaagatgttgttagataatatcaacacaccagagggtattatccccgcgctgtttgaacctgagagggaaaagtccgcagccatcgacggggagtaccgcctcagaggcgaggctaggaaaactttcgttgaactgatgcggcgtggagatcttccagtctggctgagctataaggtggcctcagagggctttcaatacagtgaccgccgatggtgcttcgatggggaaagaaataaccaggtgctcgaggaaaatatggacgtcgagatttggacgaaagagggagaaaggaagaaattgcggccccgctggctggatgctagaacctattctgaccctctagcactgagggagtttaaggagttcgccgctggtcggcgatccgttagcggcgacctcatacttgagatcgggaaactgccgcagcatttaacacagagagcccaaaacgcattggataatctggtgatgctccacaactcagaacagggaggccgcgcgtacaggcatgccatggaggagctgccagacactattgaaacccttatgctgctcgctttgatcgccgtactgacaggtggggtgaccttatttttcctaagtggccggggactgggcaagactagcattgggctcctttgtgtcatggcatcctctgtgctgttgtggatggctagcgttgagccccactggatcgccgcatccataatcctggaatttttcctcatggtgctgcttattcctgagcccgatcgtcagagaacgccacaggacaatcaactcgcctatgtcgtaatcggactgttgtttatgattctgaccgtggctgcgaacgagatgggtttactagaaacaactaagaaagatctgggcatcgggcacgttgccgtggagaaccatcaccatgcagctatgctcgacgtcgatcttcaccctgcctcagcctggaccctgtacgcagtggctacaaccataattactcccatgatgaggcatacaatcgaaaatacgaccgccaacatttctttgactgcgatcgctaatcaggccgcaatactgatgggactcgacaagggctggccaatcagtaaaatggatattggtgtccctctgcttgccttagggtgctactcgcaagtgaacccgctgacactcaccgctgcagttttgatgctggtggcccactatgcgatcattggccccggactacaagctaaggccacccgcgaggcacagaaacggacagccgctggcatcatgaagaatccaactgtagacgggatagtggccattgatctggaccctgtcgtttacgatgcaaagttcgaaaaacagctcggacagatcatgcttctgatcttgtgtacgagccaaattctgctcatgcgaaccacatgggctctgtgcgagtccatcactttagccaccggcccccttacaaccctgtgggagggttctccagggaagttttggaacactacgatagcggtgtcaatggccaatattttcagaggaagctatctcgcaggcgctggtctagccttctccctgatgaaaagtttgggcgggggaaggcgcggcacaggggcacagggagaaaccctgggcgagaagtggaaacggcagctcaaccagctttctaagagcgaatttaatacttacaagagatcaggtatcatggaggtcgaccgttccgaagctaaagaggggctgaagaggggagagaccacaaaacacgccgtgagtcggggcactgccaagttgcgctggttcgtagaacgaaacctggtgaaacctgagggtaaggttattgacctcggctgtgggagaggaggctggagctattactgcgcggggttaaagaaagtgaccgaagtcaagggatatacaaaaggcggtcccgggcatgaggaaccgatcccaatggctacgtacggatggaatctggtgaaacttcactctggcaaagatgtctttttcatacctcccgagaagtgtgacaccctgctatgcgatatcggcgagtcctcaccaaaccccactattgaagaggggaggacactccgggtgctgaaaatggttgaaccttggttgcgcggaaatcaattttgtatcaagattctgaacccgtacatgcccagcgtagtggagaccctcgagcagatgcagagaaagcatggtggcatgcttgtcaggaatccactgtcgcgaaactctactcacgaaatgtattgggtgagttgcgggacaggaaatatcgtttccgcagtgaacatgaccagccggatgttactgaaccgtttcacgatggcccacagaaaacctacctacgagcgcgacgtcgatttgggcgctggtacaaggcatgtggccgtagaacccgaggtggcaaatctcgacattatcgggcagcggatagaaaacattaagcacgagcataaatcaacttggcactatgatgaggacaatccttacaagacctgggcctatcatggatcctacgaagttaaaccatctggcagcgctagttccatggtcaacggcgtggtgaagctgctaacaaagccctgggatgtcatccctatggttactcaaatcgcgatgaccgacacaaccccatttgggcagcagagagtgttcaaagagaaggtagatactcgcacgcccaaagccaagaggggaacaacccaaattatggaagtgactgcacgatggctttggggttttctgagccggaataaaaagccgagaatatgtaccagggaggagttcacacgcaaggtccgttctaacgctgccatcggcgcagtgtttgttgacgagaatcagtggaactcagccaaagaggctgtggaagacgagcggttctgggatctcgtccacagagaaagggagctgcacaagcaggggaaatgcgccacgtgcgtgtataatatgatgggaaagcgcgagaagaagttgggcgagtttggtaaggcgaaagggagtcgagcaatttggtacatgtggctgggagcccggttcctcgagttcgaagctcttggctttatgaacgaggaccattggttctccagagaaaatagcctgtctggcgtagagggggagggattacacaagctgggttacatcttgagggatatttcgaaaatccctggcgggaacatgtatgccgacgataccgcaggatgggacactcgcataacagaagatgacctccagaatgaggctaagatcaccgatattatggaaccagagcatgccctgctagctaaagccatctttaaacttacttaccaaaacaaagttgtgagagtccagcggcccgcaaagaatggcacagtgatggacgtgatttcaaggcgtgatcagcgaggtagcgggcaggtcggaacctatggcctgaacacattcactaacatggaagcgcaactcatccgccagatggagtccgagggcatatttagtccttctgaactggagaccccaaatttggccgaaagagttttagactggctggagaagtacggggtggaacggctcaaaaggatggctattagcggagatgactgtgtagtgaagcccatcgacgatcgcttcgccacggcacttaccgctctgaacgacatgggtaaagtcagaaaggatatcccgcagtgggagccttccaaaggctggaatgactggcagcaagtgcccttttgctcacaccacttccatcagctaattatgaaggatgggcgggagatagttgtgccatgtaggaaccaggacgaactggtcggacgagcccgtgtgagtcagggcgcaggttggtctctcagagagacagcctgcttgggaaagagctatgcgcaaatgtggcagctgatgtactttcaccgccgggatcttaggctggctgccaatgcaatctgttccgccgtacctgttgactgggtgcccacttcaagaaccacatggagcattcatgctcaccatcagtggatgactaccgaagatatgctctctgtctggaaccgcgtgtggatcgaggaaaatccatggatggaggacaaaacgcacatttccagttgggaggatgttccctatttaggaaagcgggaagaccaatggtgcggcagcctgatcggcttgacagccagggcaacctgggctactaacatacaggtggccatcaatcaggtccgaagactgattgggaacgagaattacctcgactacatgacatcgatgaaacggttcaagaacgaatccgatcctgagggagcgctttggtga

SEQ ID NO: 14149 - RNA, 9879 nt, synthetic construct
  misc_feature 1..9879: note = derived and/or modified CDS sequence (opt3) from DENV-1__KC762650__SS-prME
  source 1..9879: mol_type = other RNA
agcgtgaccatgctgctcatgcttatgcccacagcactggctttccacttgactacgagaggcggggaacctcatatgatcgtctccaagcaggaaagaggaaaatctttactgtttaagacctcagccggtgttaacatgtgcacactgattgccatggacctcggcgaactgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagcgggtggaaacttgggctctgcgccaccctggattcaccgttattgcactgtttctcgcccatgctatcggcacatcgattacccagaaaggcatcatattcatcttactgatgcttgtgacgccatcaatggccatgagatgcgtcgggattggaagcagggattttgtggagggtttgagtggcgcgacttgggtagacgttgtgctggagcacgggtcctgtgtcacaaccatggcaaaggataagcccactctagacatcgaactcctgaaaacagaggtgaccaaccctgccgtgcttcggaagctgtgcattgaagctaaaatctctaatacgaccacagatagccgctgtccaactcaaggagaggccaccttggtcgaagaacaagacgcaaacttcgtttgccgaagaacatttgtggataggggctggggtaatgggtgtggactcttcggcaagggctccctgataacttgcgctaaatttaagtgcgtaaccaagttagaggggaaaattgtgcagtacgaaaacctgaagtattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccacggacaggattggacttcaacgaaatggtcctactgacgatgaaagagaagtcttggctcgtgcataaacagtggtttctggatcttccgctgccctggacctccggcgcatcaactagccaagagacatggaatcgtcaggacttgctcgtaaccttcaagacagctcacgccaaaaagcaggaagttgtggtcctgggtagtcaagagggggctatgcacactgccttaaccggcgcaacggaaatccagacctctggaacaactaccatttttgccggccatctgaagtgccgcctaaaaatggataagctcacactgaaagggatgtcctatgtgatgtgtactgggagcttcaaacttgagaaagaagtcgctgagacccagcacggtacggtgttggttcagataaagtacgagggcacagacgcgccttgcaagatcccattctcgacccaagatgaaaaaggggtgactcagaacggaagactgattacagcaaatcccatcgtaaccgacaaggagaaacctgtcaacatagaagccgagccaccctttggcgagtcttatattgtgatcggtgctggggaaaaggccctcaaactgtcctggttcaagaagggctcaagtatcggaaaaatgtttgaggcaactgccaggggcgctcggcgaatggccattcttggggataccgcatgggacttcggaagcatcggtggcgtttttacatccgtggggaagctggtccatcagattttcggaacggcgtacggcgtgttgttttctggtgtaagctggaccatgaaaatagggatcggcgtgctcctgacttggttaggactaaattcacgcagtacatccctaagcatgacctgtattgctgttggcctcgtcacactgtaccttggggtgatggtgcaggccgattctggatgcgtcatcaactggaagggcagagaattgaaatgtggttcagggatcttcgttactaatgaggtgcacacctggacggaacaatataagtttcaggcagacagtccgaagaggctgagcgccgctattggaaaagcctgggaggagggcgtgtgcggtatacggtccgcaacacgcctcgaaaacatcatgtggaagcagatttctaacgagctgaatcatatcttactggaaaacgacatgaaattcaccgtagtcgtgggcgatgttgctgggattcttgcccagggaaagaaaatgatcagacctcaacccatggagcacaagtactcgtggaaaagctggggcaaggcgaagataatcggggccgacgtgcagaatactacctttattatcgatggaccaaacacacctgaatgtcccgacgatcagagggcttggaatatttgggaggtcgaggactatggcttcggtatctttactaccaacatatggttgaaactccgtgattcctacacacaggtgtgcgaccaccggctgatgtcagcagccattaaggatagtaaagctgttcatgccgacatggggtattggatcgaatctgagaagaatgaaacgtggaaactagcacgagcgagcttcattgaggtgaagacctgtatctggccaaagtcccacactctgtggtcaaacggagtactcgaaagcgagatgataatccccaaaatttacggcggtcctatctctcaacataattatagaccaggctacttcacacagaccgccgggccgtggcacctgggaaaacttgagttggattttaacctgtgcgaaggcactacagtcgtggtggacgagcactgcgggaataggggaccctccttacgcaccacgactgtcaccggcaaaattatccatgaatggtgttgccggagttgtacactccctccactgagattcaggggtgaggatgggtgctggtacggaatggagatacgccccgttaaggaaaaagaggaaaaccttgtgaagtccatggtatctgctggctccggtgaggtggactcatttagtctgggcttgctctgtattagcatcatgatcgaagaggtcatgcgatcgcggtggtcccgtaagatgctgatgaccgggactctagccgtgttctttctgctcattatgggacagctgacatggaatgaccttatcagattgtgcattatggttggcgcaaacgcttctgataggatggggatgggaaccacatatctggccttaatggcaactttcaaaatgcgccctatgtttgccgtgggcctcctgttccggagacttaccagcagggaggtcctgctactcacgataggtctgtcattggtggctagtgttgaactgccaaattccttagaggaactcggggacggactggcgatgggcatcatgattcttaagctgttgacagattttcaatctcaccagctctgggccaccctgctaagcctgactttcatcaaaaccacattttcccttcattacgcatggaagactatggctatggtgctctcaattgtcagcctgttccccttgtgtctgagtaccacgtctcagaaaacaacctggttaccggtactcctgggctcccttgggtgcaagcctctgactatgtttttgatcgccgagaacaagatatggggacgaaaaagctggccactcaacgaaggtatcatggccgtgggcattgtttcgatcctgctatcatctctgcttaagaatgacgtgcccctcgctgggcctctgattgcaggaggcatgttgatcgcctgttatgtcataagtggttccagcgcggatttatctctggagaaagctgccgaggtgagctgggaagaggaagcagagcactccggggcctcacataacattctcgtagaagtgcaggacgatggaacaatgaagatcaaagacgaggagcgcgatgacaccctgactatccttctgaaggctacattgctagcagtcagtggcgtttaccccctgagcattccagccaccctcttcgtgtggtatttctggcagaagaagaagcagcggtctggcgtgctgtgggatacgccttcacccccagaagtcgagagagcggtgcttgacgatgggatatacaggatcatgcagcgtggattactgggtcgcagccaggttggcgtaggggtgtttcaagaaaatgtcttccacactatgtggcacgtgacccggggagctgttctcatgtatcagggcaaaagattggagccgagttgggccagcgtgaagaaagacctgatttcctacggtgggggatggaggctccagggctcttggaacacaggcgaggaagtccaggtgatcgcagtagagcctgggaagaatcccaaaaacgtccaaaccgccccaggaacatttaagactcccgaaggtgaggtgggcgctattgccctggacttcaagcctgggacctcgggaagcccaatcgttaatcgagaaggcaaaatagtgggtctttacgggaacggagtcgtgacgacatcaggcacttatgtttccgcaatcgctcaggccaaggcgagtcaggagggccccctgcctgagattgaagatgaggtgtttcggaaacgcaatttgaccatcatggacctacatccggggtctggaaagacaagaaggtacctgccagccattgtccgggaagcaatcaaacgaaagctcagaaccttaatactggctcccactcgcgtggtagccagcgagatggctgaagcacttaagggtatgcctattaggtatcaaaccacagccgtgaaatccgagcacacgggcaaggagatcgttgatctgatgtgccatgccactttcaccatgcgtctcttgtcaccagtccgggtgcccaactacaatatgatcattatggacgaagctcactttacagatccttctagcatcgcggcaagagggtatataagtaccagggtgggaatgggcgaggccgctgccattttcatgactgcaacaccgcccggttccgtcgaagcctttccacagagcaacgctgtaatccaggacgaggaacgcgatattcctgagcgatcttggaactcagggtacgagtggatcaccgacttccccggaaaaacggtgtggtttgttccatccataaagagtggcaacgatattgcgaattgtctgaggaagaatggcaagcgggtgatccagctcagcaggaagactttcgacacagaatatcagaagaccaagaacaatgattgggactacgtcgtgaccactgacatctcggagatgggggccaacttccgcgcagatcgtgttattgaccctagacggtgcctgaaacccgtgatccttaaggatggaccagaaagggtcattctagctggtccgatgcctgtgacagtagcctctgcagcccagcgccgaggcagagtggggcggaatcataacaaagagggagaccagtacatatatatgggccagcccctgaataacgatgaggaccacgctcactggaccgaagccaagatgttgttagataatatcaacacaccagagggtattatccccgcgctgtttgaacctgagagggaaaagtccgcagccatcgacggggagtaccgcctcagaggcgaggctaggaaaactttcgttgaactgatgcggcgtggagatcttccagtctggctgagctataaggtggcctcagagggctttcaatacagtgaccgccgatggtgcttcgatggggaaagaaataaccaggtgctcgaggaaaatatggacgtcgagatttggacgaaagagggagaaaggaagaaattgcggccccgctggctggatgctagaacctattctgaccctctagcactgagggagtttaaggagttcgccgctggtcggcgatccgttagcggcgacctcatacttgagatcgggaaactgccgcagcatttaacacagagagcccaaaacgcattggataatctggtgatgctccacaactcagaacagggaggccgcgcgtacaggcatgccattgaggagctgccagacactatcgaaacccttatgctgctcgctttgattgccgtactgacaggtggggtgaccttatttttcctaagtggccggggactgggcaagactagcatcgggctcctttgtgtcatggcatcctctgtgctgttgtggatggctagcgttgagccccactggatagccgcatccatcattctggaatttttcctcatggtgctgcttatccctgagcccgatcgtcagagaacgccacaggacaatcaactcgcctatgtcgtaattggactgttgtttatgatcctgaccgtggctgcgaacgagatgggtttactagaaacaactaagaaagatctgggcatagggcacgttgccgtggagaaccatcaccatgcagctatgctcgacgtcgatcttcaccctgcctcagcctggaccctgtacgcagtggctacaaccattatcactcccatgatgaggcatacaattgaaaatacgaccgccaacatctctttgactgcgatagctaatcaggccgcaatcctgatgggactcgacaagggctggccaattagtaaaatggatatcggtgtccctctgcttgccttagggtgctactcgcaagtgaacccgctgacactcaccgctgcagttttgatgctggtggcccactatgcgattatcggccccggactacaagctaaggccacccgcgaggcacagaaacggacagccgctggcataatgaagaatccaactgtagacgggattgtggccatcgatctggaccctgtcgtttacgatgcaaagttcgaaaaacagctcggacagatcatgcttctgattttgtgtacgagccaaatcctgctcatgcgaaccacatgggctctgtgcgagtccataactttagccaccggcccccttacaaccctgtgggagggttctccagggaagttttggaacactacgattgcggtgtcaatggccaatatcttcagaggaagctatctcgcaggcgctggtctagccttctccctgatgaaaagtttgggcgggggaaggcgcggcacaggggcacagggagaaaccctgggcgagaagtggaaacggcagctcaaccagctttctaagagcgaatttaatacttacaagagatcaggtattatggaggtcgaccgttccgaagctaaagaggggctgaagaggggagagaccacaaaacacgccgtgagtcggggcactgccaagttgcgctggttcgtagaacgaaacctggtgaaacctgagggtaaggttatcgacctcggctgtgggagaggaggctggagctattactgcgcggggttaaagaaagtgaccgaagtcaagggatatacaaaaggcggtcccgggcatgaggaaccgataccaatggctacgtacggatggaatctggtgaaacttcactctggcaaagatgtctttttcatccctcccgagaagtgtgacaccctgctatgcgatattggcgagtcctcaccaaaccccactatcgaagaggggaggacactccgggtgctgaaaatggttgaaccttggttgcgcggaaatcaattttgtattaagatcctgaacccgtacatgcccagcgtagtggagaccctcgagcagatgcagagaaagcatggtggcatgcttgtcaggaatccactgtcgcgaaactctactcacgaaatgtattgggtgagttgcgggacaggaaatattgtttccgcagtgaacatgaccagccggatgttactgaaccgtttcacgatggcccacagaaaacctacctacgagcgcgacgtcgatttgggcgctggtacaaggcatgtggccgtagaacccgaggtggcaaatctcgacatcatagggcagcggattgaaaacatcaagcacgagcataaatcaacttggcactatgatgaggacaatccttacaagacctgggcctatcatggatcctacgaagttaaaccatctggcagcgctagttccatggtcaacggcgtggtgaagctgctaacaaagccctgggatgtcatccctatggttactcaaattgcgatgaccgacacaaccccatttgggcagcagagagtgttcaaagagaaggtagatactcgcacgcccaaagccaagaggggaacaacccaaataatggaagtgactgcacgatggctttggggttttctgagccggaataaaaagccgagaatctgtaccagggaggagttcacacgcaaggtccgttctaacgctgccattggcgcagtgtttgttgacgagaatcagtggaactcagccaaagaggctgtggaagacgagcggttctgggatctcgtccacagagaaagggagctgcacaagcaggggaaatgcgccacgtgcgtgtataatatgatgggaaagcgcgagaagaagttgggcgagtttggtaaggcgaaagggagtcgagcaatctggtacatgtggctgggagcccggttcctcgagttcgaagctcttggctttatgaacgaggaccattggttctccagagaaaatagcctgtctggcgtagagggggagggattacacaagctgggttacattttgagggatatctcgaaaatacctggcgggaacatgtatgccgacgataccgcaggatgggacactcgcatcacagaagatgacctccagaatgaggctaagattaccgatatcatggaaccagagcatgccctgctagctaaagccatttttaaacttacttaccaaaacaaagttgtgagagtccagcggcccgcaaagaatggcacagtgatggacgtgatctcaaggcgtgatcagcgaggtagcgggcaggtcggaacctatggcctgaacacattcactaacatggaagcgcaactcatacgccagatggagtccgagggcatttttagtccttctgaactggagaccccaaatttggccgaaagagttttagactggctggagaagtacggggtggaacggctcaaaaggatggctatcagcggagatgactgtgtagtgaagcccatcgacgatcgcttcgccacggcacttaccgctctgaacgacatgggtaaagtcagaaaggatattccgcagtgggagccttccaaaggctggaatgactggcagcaagtgcccttttgctcacaccacttccatcagctaataatgaaggatgggcgggagatcgttgtgccatgtaggaaccaggacgaactggtcggacgagcccgtgtgagtcagggcgcaggttggtctctcagagagacagcctgcttgggaaagagctatgcgcaaatgtggcagctgatgtactttcaccgccgggatcttaggctggctgccaatgcaatttgttccgccgtacctgttgactgggtgcccacttcaagaaccacatggagcatccatgctcaccatcagtggatgactaccgaagatatgctctctgtctggaaccgcgtgtggattgaggaaaatccatggatggaggacaaaacgcacatctccagttgggaggatgttccctatttaggaaagcgggaagaccaatggtgcggcagcctgataggcttgacagccagggcaacctgggctactaacatccaggtggccattaatcaggtccgaagactgatcgggaacgagaattacctcgactacatgacatcgatgaaacggttcaagaacgaatccgatcctgagggagcgctttggtga
